United States Patent 7,745,391 (HUMAN THROMBOSPONDIN POLYPEPTIDE) - sequence listing, part 15

SEQ ID NO: 36323 - DNA, 1821 bp, Homo sapiens
ggcacgagcatccttacatttccaaggatgcagctgtcccaaagaattcttacccatgggctgaagaatttgcattaatctaaagccaagctctcagggaagctgtgtgcatttaggaaacagcagaggattaatggaacctcctagcctgttgcctcccaacttggccttgttccctgcagcacaaattaaaatcaattgcttgcttaatatgagtctcacccttctccatcttttctctcttagatcgtaccatgaggggttttacttactgttaacttttctctcttagattgcaccatgaggggttttacttactgttaaagaatgcttgtaaagtgtgggttaactgtgctaagaaagtaatctttattcttgggtttggaaaatgaaccacttttgggcagatctttgatgttttcagagatgctagggttagaatttctagatccttattttccaggctaacaattaaattaataagttaaaacattttagtagtttataaacgcataggaaaaggactggatagacactaatgtcaaaagggagacatagaaaagagaatgattgtgttttactctcataggtctataatctttacaatgagaatgtgttttatattaaatagttgtgtaataaaaattcaaacaaattttattctggtcacaagcatgctttctgctctgtcccagacaacaaaaatgacccacattctctctactatgttcacttagctcatcacactctgcctttttaaaaacaccttttgatagaaaactttttgcaaatttaattttttaaaaataacctgctgactcactggtttgtaatggaggacagagtcctttctagatcctcgaatttcgtgcctgtctcccaaggcacatcccccacatcccgtcacagtgctgcaggattagggaggattgcttccagctgaaagagatgggaggccataaaggctctttcttctggatgacgttggaaaggaagaaacatggagttagaaatgcttatgtctccacacgtagcctcttcctgggcaaccctggacagtctctgtctgccaaggtgatcattgtacttgcaaatttacctaacctgttgactgcctgtgttacatttactattgaaccagctagagttcaaaattaacttttgatcactgactttcagtttgaaccaaaaaaataaaaagaggaaagagccacgtaaaaggaaatacagcttgatttcatttttttcttgttttatttgatgaactaaattgtccattcttcaggggctcagaatagatatttccttttgttttgtatcaaatattaaagagagtttgaccttctttgcaggtcagaaaattaattagttaactctggatattgaatatgccacaaagtagactaaaatacttcagatcatttctagaatgaggcaaggcctaaagaaataaatcctctaaatcgagtgaggttggccagagatacctagcattttatggttggctgaagatacccagcattttattaactctttatgacttctttatcacgagatttgagtcacctgctactaagacacataaatagattgtttggtcaacacacaacatgtggattaaagtataactttcagaggcagagaatccaaggggtaaaaataccacatttgctcagtattctaccccagtgcggtggccaaggtggccctgtacctggattggtcttatttctgtttcctagtgttgggggtaactctggactgcattatgctggtgggcctatagtttgtcttcaagttttttaaaaatctcagtcccta

SEQ ID NO: 36324 - DNA, 576 bp, Homo sapiens
ttgcaagtacccacctgcaagtacccacctgcaagtacccacctgctaattggatatttccttttgttttgtatcaaatattaaagagagtttgaccttctttgcaggtcagaaaattaattagttaactctggatattgaatatgccacaaagtagactaaaatacttcagatcatttctagaatgaggcaaggcctaaagaaataaatcctctaaatcgagtgaggttggccagagatacctagcattttatggttggctgaagatacccagcattttattaactctttatgacttctttatcacgagatttgagtcacctgctactaagacacataaatagattgtttggtcaacacacaacatgtggattaaagtataactttcagaggcagagaatccaaggggtaaaaataccacatttgctcagtattctaccccagtgcggtggccaaggtggccctgtacctggattggtcttatttctgtttcctagtgttgggggtaactctggactgcattatgctggtgggcctatagtttgtcttcaagttttttaaaaatctcagtcccta

SEQ ID NO: 36325 - DNA, 888 bp, Homo sapiens
  misc_feature (773)..(773): n is a, c, g, or t
  misc_feature (776)..(776): n is a, c, g, or t
  misc_feature (780)..(781): n is a, c, g, or t
  misc_feature (783)..(783): n is a, c, g, or t
  misc_feature (795)..(795): n is a, c, g, or t
  misc_feature (799)..(799): n is a, c, g, or t
  misc_feature (802)..(803): n is a, c, g, or t
  misc_feature (811)..(811): n is a, c, g, or t
  misc_feature (822)..(822): n is a, c, g, or t
  misc_feature (826)..(826): n is a, c, g, or t
cccgtgcaatccctgcttaagagaccccgcagtggggcgctcgtccgaagccaggccgcgtccgccatagtgcctggcttggaggtgtcgccgccgctcggtgagagcccccgagcggcagggggccaacacaaaaagggagccggagaagccctagccgctgcccagcagcttgcgggcgtgttctcgcggttccgggcctcaaggcgacggaaacgaaaggcgagcgaagcgcggaggatccggcgagaagaagcgtcagggagcctcggcggtgtccccggggtccgccgaagccacccggccgccggctggggcccggggtggtgaggaagtgctccgaggcctcgccgaggcctagcgccggctttgtgtccgaggcggcggcggcggcggggggaggcggagccgggggcggcctgcgggaaggcctctcctccgccgaccgcgcgttttcggcctaggccgtggggccgctcgtggcctccggggagcaggcgccaggggtttgtgtgcggtgggggcctgggcctgggcctggggaagctgacgccggtcgtccggaagccaggaggaggcgtgaggccgctcgtggactccgggcctaggccctctcccctcaaccttctcccggggcctgggtcaccccaatccacggagagagagacccgccgggaggtgcggccgcgctatggacccctgaccccgtggggtcgctcggactcttaacgtgtggactgaccgtatggtgccgcaatccccgtttgcggccnttnttgnngngggcccccgggnttgnccnnggggtctngttccctccgntgtnctctccagagttggtcgcgccttttgcgcacccgggggggtaaccgccgcgccgtgtgcaag

SEQ ID NO: 36326 - DNA, 1690 bp, Homo sapiens
tagagatggggtttcaccgtgttagccaggatggtcttaatctcctgacctcgtgatccgcccccctcagcctcccaaaatgctggtattacaggcgtgaaccaccgcgcctggccagtagtctttttttctttaacaaaaagcaaataatcactttgcttaaaatccttcagtgtcttcctgttgcacttcaaaacaaaatataaatcagtgtatggtctatacctttctgtcattcttttcttttattttcttaggctcttcaagccgtttcgtatcatttttctacatgctttttttatcctttgcctgaaatagtcctcaaccagtttttttcctgtatctggctgggttctcagtctttaagtatccagtagaagttcctccaaggggctttcttggaatcaacattctatctgaagttgtattccactattcattccttattagaaaaccattttctctttattcataacgtcataatttaatttttagtctatcttcctcagtaataatttctgtgaatgcagggattgtaatactcaactaacgtttagggactaggagagacagaatatcttcattccgaataacggctttttcaccattcacatgttcagcatttcagactaaactaaagaatgacggtgttactgagatttggagttccacaaaagtagaagtgctagagccaagaacctgctgatgatattggttgtcctttgaaaagaagccctcttagggctttggatgtttgttctgacaatatcagtaatctagttgcaaggaacttgtagttattatatttaaagtcatttcccatgaaatttatatttgaagttttctaattcttggttacgcactcaaatccccaaatggaaattcaattctgtctttttatttacagaatatactgatgataatgctctgattcctaagaattcttctgtaattgttagaagaattcctattggaggtgttaaatctacaagcaagacatatgttataagtcgaactgaaccagcgatggcaactacaaaagcagtatgtaaaaacacaatctcacactttttctacacattgcttttacctttataatgtagcagtgaagtaaatcattttagaacttaatatccaactgatcatagtacatattgtaaataaaatgtattttgatgacagctcagttgaatatggataatatgtggcatcacttgcacacttattttgtagaaatgggtaatttgtgcccgtaacactgtttcatattaaatatgatagcattatccctgtatgacactgtgttgtacagttaatgtatgatcctttttagatcgtttaggttttacactaaggaacatgatgacatgttctacatttgtctgtctatagttagtattttgtatgtatgtacaggctgttgtgtgctttttgtttcttgcaataaaaaatgtttggagtgtaaaaaaaaaaaccacactaccaaacaaacactttgtggggcgcgcctgggccccttgagagaaagtttttaaaacaccattgcttttgggggcgcgggggccccagtgttgggtttcgtgacacgtgtgctccaggcgtgtccacaaggaaacactctggtcagacacgacgtgctgggattctcccccatataaaagcgcgcgggtgacaccagcgttttttaacc

SEQ ID NO: 36327 - DNA, 1180 bp, Homo sapiens
gtgaaaaatgaaaatagctatcagcctggccctccagatttgaaaattagttttgggagcacagcaatttctcagggattcaaattacaaatgttaacaacagcagtcttcctgatgtgtgaaaatttacgcattcagaaactgggaaattatataatttaaaaattttcagtttattaagaataaactacgtttctaaacataaaatccctatactacctttcagaaaacatttgttttaagtggcagggtacacctatttttgaattccctagtatggaatttttttccaaaccacaaatctatcttaaaactgctcaaaggtggtaaagattaatcagagtaatttattcattcagaaattggctgttaaatatttataccaaaggaaaattaggttcctaaaaatgtattattgaagataatgtgttaaaatttattagcacaaaaattcataaatagctaatgttaatttttgtttttattttgtgttttagaagtcgaactgaaccagcgatggcaactacaaaagcagtatgtaaaaacacaatctcacactttttctacacattgcttttacctttataatgtagcagtgaagtaaatcattttagaacttaatatccaactgatcatagtacatattgtaaataaaatgtattttgatgacagctcagttgaatatggataatatgtggcatcacttgcacacttattttgtagaaatgggtaatttgtgcccgtaacactgtttcatattaaatatgatagcattatccctgtatgacactgtgttgtacagttaatgtatgatcctttttagatcgtttaggttttacactaaggaacatgatgacatgttctacatttgtctgtctatagttagtattttgtatgtatgtacaggctgttgtgtgctttttgtttcttgcaataaaaaatgtttggagtgtaaaaaaaaaaaccacactaccaaacaaacactttgtggggcgcgcctgggccccttgagagaaagtttttaaaacaccattgcttttgggggcgcgggggccccagtgttgggtttcgtgacacgtgtgctccaggcgtgtccacaaggaaacactctggtcagacacgacgtgctgggattctcccccatataaaagcgcgcgggtgacaccagcgttttttaacc

SEQ ID NO: 36328 - DNA, 2038 bp, Homo sapiens
cccgtgcaatccctgcttaagagaccccgcagtggggcgctcgtccgaagccaggccgcgtccgccatagtgcctggcttggaggtgtcgccgccgctcggtgagagcccccgagcggcagggggccaacacaaaaagggagccggagaagccctagccgctgcccagcagcttgcgggcgtgttctcgcggttccgggcctcaaggcgacggaaacgaaaggcgagcgaagcgcggaggatccggcgagaagaagcgtcagggagcctcggcggtgtccccggggtccgccgaagccacccggccgccggctggggcccggggtggtgaggaagtgctccgaggcctcgccgaggcctagcgccggctttgtgtccgaggcggcggcggcggcggggggaggcggagccgggggcggcctgcgggaaggcctctcctccgccgaccgcgcgttttcggcctaggccgtggggccgctcgtggcctccggggagcaggcgccaggggtttgtgtgcggtgggggcctgggcctgggcctggggaagctgacgccggtcgtccggaagccaggaggaggcgtgaggccgctcgtggactccgggcctaggccctctcccctcaaccttctcccggggcctgggtcaccccaatccacggagagagagacccgccgggaggtgcggccgcgctatggacccctgaccccgtggggtcgctcggactcttaacgtgtggactgaccgctactgactgcaccgccaatccccccgtctctgccggccccttagcatgagcgagggggacccagccgggtgacattgtgcccgttggcggattctcgatttcccctcttccccgtcctcgtcctcctcctcccccatgaagtgattctgagtatcggggggtctctggattattgttctgacgaacccctgcttgtggttggggggtatttaatctgaggccttagggtccttcggtgtctttgagtgttttgtgtgtacatattttgctcttaaagtttataaatatacgtatattgagagtgtccacgtctcctcgctgaaccttaggaatcccttggcaccatgtcctgtgtgcattataaattttcctctaaactcaactatgataccgtcacctttgatgggctccacatctccctctgcgacttaaagaagcagattatggggagagagaagctgaaagctgccgactgcgacctgcagatcaccaatgcgcagacgaaagaagaatatactgatgataatgctctgattcctaagaattcttctgtaattgttagaagaattcctattggaggtgttaaatctacaagcaagacatatgttataagtcgaactgaaccagcgatggcaactacaaaagcagtatgtaaaaacacaatctcacactttttctacacattgcttttacctttataatgtagcagtgaagtaaatcattttagaacttaatatccaactgatcatagtacatattgtaaataaaatgtattttgatgacagctcagttgaatatggataatatgtggcatcacttgcacacttattttgtagaaatgggtaatttgtgcccgtaacactgtttcatattaaatatgatagcattatccctgtatgacactgtgttgtacagttaatgtatgatcctttttagatcgtttaggttttacactaaggaacatgatgacatgttctacatttgtctgtctatagttagtattttgtatgtatgtacaggctgttgtgtgctttttgtttcttgcaataaaaaatgtttggagtgtaaaaaaaaaaaccacactaccaaacaaacactttgtggggcgcgcctgggccccttgagagaaagtttttaaaacaccattgcttttgggggcgcgggggccccagtgttgggtttcgtgacacgtgtgctccaggcgtgtccacaaggaaacactctggtcagacacgacgtgctgggattctcccccatataaaagcgcgcgggtgacaccagcgttttttaacc

SEQ ID NO: 36329 - DNA, 1653 bp, Homo sapiens
cccgtgcaatccctgcttaagagaccccgcagtggggcgctcgtccgaagccaggccgcgtccgccatagtgcctggcttggaggtgtcgccgccgctcggtgagagcccccgagcggcagggggccaacacaaaaagggagccggagaagccctagccgctgcccagcagcttgcgggcgtgttctcgcggttccgggcctcaaggcgacggaaacgaaaggcgagcgaagcgcggaggatccggcgagaagaagcgtcagggagcctcggcggtgtccccggggtccgccgaagccacccggccgccggctggggcccggggtggtgaggaagtgctccgaggcctcgccgaggcctagcgccggctttgtgtccgaggcggcggcggcggcggggggaggcggagccgggggcggcctgcgggaaggcctctcctccgccgaccgcgcgttttcggcctaggccgtggggccgctcgtggcctccggggagcaggcgccaggggtttgtgtgcggtgggggcctgggcctgggcctggggaagctgacgccggtcgtccggaagccaggaggaggcgtgaggccgctcgtggactccgggcctaggccctctcccctcaaccttctcccggggcctgggtcaccccaatccacggagagagagacccgccgggaggtgcggccgcgctatggacccctgaccccgtggggtcgctcggactcttaacgtgtggactgaccgctactgactgcaccgccaatccccccgtctctgccggccccttagcatgagcgagggggacccagccgggtgacattgtgcccgttggcggattctcgatttcccctcttccccgtcctcgtcctcctcctcccccatgaagtgattctgagtatcggggggtctctggattattgttctgacgaacccctgcttgtggttggggggtatttaatctgaggccttagggtccttcggtgtctttgagtgttttgtgtgtacatattttgctcttaaagtttataaatatacgtatattgagagtgtccacgtctcctcgctgaaccttaggaatcccttggcaccatgtcctgtgtgcattataaattttcctctaaactcaactatgataccgtcacctttgatgggctccacatctccctctgcgacttaaagaagcagattatggggagagagaagctgaaagctgccgactgcgacctgcagatcaccaatgcgcagacgaaagaaggtaagggccgcttggtcttaagatatttggtggctggagagagatactagctagaaggtgcctggcaggaagctaaccgccattatgtctctagtggggactgttcgttctagtactttggatacaactttcattgatagccaaggtttgcagcagttggccttggagtttcactggtttattttatttctgcatacttgggtcatctgtaacaggctaacccaaaacgtggaagcctgattattcttctcgctgttttttaaaatgagggagggaggagagggggatagctatctagactctttgagtgcttgtcttagggcgttttctaacttattttccatcaggagggcaggagagcctgtgcaaagcttgtttgttcaatcagcaaaaaaaaa

SEQ ID NO: 36330 - DNA, 1278 bp, Homo sapiens
cccgtgcaatccctgcttaagagaccccgcagtggggcgctcgtccgaagccaggccgcgtccgccatagtgcctggcttggaggtgtcgccgccgctcggtgagagcccccgagcggcagggggccaacacaaaaagggagccggagaagccctagccgctgcccagcagcttgcgggcgtgttctcgcggttccgggcctcaaggcgacggaaacgaaaggcgagcgaagcgcggaggatccggcgagaagaagcgtcagggagcctcggcggtgtccccggggtccgccgaagccacccggccgccggctggggcccggggtggtgaggaagtgctccgaggcctcgccgaggcctagcgccggctttgtgtccgaggcggcggcggcggcggggggaggcggagccgggggcggcctgcgggaaggcctctcctccgccgaccgcgcgttttcggcctaggccgtggggccgctcgtggcctccggggagcaggcgccaggggtttgtgtgcggtgggggcctgggcctgggcctggggaagctgacgccggtcgtccggaagccaggaggaggcgtgaggccgctcgtggactccgggcctaggccctctcccctcaaccttctcccggggcctgggtcaccccaatccacggagagagagacccgccgggaggtgcggccgcgctatggacccctgaccccgtggggtcgctcggactcttaacgtgtggactgaccgctactgactgcaccgccaatccccccgtctctgccggccccttagcatgagcgagggggacccagccgggtgacattgtgcccgttggcggattctcgatttcccctcttccccgtcctcgtcctcctcctcccccatgaagtgattctgagtatcggggggtctctggattattgttctgacgaacccctgcttgtggttggggggtatttaatctgaggccttagggtccttcggtgtctttgagtgttttgtgtgtacatattttgctcttaaagtttataaatatacgtatattgagagtgtccacgtctcctcgctgaaccttaggaatcccttggcaccatgtcctgtgtgcattataaattttcctctaaactcaactatgataccgtcacctttgatgggctccacatctccctctgcgacttaaagaagcagattatggggagagagaagctgaaagctgccgactgcgactggagttaccaagggcgcacatgcagattttctgtgggggcgatctgtctccgg

SEQ ID NO: 36331 - DNA, 1832 bp, Homo sapiens
  misc_feature (122)..(122): n is a, c, g, or t
  misc_feature (149)..(150): n is a, c, g, or t
  misc_feature (205)..(205): n is a, c, g, or t
attaaaaagattcgcggcccccaaacctccacgggccccagagcgggaggtgatcccaaaaaaaggagtgtccccaaattcccgggccctcctttccgggacggggaacccagggtcacagnccaccggccagtggccaaattggtttnnacgtcccacatgttggctacccccggccactttggacagatggaggtgcctgaanactgatttcgccctcctccagattcacagacaagaagggtgggctacctggggggccatgcttctattggatgagaggcacgatccccacctgctcattaccaacagcatcaagaatggcctgggcctggggaagctgacgccggtcgtccggaagccaggaggaggcgtgaggccgctcgtggactccgggcctaggccctctcccctcaaccttctcccggggcctgggtcaccccaatccacggagagagagacccgccgggaggtgcggccgcgctatggacccctgaccccgtggggtcgctcggactcttaacgtgtggactgaccgctactgactgcaccgccaatccccccgtctctgccggccccttagcatgagcgagggggacccagccgggtgacattgtgcccgttggcggattctcgatttcccctcttccccgtcctcgtcctcctcctcccccatgaagtgattctgagtatcggggggtctctggattattgttctgacgaacccctgcttgtggttggggggtatttaatctgaggccttagggtccttcggtgtctttgagtgttttgtgtgtacatattttgctcttaaagtttataaatatacgtatattgagagtgtccacgtctcctcgctgaaccttaggaatcccttggcaccatgtcctgtgtgcattataaattttcctctaaactcaactatgataccgtcacctttgatgggctccacatctccctctgcgacttaaagaagcagattatggggagagagaagctgaaagctgccgactgcgacctgcagatcaccaatgcgcagacgaaagaagaatatactgatgataatgctctgattcctaagaattcttctgtaattgttagaagaattcctattggaggtgttaaatctacaagcaagacatatgttataagtcgaactgaaccagcgatggcaactacaaaagcagtatgtaaaaacacaatctcacactttttctacacattgcttttacctttataatgtagcagtgaagtaaatcattttagaacttaatatccaactgatcatagtacatattgtaaataaaatgtattttgatgacagctcagttgaatatggataatatgtggcatcacttgcacacttattttgtagaaatgggtaatttgtgcccgtaacactgtttcatattaaatatgatagcattatccctgtatgacactgtgttgtacagttaatgtatgatcctttttagatcgtttaggttttacactaaggaacatgatgacatgttctacatttgtctgtctatagttagtattttgtatgtatgtacaggctgttgtgtgctttttgtttcttgcaataaaaaatgtttggagtgtaaaaaaaaaaaccacactaccaaacaaacactttgtggggcgcgcctgggccccttgagagaaagtttttaaaacaccattgcttttgggggcgcgggggccccagtgttgggtttcgtgacacgtgtgctccaggcgtgtccacaaggaaacactctggtcagacacgacgtgctgggattctcccccatataaaagcgcgcgggtgacaccagcgttttttaacc

SEQ ID NO: 36332 - DNA, 1146 bp, Homo sapiens
cccgtgcaatccctgcttaagagaccccgcagtggggcgctcgtccgaagccaggccgcgtccgccatagtgcctggcttggaggtgtcgccgccgctcggtgagagcccccgagcggcagggggccaacacaaaaagggagccggagaagccctagccgctgcccagcagcttgcgggcgtgttctcgcggttccgggcctcaaggcgacggaaacgaaaggcgagcgaagcgcggaggatccggcgagaagaagcgtcagggagcctcggcggtgtccccggggtccgccgaagccacccggccgccggctggggcccggggtggtgaggaagtgctccgaggcctcgccgaggcctagcgccggctttgtgtccgaggcggcggcggcggcggggggaggcggagccgggggcggcctgcgggaaggcctctcctccgccgaccgcgcgttttcggcctaggccgtggggccgctcgtggcctccggggagcaggcgccaggggtttgtgtgcggtgggggcctgggcctgggcctggggaagctgacgccggtcgtccggaagccaggaggaggcgtgaggccgctcgtggactccgggcctaggccctctcccctcaaccttctcccggggcctgggtcaccccaatccacggagagagagacccgccgggaggtgcggccgcgctatggacccctgaccccgtggggtcgctcggactcttaacgtgtggactgaccgctactgactgcaccgccaatccccccgtctctgccggccccttagcatgagcgagggggacccagccgggtgacattgtgcccgttggcggattctcgatttcccctcttccccgtcctcgtcctcctcctcccccatgaagtgattctgagtatcggggggtctctggattattgttctgacgaacccctgcttgtggttggggggtatttaatctgaggccttagggtcctcacggaaacattgaaaagatcagtgaaaaaacaaataaaatcttaaaaaacatatgaagaaaaaaacacgctgtaatcgaaaaaaagattaccacataataagatataagatctaaacacatataacggaaaaacacattcttaggaaacctaaatcaatccattatat

SEQ ID NO: 36333 - DNA, 1072 bp, Homo sapiens
cactagagatagccctcgccctttcattcacacagaggcttttaagaaaaaagcaaccaacctgaagaggacctggcagcaataagtttttggtgaaataacaaagaggaatcccttggcaccatgtcctgtgtgcattataaattttcctctaaactcaactatgataccgtcacctttgatgggctccacatctccctctgcgacttaaagaagcagattatggggagagagaagctgaaagctgccgactgcgacctgcagatcaccaatgcgcagacgaaagaagaatatactgatgataatgctctgattcctaagaattcttctgtaattgttagaagaattcctattggaggtgttaaatctacaagcaagacatatgttataagtcgaactgaaccagcgatggcaactacaaaagcagtatgtaaaaacacaatctcacactttttctacacattgcttttacctttataatgtagcagtgaagtaaatcattttagaacttaatatccaactgatcatagtacatattgtaaataaaatgtattttgatgacagctcagttgaatatggataatatgtggcatcacttgcacacttattttgtagaaatgggtaatttgtgcccgtaacactgtttcatattaaatatgatagcattatccctgtatgacactgtgttgtacagttaatgtatgatcctttttagatcgtttaggttttacactaaggaacatgatgacatgttctacatttgtctgtctatagttagtattttgtatgtatgtacaggctgttgtgtgctttttgtttcttgcaataaaaaatgtttggagtgtaaaaaaaaaaaccacactaccaaacaaacactttgtggggcgcgcctgggccccttgagagaaagtttttaaaacaccattgcttttgggggcgcgggggccccagtgttgggtttcgtgacacgtgtgctccaggcgtgtccacaaggaaacactctggtcagacacgacgtgctgggattctcccccatataaaagcgcgcgggtgacaccagcgttttttaacc

SEQ ID NO: 36334 - DNA, 668 bp, Homo sapiens
gccctttttctatcagtctctgatccctcatgggttctgcctgcccttgtatctcttgtacaatgctcccaaagggctttgctgatctctgcacttctttcctgggacactccccccaccaccaccctttgcacacaccagtgaccaaagtgtatgcagtgatctcacagaagacatcaaaaatggtgcatgcaccgtgaatgtgctcacagagacacgtgcacaagattctgcacccttggccttaatctcagtatgacttaaggtgcaggaacatttttaacaggttttaaaaaaacaaaaaacccttctgggaggaaaaaaataaaaagcagatacaacagctcaactgttcccactcctaactctccactatgtgcttataacttcacattctatgccctccccgccacccacctcatccctgttctgcgtaaccaaaaaacagacaacaaaagcaacctgaggagaggtttctggactattttatctgtctccatttagatggagatataaatgctgctttgggttccataatcctagggggctatgtttacatagtaaaatacatcctaccaaatcaggaaacagtgaataatgggagtcacttcacagagacgcaggaggacctgggggcgtagcagaggaggatagtagagaagtaccat

SEQ ID NO: 36335 - DNA, 528 bp, Homo sapiens
tggtaataccttgcagagctgggacaaggttctttattacagaaggctgtatattatgtggattagtgtccaatatatgataatatttctctgatgggcaggattcatggctccaggaaccaaggtataaaaatgggagtggtaccgctcactcttaccctcagtgtcctcctagcaaagtgtttattttctcttcttatgacctcatgctctgctggcttagagttctttgttcctaatggagtaatgcttccaacaagagatacaacaggccgggcgtggtggctcacgcctgtaatcccagcactttgggaggccgaggcgggtcgatcacaaggtcaggagatcgagaccatcctggctaacatggtgaaacaccgtctgtgttaaaaatacaaaaaaaaaaattagccgggcaaggtggcgggtgcctgtagtcccagctactcgggaggctgaggcaggagaatggcgtgaaccctgggggccggagcctgcagtgagccgagatcgtgctactgcattcca

SEQ ID NO: 36336 - DNA, 1567 bp, Homo sapiens
  misc_feature (1275)..(1275): n is a, c, g, or t
taggctagtacgaggccgggtggtgatcggccgctggctcttctcggcgtgctgcggcggaacggctgttggtttctgctggttgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattttaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaatctacaaattacctgtcatatactgangaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggcccctttta

SEQ ID NO: 36337 - DNA, 1662 bp, Homo sapiens
  misc_feature (1370)..(1370): n is a, c, g, or t
cgaacgccttcgcgcgatcgccctggaaacgcattctctgcgaccggcagccgccaatgggaagggagtgagtgccacgaacaggccaataaggagggagcagtgcggggtttaaatctgaggctaggctggctcttctcggcgtgctgcggcggaacggctgttggtttctgctggttgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattttaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaatctacaaattacctgtcatatactgangaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggcccctttta

SEQ ID NO: 36338 - DNA, 996 bp, Homo sapiens
  misc_feature (883)..(883): n is a, c, g, or t
taggctagtacgaggccgggtggtgatcggccgctggctcttctcggcgtgctgcggcggaacggctgttggtttctgctggttgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataatgtgtgccaaagatntgctggtgggtcctgccgttttgcggcattagaagtccccaatgggttgtttgggacactttatatcctacgggaggtcacagtactggggggcccaggctgagaaaggaggg

SEQ ID NO: 36339 - DNA, 1544 bp, Homo sapiens
  misc_feature (1252)..(1252): n is a, c, g, or t
gaactatactgccgtaggtcgaggctgggttagggggaacggctgttggtttctgctggttgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattttaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggacaccaatctacaaattacctgtcatatactgangaatctcttcttccagttatgcagcacctggctaagaatgtagtcatggtaaatcaaggacttacaaagcacatgactgtcaagaacaagtatgccacatcgaagcatgctaagatcagcactctaccacagctgaattctgcactagttcaagatttagccaaggctgtggcaaaggtgtaacttgtaaacttgagttggagtactatatttacaaataaaattggcaccatgtgccatctgtacatattactgttgcatttacttttaataaagcttgtggcccctttta

SEQ ID NO: 36340 - DNA, 928 bp, Homo sapiens
taggctagtacgaggccgggtggtgatcggccgctggctcttctcggcgtgctgcggcggaacggctgttggtttctgctggttgtaggtccttggctggtcgggcctccggtgttctgcttctccccgctgagctgctgcctggtgaagaggaagccatggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaatccgtgtgtgcgggacctgtctgcggtcctattgacgggccggcaaaattgggtgcccaaattgctggggggccggccgtttggcccttgaaaggccccagggggcgttgggggaccttagcaga

SEQ ID NO: 36341 - DNA, 1476 bp, Homo sapiens
  misc_feature (217)..(217): n is a, c, g, or t
  misc_feature (223)..(223): n is a, c, g, or t
  misc_feature (231)..(233): n is a, c, g, or t
  misc_feature (235)..(235): n is a, c, g, or t
  misc_feature (239)..(240): n is a, c, g, or t
  misc_feature (348)..(348): n is a, c, g, or t
  misc_feature (352)..(352): n is a, c, g, or t
tttgtgtttggtttatttgtttagctttacaaggtacacataagttaggttgaggggttgttaacccttccgtggtctgctttcattccgtgtgcttcctgtcacaggtaatggaaaacataagtagaataggtgacctcttagttttgaacttatttaagtgtggggatgaatttttcatcagaagtgcttacagggttactacctcagtttacantctacntggtcatnnntntatnncatccagtctaagaactgcctccactgttatatattcataattaaacacattgagaatgcacactataaaagctggtcaaatttttgcagagcccttatctgtgtgtntttngtttttttcttttttttttgagacagagtctcgttcggtcccccagcttggagtgcagtggcgcgatctcggctcactgcaacctccgcctcctgggttcacgcgattctcctgcctcagcctcccgagtagctgggattacaggcacacaccaccacgcccggctaattttttgtgtctttttagtagagacggggtttcgctatgttggccagactggtcttgaactgctgacctcgtgatccgcccgcctcggcctctcaaagtgctgggattctgtgtgttttgtgcacctccactttaggtaatcatagggagcacatttacaggatggtctaataacatgaaaacaggctagtttcaagcaacagcaatgtcggttggaaagcaggcgtcatttgccttgaaaaaagccttttgacaacatacaggcattcttttaaaaccaggctgaaacattttatttccgagacttaacgttgtgtttcctgtttcttaaacctagcacctctgtgtatttgaaaataatgagacatctttcattggattttggaaaattgttccccatgggattctaacctcactaccaaatgagtgaaagcttgattaagagttcttccatatactagcctccttggaagaagtgatcagaaggtgataagaaggacagaaaggactattttaaagttggactgaaggagaaaaaagcaaaattcttgtttcatcccaattctagttagaacaaagttaaacccccgtaatcttaaagagaaaatctttggaggttttaattaaacattttatacatttaaagtcttgttaatggtgctttaagtgtcaatgtagcatgtaaaaggctttgtacagacaggtaaaagttccatttctgagtgatgaaatgtaacacttcttcatctttaacttgaaatcaaaactatcagattttatttttgtataatttaaggaaggtaaagttaggggactagaagactctaaattggcttctacagatcaataatttaaatgtaactagttgggattttatagttaaaattatatttgtgtatataacataactaatctgtaaattgtaataaatatatttgcaattattgtcgacgcgg

SEQ ID NO: 36342 - DNA, 1012 bp, Homo sapiens
tgccatccctacaaagactgtatttccattgcaccctccttttattactcggctaattttttgtgtctttttagtagagacggggtttcgctatgttggccagactggtcttgaactgctgacctcgtgatccgcccgcctcggcctctcaaagtgctgggattctgtgtgttttgtgcacctccactttaggtaatcatagggagcacatttacaggatggtctaataacatgaaaacaggctagtttcaagcaacagcaatgtcggttggaaagcaggcgtcatttgccttgaaaaaagccttttgacaacatacaggcattcttttaaaaccaggctgaaacattttatttccgagacttaacgttgtgtttcctgtttcttaaacctagcacctctgtgtatttgaaaataatgagacatctttcattggattttggaaaattgttccccatgggattctaacctcactaccaaatgagtgaaagcttgattaagagttcttccatatactagcctccttggaagaagtgatcagaaggtgataagaaggacagaaaggactattttaaagttggactgaaggagaaaaaagcaaaattcttgtttcatcccaattctagttagaacaaagttaaacccccgtaatcttaaagagaaaatctttggaggttttaattaaacattttatacatttaaagtcttgttaatggtgctttaagtgtcaatgtagcatgtaaaaggctttgtacagacaggtaaaagttccatttctgagtgatgaaatgtaacacttcttcatctttaacttgaaatcaaaactatcagattttatttttgtataatttaaggaaggtaaagttaggggactagaagactctaaattggcttctacagatcaataatttaaatgtaactagttgggattttatagttaaaattatatttgtgtatataacataactaatctgtaaattgtaataaatatatttgcaattattgtcgacgcgg

SEQ ID NO: 36343 - DNA, 385 bp, Homo sapiens
gcacgtgacccagagtaggcgttcagtgaataaatgggcatagaactgttgtatttaagtttgcttctatcccatagactcctacagttggaccagatttggatagaatgcgagcaaattatgccagtgggttggagttcattttacttttcctttaatctacctttttctaaggttagactttatttggctatcatccctgcagcttttatttattcataagcttgaatagccagttataaatgtcatatgttttattatgcagcaatagtgttcgatttggtaccttgaactgttgtaacaatctgacatgaaatacaattaatgcactaacaggagttcatttaaggtatttattcttatgcgttatcttgtgaggaagtga

SEQ ID NO: 36344 - DNA, 355 bp, Homo sapiens
gcacgtgacccagagtaggcgttcagtgaataaatgggcatagaactgttgtatttaagtttgcttctatcccatagactcctacagttggaccagatttggatagaatgcgagcaaattatgccagtgggttggagttcattttacttttcctttaatctacctttttctaaggttagactttatttggctatcatccctgcagcttttatttattcataagcttgaatagccagttataaatgtcatatgttttattatgcagctcgcccctgagttagcagctcgcccctgagttagcagctcgccccttagttagcagctcgcccctgagatagcagctcgcccctgagtt

SEQ ID NO: 36345 - DNA, 405 bp, Homo sapiens
tgtagacggggtctgactctgttgcctaggctgaagtgcagtggcatgacctcggctcactgcagcctgcctctgctttctgggttcaagtgattctcatgcctcagccactacagtagctgggattatgggcatgtaccagctacttgggaggctgaggcagtagaattgcttgaacctaggaggcaaaggttgcagtgagccgagatcgtgccactgcgctccagcctaggcaaccaaatgagactgtcaaataaaaaaaaaaaaaaaaaagccatgtgatgctcatctcatctctgtgtgagtagttcctctccagtaaattacttgctgcagtaaaaagtgatctcttctgaggtcgggagttcaataacagcttgaccaacatggagaaaccctgtctct

SEQ ID NO: 36346 - DNA, 370 bp, Homo sapiens
ggtttacgaatcaccctactaatggtccttgtattttacagaaactctgttaatgcatcctgagtaaaattatcatgtattgtataacagaactgtacattttattatctcctgatttatctttatacaagattagatttggggatattattttttaagctaatattttggtggacaagttttagtcattcatgctcagcaaaacaacgttttaggatggtgagagaagacaaagtaattgatagaagaatgtggacactacttcaaaataactgggaaattatgaggctgggcacagtagctcaaacttgtaatcccagcactttgggaggcagaggtgggaggactgtttgaactcaggagttcggga

SEQ ID NO: 36347 - DNA, 495 bp, Homo sapiens
tctcttgaccttgtgatccacctgcctcggcctcccaaagtgctgggattacaggcataacccaccatgtccagcctctcctggtctttttaaagggaaatgtggacaggccattaacactaaatacatgagttcctactggtgaaatctttgctactctggtagactggtgggggcagtacaactgcaggtggaccaaatgccatgcgactggcaaggtgttctcactccgagcctcagtttcctcaaagtaaaacaatgggattacattagcttgatgatgttcaaagatcattagcattgggacccttttgcaaatgaaatcttatatggcaaaaagcagacgtgggatggatagacttctgagtttaacagctatgcaggatgtctgtgaagacatccaggagaacctcccctaggtgcctgcagagatagagaggtttactacaggcaaggacaggtttagggaccccaggaattcctgaggccttgatt

SEQ ID NO: 36348 - DNA, 346 bp, Homo sapiens
taggccaagaagtctcacagggaaagaaatatcagtttctttttttattaaaaaaatttttttttggctagatgtgtggctcacacctgtaatcccagcactttggaaggctaaggtgggcagattgcttgagctcaggagttcaagaccagcctgggcaacatggtaaaacctcgtctctacaaaaaaatagaaaaaattagccaggcatggtggcatgagcctataatcccagctattcaggtgactgaggtgggaagatgacttgagcccctgaagcagaagttgcagtgagccaagatcacgccactgtactccagcctgggtgagagagccagacgctgtc

SEQ ID NO: 36349 - DNA, 300 bp, Homo sapiens
cagccagtgccactgatgaccaggcctgaggttaaaagattaacccccgactctaaccgcatgtgctctcaatctatcacgaccctttcacatggaaccccttagagttgtaaggccttaaaactctggcttcctggagctcggttcttgagacgcgagtctgccaaaactccccgccgttgagacgcgagtctgccgaggctcacagcccaataaagccaaatccttcgtagccgggtgtctgaggggttttgtccgcggctgtcctgcttcatttcttggttccctgaccaggaagag

SEQ ID NO: 36350 - DNA, 980 bp, Homo sapiens
tgggttgtcctgatgttactgtgtctaggatgtcattgccactggtctcctcagatcaatcattctgcctaataaacagaaaaataacatgggcagcctcacatgcaagcctttacacacactgctaaagagacctcgcttcctctgagaagtgaggatgtgagaatgaaggattgattttacagaactggatgacaggttaaattgggcatctggaggtttatattcccatctccactcaccaagtttcatcctccatttatgaccaaggataggtataacatctgatcttgatggttactgtttcaaaaaacaatctgatcttttttataaagttaaacatttacttaatcatgcagcatactaattcccactcctgggtatttatccgagtgacataaaaacaagttcacacaaaacctgtaaacacatatatgtctttattcatataatagaaaaaacacaaaccctaaaatggaaaaaacataatgtccttcacctggtgatatggtttggttctgtgtccccacccaaatctcatctcaaattgtaatacccacgtgttgaaggaaggacctataaccttcacgtgtcaagggagggaagtgattggatgatgggggcggtttcccccatgctgttcttgtgatagtgcatgaattctcaccagagatgatggttttaaaagtgtttggcagttcttccttcattcacacacactcactgtctctcccctgtgccacataagatgagcttgcttcccttctaccataactgtaagtttctgaagtcctccccagccatgcagaactataagtaaattaaacctcttttctttataaattacctagtctcaggtatgtctttatagcagtgtgaaaataggctaatacatctggtgaatcaataattaaaatgtagcatagctataaatggaatactactcagtaataaaagaataactcgatacatacaaaaaa

SEQ ID NO: 36351 - DNA, 263 bp, Homo sapiens
tgtcagatggttttaatttttctttttcttttttttttctttctttctttttttttttttttttttgagacagaattacaggcgtgagctgctgtgcccggccttatccttctactcttgatggacatttgtcttgtaatttttggctactacaggcagtgtgactatgatcattttgtgcgcatattttggtacacatttgcttgcatttctttagaatatatacctagtgattaaattgctgatagtggctggatgcagtg

SEQ ID NO: 36352 - DNA, 582 bp, Homo sapiens
tgtgcctcagcctcccgagtagctgggattacaggcacccgccatcacgccttgctgatttttgtgtttttagtagagacggggtttcaccatgtaggccaggctggtctcaaacttctgacctcaagtgatccacctgccttggcctcccaaagtgctgggattacaggtgtgagccgctgcgtccagcctaattcagtagaagatttaaacaatttgtggagaattttgaagataatcggtgttgcatacataaaaaacaaaactgaaacaattagtcactcagggtgcagtttgggtggaaagatgagttgttcaagaaaaggaaaatatgcttttcagagtaggggattaaaagaaaaattaaaaaaggaaaatagtataccacatggctcagtggtaagcagcatttatatagtaatgatgtaaacactgaatatagaaccgtacaaaatgatggaacaactagcaggagggtaggaggtatggatgtggacgggggtgggggtagcttccatagtaaaaagtcaaaaaataatacatctttattactcaaaaatcgagagttgcaatacaacactg

SEQ ID NO: 36353 - DNA, 1793 bp, Homo sapiens
  misc_feature (857)..(858): n is a, c, g, or t
  misc_feature (876)..(876): n is a, c, g, or t
  misc_feature (1020)..(1020): n is a, c, g, or t
  misc_feature (1099)..(1099): n is a, c, g, or t
aaaggaatatggaaccagtatgaattaaaatttgtgttttcttcaacattccataacatcactaagaaataaaaaattataaaagctacatggttaaaaagtaccatgctggccaagcgtggtggctcatgactgtggtcccagcactttgggaggctgaggtgggaggaaggctggagcccgggagtttgaggttgcagtgagctgtgatcacaattgcactacagcctggacgacagagtgagaccctgtctcaacaaaaagtacaattgtttgaaagaatgtatacatgttttttactttttagtgaaatatattgtttttaaacattccttggtagagagaatttttttgttggataaaagggaggtatttttgttaaggatatctgggcaccctaaaaatttcatactttatgtccactcattaccgtatgggagaaaagttgctaccattaaagtatgtggtttgtaggagctcctaaaataaaactcttcagttttccaccctgaagtcagcttttggtcataccagattatgtacatatgtagtgggttcatgccatacttttagaaggccagcagagggagcactactcaatgtacagtgtttactgtactgctgagaagactagtattttctatggctcagtacaaaatgaaaacaaaattaaatttcacaactcctcaaaacaaaaccaaaacaaaatttttcattttattcgtgggttcaggtttcagacatgctatttattagtgactgagcagattattttatttctgtgtacttttttgcctatatatgaagactactcaattaccctattttagagggttggtttgtttgtttgttttgcnncagggtctcactttgtcntccaggctggagtgcagtggcatgattgcagcttgctgcagcctcaacgtcccgggttcgacggattctcccacctcagcctcccgagtagttcggactacaggtgtgcgccaccacacccagctaatttttgtatgttttgtngaaatgtggtttcactatgttgcccaggctggtcttgaacccctgggctcaagtagtcctcctgctttgtcctcccaangggctggaattacagatgtgagccaccataccccgttagagttgtgtttttagatttttaagttattatggatacatcctagttgcacatatttttgaggtagatgtgatattttgatacaagcatataatatgtaatgatcaaatcagggtaattggagtatccattgcctaaagcatttatcatttctttgtgttgggaacattccaattccactgtcataattgttttgaaatatatagtaaatgattgttaactataattgccctatagagttacgttgtcagtctacttagtggcctagcaaagaggaagaaacatagtaatttacgcaaattccaggtggaaaatagagaaagtttagagaactaaattagtgtaaaacttaaaagtatttctgactataaattctaccattaaaaacaaaaaagcacccgtgaacccacaaggataaaataatgtgtttgtccctgcccttccttgcatatcctgggtgaggctggttgatggtacattgttgtagaataattgcggaattttatttacctggaagtttgctgagaaaacaatgtctgaggtggtgtaagtttttggaaagcaaacatttgacagagttctcataattgattttcattttccaccctttattctgttaaagttctgaaatattgcataaggccatctgaaaagaaaa

SEQ ID NO: 36354 - DNA, 422 bp, Homo sapiens
ggtcgacatctcattaccaagaactcaggtgtgatcctagggacccaccttgagtaacaaacacatttctttcacttggtaaattccaaggatgtataggatgtataggttacttcccaggaaccaggagcaaaggccagttaaattctttattatacagaagcaattttaaaatgttactgaaaaaccaatcatctactggtaagcagggaattccagacaaaagccctcgacatacccctatgaatcagtaacctggctgtgaaatctgatgatgagaaggaagacatacaggaaatgacagcttgccttgaggtgaggagctgggggatcaccaacaatgctgcccttgttggcatgtaaggatttggaaattggacttttttctatggtttttcagtaacattttaaaattgcttctg

SEQ ID NO: 36355 - DNA, 373 bp, Homo sapiens
aaaatggaatcttctaaatcaaggattggaaaactttttcaataaagggccagagagtgaatatcttagactctgagggccattatagactctgttgcaactactccactctgcgctagtatttaatgatacaaaagcagtcatagggaattaataaactaataaggatggctgtattccaataaaactttatttatggacattgacatttgcatttcttataattttcatgtgtcacaaaatattttcccaaccatttaaaaatgtaaaacctgttctcagctcataggtcatacaaaaataagtggattcgactgatgtgccttagtttgcaaattcagcatattttcaaatggtcattacatgtcacatc

SEQ ID NO: 36356 - DNA, 900 bp, Homo sapiens
ctggagagatacttgagaattttggacactgtaatattgaatttggttctaattgtgatctagagaccctcagactctttcaggtgatgcacgaagtcaaaattctgttcatagtaacgttaacacagtgttgctttttcactctcattccctcaccagtatacagtggcattttccagaggctaaatgatgtgtggtaacatcacattcttctggctaatgaaatgtgtaattctgtattcttgtgttttctataatttttaaggtagtactttaaggtaaaaatatggaagttttcattgatggactcagtttgttcttagtacttctgtgctcttactaggtttcttcagttataactgctatcatctttttgtacacttcattactgtctaataaatccttattttgaaatcccagcattttcctggaacctttgagaaaatataagaagtaagtactacttgtaaaacttgcttgtaaaaacttttgggaaaactcctaattttaaaaattttattgacaacttattttagcactttattctaaaatagaaaaaaatttatattatttctcttatatgtaagggtggattgttggcttaaaaaagggagattagaagacttgctttttcaacccatagctgcaacttgtatgttaaaaatactgaagtggacataccaacaagtataaaggaggactttaaagaatctgggcagaactgtaaataagaactaaaaaaaaaaaaaaagaaaagaaatgaaagtgtaatgaaagctaccttctcagtttcataaatgttcataatgtaccttactgcgtcttatgcgacagaacattttcgtgtagtattatggtaccagttaagttgtggcattctttcaagatcatttagagttt

SEQ ID NO: 36357 - DNA, 931 bp, Homo sapiens
aggagatctgtggctttcttttgttgtgggaatctggcttatggatgaatctacgacacaggattgtgaaattacagctctttgggaacaaaaggaaggcagtattgcatgacttagtttcccagcttcactttccctttggcatggtgagtttggggtcttgagagtctattttctttcacacccatcagcactgttaagtaagcaggaagacaacctgaggttgtctctttactttgagttcctacataataaattgcagcctaatttagtacataaacccaaacctaatttaggagtaaattttttgtagcagatagccagatttcagccaatcacaggcttccagctaacaagactatgcccaaataaggcaaatgcctcatcacatgatgctcaaataaggcagccacctaggcgaggccaatcaggtaacttttctactttgcttaattgttcagcctgtacaaatttgctgcttatgactgctgagcagagctgtctaaacctcttctggtttggagtgctgccttatatatgaattgttctttggtcacataaaattggttaaatttaacttctctaaagttttgtattaaattgtatgtaaaacattggtagcacaatttggattcagatacccaaatattgactatgataatgtaaataatccttaagcagactgatttacaaaggcctgaacaagtttgatattctgaatattcacttcttctgatgaaaaaattgccaagaccttacaattggcaggaaaaaaaatgtgtgttggttaaataagttatgttaacaacaagaacattaccacaattagaaaactcttactatgccaggcactattataaacacacctttgtaccttttttaatcctgaaaaatttctaataaatatgcatttaatattatttgtatttaa

SEQ ID NO: 36358 - DNA, 328 bp, Homo sapiens
tattttttttttcaattcagcatatgaaggatgatgagttttctaacaccaaattttaggattaaaacaacagagtcattatattttcctcaaatattttcacagagatataactttaaatatacttacatttagctacacagaaaccccttttctacacacataggcttagttggattctggaacttcaaaagtacactttgctgtaatcaccattgccttctattggtggctgttatttgtgtcagggttacctgaggctacagctttactggtattcaccaaaagtttaatagttgaaaatctgtagaggattactatgtatacc

SEQ ID NO: 36359 - DNA, 418 bp, Homo sapiens
ggctttgccacatcagctgcttccttactgggccaactttcccactgtccctgctgctctcagtttttctctcctcctgagctgggcttcaagggctgtagccctgggtctcctgtccagtttctgccctactccaccatctggtctgggctttctgagttttatcatgagcacccttctccactcagcagttttcaacctctggtctctgaccccagttctcagactgggaacttccatattgaaaacttgacaaaatgcctgctaacagcttgttacagcaggttttgagttatccgggggagctgtcaggaagccaggttaggatgaagcaagacaagaaacgacattatttctagggctggggaagccccagtcaagacagtcagccacagcctgataactctccctgcatgcg

SEQ ID NO: 36360 - DNA, 383 bp, Homo sapiens
aaaaacaaacagttgaaaaactaccccacttaattaaaacaaaacaaaacgaaacaagaaaacttctcatgccagctgatcccccattgtccacggctaagatggcagcagaatgctgtcattatatacagaaacaagacaacctgaagctaaatggatgccactgcagagtcaacaggcccagcctcacagtgcaggttctgagctatcgcccctccaaaaggcatcttctccacagcctcgatgccaagcaaggagcatccgagttcgtctcgtttgttttgttctttttacaaatatatatatatatatacacacacacacacacacaattgataacttagaatttctagccaataaccatatagttaataccaccttac

SEQ ID NO: 36361 - DNA, 413 bp, Homo sapiens
gctcagtacctcacctttagtattatgtttaatgtctaaaataacattctgtgtaagtcagatggttttattatcatcatttcacagaagagggttgatccatggagagattaagtaatttgcccaaggttgcatagataaaagtaataaagatggaacatagggtcaagattttaagtcaagcatcccaacttttatctgtttcactcactcttaacctcctcactcttgtatatgacatgattttaaaaaaaatatttatctcacatcgtccaggcaagtacgcccaatgacatggtgctttcttgactcaaattcaagaaaaatctatgttggaggccaagacaggaggattacttgagcccaggagtttaagaccagcctgggcaacatagcaagaccctgtctctacc

SEQ ID NO: 36362 - DNA, 349 bp, Homo sapiens
gagcttatgttcagtggaattttataggaattatttgaggtctggatagaagaatattccaccaaagagaatataattttaatccttctaagtgatttatctctgttgactaataaccgctttaaataattggcttgaggtttttttggatatcagaggaagtaagtctttttattctacctagcatctagtttttgatagacaagtttccttattatacccctcttctggttggtttggcttctcattgttgctattgttgttcacttttcactgaagatataaggctttctggtttatgtgtaggtctcctctcagcctctgcatgttgggcagtctcttttgtctc

SEQ ID NO: 36363 - DNA, 299 bp, Homo sapiens
tattttaaaaattgttccgatcaactgtattgaagtataattgacataaaataattttaagtttgtaattcaatgagttttagcaaatatttctttaaataccatcacaatcatgatgcagagtagttccatcatccccaaagtttgctcctgctcctttctaatcagttcttgctcccacctccttgccacttctgatctgctttctatcactagttagcatttcatttaagtggaatcatacagcatgtacttcttgtaggcttcttttgtgaaacttgggcactgtttggactctg

SEQ ID NO: 36364 - DNA, 577 bp, Homo sapiens
gttgcatactggaaacttccaggatctattgaaggtgtcatcagaggcaaatttgtagccttaaattgatttatataaaaccaaaaaaattgaaaatacctgaattaagaactcaatgcaggtgacagcagaaagaatatagagaaagagaggaccttttctgtctagatcatggtgtttgaggagcactagggcagggaggagagagcctggaaagttagcaggggccgaagtaatctggggcctccaaggctaggccctgaagcatgtcagcagtggacagtctcttctacagtacatgttggctttggcccacagcagagcccaggtgttctctgtgctgtcctctgagtgccctgggctgctaggcagaagaacaggagccttcgtggaaggtacctggagcaggggctgcgtggtcctcttggtaaacaggcactgttagggaggactgcagatccacacagcttatcactcgcttcatccctggaacttcctggggtttggtctcgtaaaggagcgctagcacttcttatctgcagggctcccagtgcctgcgctctggtcctgacccctg

SEQ ID NO: 36365 - DNA, 137 bp, Homo sapiens
tagaagtgacatgtaggggaattagaccagggagagatgttggcacagtatcctggaaagctattacaaataatccatgcatgaagtgacaagagctgtagggttatagactgaatgtgtaatctcttaggtttata

SEQ ID NO: 36366 - DNA, 445 bp, Homo sapiens
tgatttaaagtaatacacctaaaagttcttttgatttaaaagtttagcttgcctgatattaatttaaacacaaaagaatacaaactcaagaaattaaaatcctgaaaatagttgcagatactcaacaggggaaaatgatacatgtataatgtatatacagagtacacacattaatatataatacaaattatggtagaaagtaattttctatttagcaatattgaaaaaagctaatactaactgctgaagaaataacacagttcagggaaacaaaacataaaaaacaaaagtatgaaagatacagctacgtggtattttatactctttaatattttattttcatgagctctgaaatcatgtattaaaaatacacaaaatgcgatgacaattcctcaataccattcatttggtggatgtttttactacatttaagaaaaaaaaaaaa

SEQ ID NO: 36367 - DNA, 535 bp, Homo sapiens
attaaaattcaatgggaaagttaggaattaaagttgacacactcaaagaaagtggaggcaacaaagacaaacatggaaaacagagaagagaaaataggaggactggtctggaaagtcagtagccgaataacctgagaaaacaggagggaagaagtcatcaaaataattcagaattttccagaactgattgattgatagaatttccagagtcaaaaggtcactgcacaatggatgaaaatagaccaactccggagcatgttacttgtgagatatgagaacacccaagcacacgaagattctgcaggcgtgtaggggggacggaggggcggattgttacatataaaggatcaagaatcaaaatgtcttcacgcttctcaacaacatctttggaagctagaaagaagataatgtagaagtgcctttggaattcttacaaaaaattatttccaacctagaactctttacatagccaaattataagccaagggttatggtagaataaagacacttggagatatatgagatctcaaaagca

SEQ ID NO: 36368 - DNA, 320 bp, Homo sapiens
aatgaggaaggagcccttaatagtttagtgatgttagaagtgtgtagtttataataatagtttattaaaataatttatggaaaattattgtggaagcaaaattttctgtaaatactgacagaccttggaataggtcagcaaactcttagaggctaatggagttatgacatttatataactacttaggatttggcttattgcgatgattgaataaagcataaagcaaatagataagaaccaagaaccttctaggaggaaaataagaattgttcttccgaatttgaatagaaacacttctctttgttttgagacagagattg

SEQ ID NO: 36369 - DNA, 390 bp, Homo sapiens
taacacaacaagagtatgtataaatatataattaaacataatctttaacatagctgtcacagttacttcataatttaagcaatgctaaatatgtgcccctcctatgacatgacacacaaatattcttccacgatcttggtaacatagcactgttggagttaaatagcagccatgatctgttacctcatctcaaagcctcaaggtaggaaccacgttgtgtggcatctgaccatatgactaatccatttttaaaagcgttcgctttattttgaatcaacagaaaaatcaagaacaaggccagaaattcaatagacagatgggctaaagatatgaaccgttcacagaaagataagcattgaaatatgaaaggatactcaacctcacaaaaaa

SEQ ID NO: 36370 - DNA, 389 bp, Homo sapiens
gccaagcatatggcttacaaaaaatgaagatgtggcttcttctcttcccccatccccagggggagggagctctcttcctacctggtggacagacatggcaccagatgagtcactatgcaggatgcaatagttgctgtgctaagagacattatgggagaataaaggtcctgcctgcatgctgaaatgttcatcaccattttcaaattttaaatgcatagcagttctaaaactgttgcttttaaggaattgggtacttgtaaaggaaacagcgggtcatcctagaaagaaacagatgattactaggggaggtctcaaggccaatgtagggattatactcacagatcagaaacacagtaattgaaaaactagaggacctacaactcagaaat

SEQ ID NO: 36371 - DNA, 402 bp, Homo sapiens
  misc_feature (345)..(345): n is a, c, g, or t
  misc_feature (385)..(385): n is a, c, g, or t
  misc_feature (394)..(394): n is a, c, g, or t
gctgctgggccctcttcctccaggaagccctcacaggctgctgggccctcttcctccaggaggccctcacacactgttgggccctcttcttccaggaagccctcacacgctactgggccctcttcctccaagaagccctcatatgctgctgggccctcttcctccaggaagccctcatatgctgctgggccctcttcctccaggaagccctcacgctgctgggccttctctccggccacctcatggcagctgggtccttggcccatctggtccctccggaaggaaggggtgttctgggagattgggggtgcacaggggtgtaacaaggccagctttccccacatntgggcgtggctgatgagagcaattttgctgctgctttttnggggcagantccatcct

SEQ ID NO: 36372 - DNA, 388 bp, Homo sapiens
tcctagagctctatgttttcacatatgtaatgagtactcactacatataaggctctgagttaggcaatgagcaccgatttgggggaaaatatcaggaaatgatgctgtttgtagtatcagaagagatgattatgtgattgagacctacataacaataatgtggttagtgctgcaaaaacatcagtcttttgcagattgatttatgggcttaacacatttatgtcaaaattctagagttgttaaaagacaaaatgtttttaaatttaatcgtgagtagtaaacaaataggagtagaggagcaaaagcaagatatttaaattgatttatcttatgcaataatgtactatatagctaagaaattaagagtatggaatctacaccaaactgg

SEQ ID NO: 36373 - DNA, 342 bp, Homo sapiens
gactttgggcaagtcactcaagcaccttcagtgctttcggttataaagtgtaggagtcaggctgtatcctctactaggccacagctctgtcaaggtaggtctatatcttattaatatttgaggtttcagtcataagcacacaataatatttttggtgaattgaacatatgtagtggatggatgactgtatttatagttgaacaggagactgactcatttttctcaatggaagcactatttgcattttaggtaggatagttctttttggttctgtagcgtgtgtcacttttggggcccctaggcactaaaggccagcagtaatcccatgtggtttctacaaaa

SEQ ID NO: 36374 - DNA, 461 bp, Homo sapiens
cttggaaatgtctggagaagttttccagtgcggtagcaagcagccttccactgtgctgagacactgatggagggcaggtggaaacagagaggaagagaaagagagacgactgcttaaaggaaaagagttcccatgattgggactgacctgccaaccggtcaggagacctagagagacaggaaagggaagggtggtgcagatacaaggaaatgcaaaccaaaggaatattcttaaaagttgcatgactctggccatgtgaatgaatctttctgtgctggagttttctcatctgtaaaatgggttcattgcaacaccgacctcacagggttgttgggaggagtaaatgcttcggacagtgcatgacaattagtaagctctttctattgttattattcgtatgatttaggatggaaggttgaggaaaaataataaaataattgtcttagtgtttagaattaatt

SEQ ID NO: 36375 - DNA, 1826 bp, Homo sapiens
  misc_feature (1071)..(1071): n is a, c, g, or t
  misc_feature (1131)..(1131): n is a, c, g, or t
  misc_feature (1139)..(1139): n is a, c, g, or t
  misc_feature (1190)..(1190): n is a, c, g, or t
ctgttgttctttttccaaatatcctagagtactttgatatagttgagtatattcatctatgcaatgtccttgtgatgttggtagggagaacttctaaccttttgtgcaatgacgagaaggttatataatggcccagccaggtttcatccttgatatcctggcaactgtagtttatattaatgacatctccattgataaagggtctctgaggtttccagaagaaagttttttagatattcatgagtgtactaatatcatcaatttacctgtaactttgattaagcaaagaaagcaaacccatacacacacacaaacaaacaaaaaaaaccacttttctcaggactttccatttgttcccagcttagtttgaggtcctgcttcattggcttagatctggccaggtctgtttgtcatctggcatctgtctcttctttctcatgctccagatccagagccagagagcagccactgctttgctctgaggttggctctattttctccctttggcatatgggatggcagtagccctgtgcccttttggtactgcagaagagatggattccacttggcccatcccacccccatctctggttcacctgggcatgaaggtttccttggcttctgcctgcagccatatttgggctgcttccaggagaagagaagaatgtagtgacactgcagcagaggcagcttagccgacaaacccccaaccccaacaccagaagagcagggagtgctgctgctgattagtgagggagcagcagaaatgcctaggatgggaatgttctgtccaactactatgaggcttccattaagagctctgtctaaactgctcacagcggcactccccagcctcctcccaatagttccaatgaaaacgagttggtgaaatctctttagaggtttttgacaagtgcctctgccaaagaataaaaatgatacccttcaggaaatatattttagagtccaagatgtatattgttttaatattaagtacaatagcaactaattaaaagattttttcaagaggcactgtctctgtcacccaggctggagttcagtggcatgatnatagctcactgtaacctcaagctccctagctcaaaggatcctgccacctcagcttcccangtagcttngactacaggcacacaccaccattcccagctaatgttgttttttatttttcntttttgtagaaatgggatcttactatgttgcccaggctgatcttgaattcatgacctcagtgacgctctggccttggcctctcaaagcactgttattacaggtgtaagccaccgtgcctgacctatttctaatttgacttacccaagtaattttaaaagatttaaagcaccatccataaggtatagttttctgctaggtaggatttttgatgttatctcctttgtttccagcaacattggtaacctagaactgagtcaatgatgagcattgactacactatgaagcctctctgtttaagatacaggagaaacttagctcctttaaaaaaaaaaaaaaaaaaaaagggtgtggtggctcatgcctgtaatcccagcactttgggagggaggctgagactggcagatcacgaggtccggagttcaagaccagcctggtcaatatggtgaaactccatctctactaaaaacacataaattagctgggtgtggtggcaggcacctgtaatcccagttactcaggaagctcaggcaggagaaccgcttgaaaccagaaggtggagcttgcagtaagctgagatcatgccactacactccagcctgggcaacaagagtgaaactccatctcaaaaaaaaaaa

SEQ ID NO: 36376 - DNA, 1364 bp, Homo sapiens
taaaagaaaaaaaaagataagttccgtaagacaagagatactctcagaaaaaagtcattggctttagaaactgtacaaaacgacctaagccaaacacagcagcaaataaaggaaatgaaagagatgtatcaaagtgcagaagctaaagtcagtaaatccactggaaagtggaactgtgtggaagagaggatatgtcaactccaacgtgaaaatccgtggcttgaacagcaactagttgatgttcatcagaaagaggatcataaagagatagtaattaatatccaaagaggctttattgagagtagaaagaaagacctcatgctagaagagaaaaataagaagctaatgaatgaatatgatcatttaaaagaaagtctctttcaatatgagagacagaaagcagaaacagtagtaagtatcaaggaagataaatattttcaaacttctagaaagaaagtttaaacatttggttctggatacatgttgaacctagttgaatataaaaatcagtagataaaaagtgtgtttactatactgtataattccatttacatgaagcatccagaaaagagaaaggtataggtacaaaaagtagaataatgtttgtgaagggctggggctggaagctggtagtgactgctaatgggcgtgagggatcttgcagtgatggaaatgctctaaagttggattgtagagatggctgcacagctcagaaaatgtactaaaaatcttttaactttatgttaaaacagatacattctatagtatgtaaattatatttcaacaaagctttttggtttaaaaaaaaaggaaaaatgtgttcactacatcagcttagaaacataacttgtttccatagaggtgagagatgatttactttgagagaagacattgtgtcacctatgacattttattaggcacagagtcatattttaaggtagatagtcctgtagtgctgaaataataattttaatgtctttatattgccacatgttaagaccatggtgaaggtataaatggaaatgtttacacctgaaatgagtattttcaaattaaaatttaattaagtgatttgcttcaacacttaattctagatttcccagatgaactgaagtgtattgctgtatcttgtaatatcttgctttaagtagttttttatatattttagttggtatagctttattattattcatattaatttaacttaaatctgaaaatgtcagtctcaaattacatattttaatgaccacgtaatgttttaaaggcacctacttgttataaaattataatttagggtaaatgtggtaaattttagcaaaactatatttgatttagtcttcccactcggtattcataatttactt

SEQ ID NO: 36377 - DNA, 713 bp, Homo sapiens
aaatgtcatttggagcatggcaaccagaaaaaatagattattcttgatatttgtgattcttatagaatatgaatacaaatacttagaaatatttgatgaaccctggagggtaaagtcttttgtttcaccttggtcaaaagtgaattggaaagtttagctcagtctttgtattacaattcaaggttatatgcttgcaacatgaaagtcaaaaggccgctgtcgttacaacccttggaagtccagccagaaatgtccttgttgcctaaaattaaataagcttgtgccatagaatgaaaaattgcttacattagtcaagggaatgaccctgtttcaaaaaaaatttcaagtttgggtgtgtaactgtaaagggaaacgtgaaatatttgggaaaatgtagggatttattggggaattattgtaattgcccttaacctaatcctagacctaaattaacccagagagtaagtcccagttagtgagagaataatgaatatgtgattacttttaaagtaaatatgttaaatcgattgcctctgttctttttcctctctgttgttcccctttttattttatcttttgtgtttgtagtttgagataggcagtgtctttgtttttctctggacaattttaattgaaataattcagacttagataccattcagaaaagatatatattaaaatatctttattagcatcaaacaaagcagtagtga

SEQ ID NO: 36378 - DNA, 742 bp, Homo sapiens
aaacttcagttgtacacagatgatgatgtcatggtatcgagtattctttatattcagttcctatttaagtcatttttgtcatgtccgcctaattgatgtagtatgaaaccctgcatctttaaggaaaagattaaaatagtaaaataaaagtatttaaactttcctgatatttatgtacatattaagataaatgtcatgtgtaagataactgataaatattggaactttgctagaacaagaccctgtagtaatagtaataatagttgaagtttggccaactcttaataaagttattttggtaactaatgttttatggcacttaagaataattagcagcgttaaattttgtttgtattaagcacttttaattttatccttcctaaaaatagtttattgtatctgacaagaaacttacttaaccattgtgtccttcccatcttttttgtcatctttgttttcttcaaatgccctcctcccatctgccttgagattcccttgtcttcacttaaaagccagagtgcaagtcatgatttgcgggagggctcttgaaccacttctggctgcaccacaattctgtacttgagtatcacagtcatttgttttgagacaaacatttttataattctaatttgggttaataaagattttaaaatatttcttggttaacttttgtaattatatacacaacaaatgtgtaaataactaccttgttaaacaccttttaatagcacaaggtttttat

SEQ ID NO: 36379 - DNA, 806 bp, Homo sapiens
  misc_feature (171)..(171): n is a, c, g, or t
aaacttcagttgtacacagatgatgatgtcatggtatcgagtattctttatattcagttcctatttaagtcatttttgtcatgtccgcctaattgatgtagtatgaaaccctgcatctttaaggaaaagattaaaatagtaaaataaaagtatttaaacactttccttgantaatttaatggtagcattatttaaggattaaaattgtccattggtgcttaaagaataaagcttgacttaaaagtaagtttggcggaaaacctttttggggccttaaggaaaaaaccaaaaaggaaaacccccttgggtaagtaatagtaataatagttgaagtttggccaactcttaataaagttattttggtaactaatgttttatggcacttaagaataattagcagcgttaaattttgtttgtattaagcacttttaattttatccttcctaaaaatagtttattgtatctgacaagaaacttacttaaccattgtgtccttcccatcttttttgtcatctttgttttcttcaaatgccctcctcccatctgccttgagattcccttgtcttcacttaaaagccagagtgcaagtcatgatttgcgggagggctcttgaaccacttctggctgcaccacaattctgtacttgagtatcacagtcatttgttttgagacaaacatttttataattctaatttgggttaataaagattttaaaatatttcttggttaacttttgtaattatatacacaacaaatgtgtaaataactaccttgttaaacaccttttaatagcacaaggtttttat

SEQ ID NO: 36380 - DNA, 1042 bp, Homo sapiens
ctagtttttagtttttttcccctagtttttatatagtatgtaattatctttgatttctttcctttcctgtttcttctgtctgctccaattaattcagagtagattgatccttttaagatcaagggcatatctaaattggttctttgaagatgtttctctgttaccttcagtatggtttaatgaagaaagaacttaaagagctggactggatattaacctgttctctgaactttattttccaatatgtagtgctttattttaattatatatatatatatttcttcaaattatgagaataattcttgctcaatacagaacagctgggcaataaaaataaaggaaaattgtatataattaatacttagaagtgaccactgatatagtttcagtgtgtgtttttgtgattctttatgtgattagcttttaaagtcaagtagtatattgtgaacattaaaaaaagtaaatgcatttcagacataataatagctaatatgtatcgagtgctttatttttctcttatgtgaatttcttatggtagattctctaagtctagtgtaatgactattccacaaaatcatcagagaccccaactttttctttttgtcagtactacctccagttccaagacggctatttgagtttcagttgtcctacccatattccagccaggagaattgctcaaaagctccacaaaaaaaaaaaaaaaaaaaaaaaaaaagaaaaggaaagaggaaagacctaatattaaatgacaagccaggtgtggtggctcatgcctataatcccagcactttgggagaccgaggcagacggatcacctgaggtcaggagttggagaccagcctggccaatatggtgaaacctcatctctacttaaaaaaaacaaaaatattagctgggtgtgtggtggtgcatacctgtaatcccggctattagggagcctgaggcaagagaattgcttgaacctgagaggcagaggttgcagtgagccaaggtagcgccactgcagtccagcctggccaacagagcgagactccatctc

SEQ ID NO: 36381 - DNA, 270 bp, Homo sapiens
tgagatggagtctcactctgtcacccaggctagagtgcagtggtgcagtctcagctcactgcaacctccacctctggagctcaagcagtcctccctcctcagcctcctgagtagttgtgatacctttttttaaaggctataactttgaaacaattcatgagctttagtgtaacatataaactattatttccagtatcactgtagtgctccctaccattttaatacctcagtcctctcaaggccatcaaccgtggttgatagggcctagtt

SEQ ID NO: 36382 - DNA, 925 bp, Homo sapiens
gttaaccaagcttttaccgcggggaatggaaatattataagccacttatatatcataaccacaataggcacctcatacaaggtcttcaagctggtacaagtgcttactggataaggagtattctttgtaagttcctttttatgtttgatctcctgatgatacattctacagtatctaatattcactttgaccagagcacagttactgtggaagtcatggtttatgtgctcattgacagcacatagctttccagacaagaaatcacacaggtttccctgttattaacaatctaacctccctgggagaatgacagagtaagtgactggtgtgaataacagaattttttaaagttcttttctaaggtatgacaactaatcaagttagattttgatgccagatgtaaggttgtttactttactggaccttggatattgagaaatggataaagctggataagtttacatctaggtagcttctgagcggtaaaaattagcttagttccttggggaatataaggaaagtcttcccagataagaaagttggcctgctgtcttttgttttgtttggagatggggtcttgctctgtcacccaggctggagtgcagtggcgcgatcttggctcactgcaacctccacctccgggattcaagcgattgtcctgcctcagcctcctgagtagctgggatttaggcgcccaccaccacgcctggctgattgttttgtatttttagtagagacagggtttcaccatgttgtccaggctggtcctgaactcctggcctcaggtgatccccccggcccccctgccgcctcggcctcccaaagtgctgagattacaggcgtgaaccactgcgcccagccagcctgccgtattttgaaagttgaccagggacttgccaagaagataaatacaggataagatact

SEQ ID NO: 36383 - DNA, 399 bp, Homo sapiens
ttaatggatatttaaatgtttacaattttgtttttttttttctatctcaaataaagcttgcgctcatatgtctaagcatgtgtgtggattaaagataaaccactaggtcaggcatggtggctcaaacctgtaatcccagtactttgagaggctgaggtgggcggatcatgaggtcaggagatcgagaccatcctggccaacatggtgaaaccccatctctactaaaaaaaaaaaaattagctgggtgcggtgacacgtgcctgtaatcccactgtaatcccagctactcgggaggctcaagcctgagaatctcttgaacccaggagacagaggttgcagtgagctgagaaggtgccactgcactccagcctggtgacacagcgagactccatctcaaaa

SEQ ID NO: 36384 - DNA, 372 bp, Homo sapiens
gtctgtctcttctgccctgaaattagctctgctagggtagaaactatattgttaacgcctcattcccagtttttggtacataatagctgcccagtaagttattgaatgaatgaactccagggggtaagcatgatatccatttcacagactaaaaaactgaggctcagcagttaactaacctgcccaagtgcacatttactccctagtcatggccgggtttgagacaagggaccatgtttgcctattactggccacacaggaactcaattgaggagcatggcctccaggcccagctgatggtctttaagctcaatgagaaggagcagctggaggtgaaagagaaatgccccagctgggtctcatatagtgggg

SEQ ID NO: 36385 - DNA, 399 bp, Homo sapiens
gacagaagctccacaattgcactgttaaatagatactgaaatatagatatttccttgtgcattaaggtcctaaaaattattctggaaatgtagtgtgagctaagaaactatatccactgcaaatttgtttgggaatggagatctcacttcttgttttaacttttgatagcatgtaaagtgtataaagcagctcaacgttgcttatgattcaaaagttagttgtctaaataacaacagtttaagtttcatatataagtgttgttctgtcctgtaattttaagttgaatttactattataaaattagcaaaagctaattctcaaagccatttattgtttgatcatagtgtctgaaagcagtcttattgttgtgaaaaatttcaatctcagttccaagctga

SEQ ID NO: 36386 - DNA, 386 bp, Homo sapiens
gtaaaatttcaatctaagtaaaacaaaacacatggaatctattctgttagtatggcaaaaaggcaagatttttttctttatcctgttaagtccttttcttaaatgacttaatggactgaatagtgagcactctgccatgtaatttagtagtaaagtgaactgcccttttcttctttccctaaaaatttgcttgtatattataaagcaaaacacctttgaggcgagattcttgccagaccttaaaaataaaaagaataaacaaaacccattttgatctttctctgtacatcctgtcttatggaaagggcatcaggtgcttctatagaacttaccaacagagctccctctgaggggttttctgtctgaggatcaccagaaaagctatg

SEQ ID NO: 36387 - DNA, 505 bp, Homo sapiens
attttctttatgtgtcgacgctgcagctgctgtggggggcagggtatggttcttaggcttgctaacggagttatgttcccagggggattatggctgcctctgctgcatcatacaggttaccacagaagtggggaaaagccagtagtgacaggcctcaccgcagagcctgaagggccagtcttactcccaccgtgccccaccaacagcactgagtttatttacaggcagctggtgagcagggctgagaacttgccccaggctacaagcctccctgctgagaaagcaagcagggctttcaggtttcctgcctccccacatgccacagtttctgtgcttgtatctgtactcctaggttgccccctcccttggattcggtccaggaaacttcgccttcagtcaaaagtgttacaaagtttgtctggaaatttccttctccctttggtctttctgtaattccactggcagccctcctcaaggactcctgcgagagaaagtcaggaatggc

SEQ ID NO: 36388 - DNA, 798 bp, Homo sapiens
aagagacaattgtgctgtcaggctacagcttggtttcatgcatttttacattttaggggaatgtaagacatcaatacatgtaagatttacattggttcgatggagaaaggcaggacaacttgaagctggtggggaagggacagggacagagggagggccttctgggttataggtggattcaaagattttctgattggcagtgggtttatccaaagacctggaatcaatagaagggaatgtctgggttaagataaggtgttgtggagaccaaggttcttactgtgagatgaagccagaaggtagcaggcttcagagagaatagattgtaaatgtttcttatcagacttaagagaaatttattttggggtaaaatacttagatttctctcagggcctgttatctgtcatgttatcttgttgctacaaagagcctgtttttgtcggtcttaaggtctctgttttaatgttaatgctggtccactgtgcctgaattccaaagagaggaaggtataatgaggtatgtctgaccacccattcccatcatggcctgagctagtgtttcaggtttactttagaatgctcttggccaagtggaagggtcgattcagttggttgtgtgcttagaattttatttttgacttacatagactatcagctgcttcatgtcacatctcatgcttctcttatgttgcccagttttctcagtgcttccgactgcatgtttttgtactatatgaaaagccttctttctagaagactaccaattaaatatttctttagaaaaatgtaaaattgctta

SEQ ID NO: 36389 - DNA, 361 bp, Homo sapiens
gagacgggggtcactcggttgtccagcctgggtgacaggaaaaaaaaatcattagaaattaactattcacctgtttaatagtttctccaattaagagtacaagttgctgaagagaatagattgatcaaaataacttatttattgctaagaccaaacttgtctgaggtttgaaggaattttgttattcaataaattcctctgccaagattttaaaactagataattcaagttattaagttaaaggatctttaaacagggaagctcaaaaagactaaactgaaataggagatagagatgatggtcagaagccataatcagatatactattgtcagaagaaaaatagatgctctataagctgta

SEQ ID NO: 36390 - DNA, 468 bp, Homo sapiens
gcaagcgtgctttctccttcactaacccatcccgccatctgtttcttataagccacagatgtgccctctgaccatccaattaaggcctgtggagtgaaaatgggcctgtcacattcttctctgacagccaggctgaaagcccccttcccgtgatcctcctggaacccagggtgggggcttcatggcctcgtctgtaaatgagtccagtgcttggtgctggccgagaagggtggcacagaggtgcctttcaacccttcagacaacgacaggctcctggggaagaggggcttctggtgctggctcccttcccccaggcctgacaaaactccgactctctctctgcaaaagggctgctgatttatatccagggccaaggagaggcctccccaaactcagggccctcatgggccgtgagttattccagcctgcgtgcagccttctggccatgggccctttctgccttcagaa

SEQ ID NO: 36391 - DNA, 300 bp, Homo sapiens
caaatcagtaggggatttgtaaaatttctatacttaaaatgttgctagtcatatctcagaggctctccccaccttttcatcttccttcaccctgaattcactgatacaattatgtatgcacacaaattaagaggtggaaatattcagtaaagtcagtttaataagaaagtagaatttttaacactacagaacatgtctattatgtagataaagctaaacaggagagaaacaccgttacattaaatacaacgtaacgactctgttaaaaatatgattcctcctagattgattctaaaagct

SEQ ID NO: 36392 - DNA, 308 bp, Homo sapiens
aaacaaacccaagtatctagatagaagaatgcacggggctggagagcaaatgggacatattttcctcccccaacccccaacaagtctttataatgtgtcttgcattcatatctctcctgagctcagtggccaactcaaaatcacttctcatgttataagatttttaagttcttagggaaacacactgagttcagagtcaaaaagtatttaagcctccagaagtccccaacagctatctcattgtgtataaaagtgcatctgagctgggtgcagtggctcgcacctgtaatcccagtactttgagaggc

SEQ ID NO: 36393 - DNA, 1518 bp, Homo sapiens
cttttttcaccctgatttctaattattttattgaaacaactataaaatgtatggtttctccaggaagatatctgctttttaaaacaacaaacaagaacaacaacacaaaactggtaatgatttggagtaatcatgcgggcatattgagtctgggtagtgtttcgctggtggtagagtggttgagacttcctgggaggactttttccgccttcactcctacagatttaagattctttatttttaggccgggcatggtgactcacctgaggtgaggagttcgagactagcctggccaacatggcaaaaccctgtctctactaaaagtacaaaaattagccaggcgtggtggtgcatgcctataatcccagctactcgggaggctgaggcaggagaatcgcttgaacccaggaggcagaggttgcagtaagccaaggtcacaccactgcactccagcctaggtgacagggcgagactctgtctctcaaaaaaaaaaaaaaaaaaatttctttgagacagggtctctaatatgttgcccaagctgatctcaaactcgtggctcaactggattctcccgtttcaaccttgagtagctggggacgacagatacttgctactggcacccagctaggttaaggttctgtatactctgtctttctaaagcaattccctggaaattttctcaacattggttataactgaatgcttgggaagggaggggcagcccttcaacaggaaaaggggactgcccaaatcttaaatgcacagtcaagattctcttggagctagcaatggttctcaggttagtgagcatttagcttgcctgctgcagaatttgacccagatgggggtgttttttaggtctctcacaaatgagacaagcgaaacaattgtctccttttattctctttggtgcattggtgctggggaaacatgaactagcggcagtgtaactgcagaacatagacccagttctaccaggccaggccagcgttgggaaccaccagacagggctgctttgggctttgcttacagtatttccatgtgtagcctggcgtgtgagaaagtattaggtgaaatgccagtttcatggttcaggtgaaagtctgtgatcattcccctcgtggctcgtccttcacatcacttttgcccttcaaggagttgccgcgtccccgctcagtgccgcctgagccctcagagctcccctgtgcttttctggatggggactggcggggtcacctagcctcaccgtggagccaccgtgcaatgcccatctctgagaggcccacgcggtattcctcgtgccctgtgttagtgctttctgtataagggacagacagaactgggtttttttcctctgtctggttttagagtaaatgtaactaacttttattttccctttatgaaagatagaaattatttttatgtagtttccagactttatacaaaatttttgtaaaatgttctctggaaagttaactacaagaatgtaaatatgcttctaataaaataacaaggtta

SEQ ID NO: 36394 - DNA, 253 bp, Homo sapiens
ttacgaggaccccaccctcatgaccccactgaacctaattgccttccaaagacccttttccaaataacatccctttgggggttaggactctgacatatgaattttggggatgagggacacacttcagtccatagtaggcacatttactcttcaaagctctttactaacttaggctgtttgggatgttttagagaccccacccctgcattacaaattctaggtcatactttaattggtaaatgagtttttttcc

SEQ ID NO: 36395 - DNA, 1320 bp, Homo sapiens
attcaaaggcataagaattacaaattggactttggggacaccggagaaatgggggaagggtggttaaggataaaaaactacgtattgggcacaacgtacactgctcggatgatgtgtgcaccaaaatctcagatatcaccactaaagaacttatctatgtaacaaaaaccaccagttcccccaaaactactgaatttcttttttaaaaaaggtaattaagataccttgtagacaaggacctttgattacacactggtagaaatttcactttaccatttcagccaccatatgcctgctgtctgcccggggcttgggattcaaagacaaatgtttccagttcccttcctcccacaggtgcttgtggcctggtgggaagcaggcaacatgtgcacatagatcaaaggaagcaccaagtagctgttttcacgaagggtgtggtgagcacagaaaggaagccacctgttggcctggagaagttgaggaagggctctcaggggatgttagaactgagtggtaacagtcagaggagaggggtgaagtgccatgcctggcatgcctgccgagaaactgtggccacatgcagttctcattgcaggccagcctccagctaggacacaattctggtgttgcaatgcaggtcagtgtcctgtattagttttctatgctgcataacacattgccacatggattctctgctcggtgtctcacaaggtgggaataaaggtgtcagcaaattgtgttcctttctgcaaggccctggggaagaattcactttcgagctcattcaaattgtcagcagaactttagttccttgcagttcccttcatcctcgaggcaacagcgtcccatccaggcacactgagtctttcataagcttcaaatgtctcctctcccctgtcttgctctttagggtttaagggtgattccaccaggccaacccagataaatccaggataacctccctattttaaagtcaactgattagaaacctgtccacaaggctcttttgccttgtaaagtaacagattcatagtcccagaaattagggtttgaattctcttagaggactataatgctgcctgccagtctcccacctggaacttgccagaaatcagcacctagcactaagtctttatttaattttttatgtttagagagcagtattgctgttgcccaggctggattacagtggtgcaatcaccactcactgcagcctcaacctcctaagctcaagccatccttcatctctgcctagactagccaactataggtttgccaccatgcccagctctttttttttttaaagagatctggtctgga

SEQ ID NO: 36396 - DNA, 524 bp, Homo sapiens
ctactagtaatctttcttgtctgtgaccagtttatccttaacatgggagactttttctttggataccttcaatattttcagagtggtattttcagagtggtgcctttcacttagttaatatgcatttatgttccttctgtcatttaatggcttgattgctcatttcttttaagcactgaataatattctattgtctgaatgtactacagtttatctattcatttacctacccaccctgacactttgaatctaatcctgctcttccatgacactccctctttccccatagtgcttcctaggaacttgccacgatgtagtgcttacttagtactgcttttctaattacttaatttgtccctcatagtcaaccagcagttttgcctggttcataagagatggcctatttattgaaatgcctggatcagagaaataagatatgactagctggtgccaagaatggagcctggaagttgtctccatgctgtttaccataaagcactaactaaagtcactatttaaaaaaa

SEQ ID NO: 36397 - DNA, 411 bp, Homo sapiens
ctcattttcctcatctatgaaatgggaataaagatagtacctatctcagagggatgttttgagaattaaatgaattaacagtacctggcatacgctaagcattaatgtgtgttaaaaaaaaacacaacaaaaccaaaaggaaacaaacaaatacaagttttagaattcaatgagaacacgacagtttaaaaaaaatgaaatttgattagaaatataagctagagattgctctcaagccagtatagtaatagtacttttaaaaagttattaatgaaaaatatgaaagtaaagtctttaaatcttttagttaagtgtttcaaatttttaaaaacttgcagttctttaaatcttatgtcctcctttaattccatttgaaatttgaggtaaatagtccgacttggaaaaaaaagt

SEQ ID NO: 36398 - DNA, 210 bp, Homo sapiens
ccgcggatgaactaataaatgactgtcccataggacccaatatggcccccgctgtcacttcaaagctgtccttcaggactgtcacttttctggtgggtaagcttagcaaactgcccaccatccacacacacagcaactttgctgtctttgtttacgtttaacatacatggaatctctcagaaatagcactttagaaacatgtttcttggc

SEQ ID NO: 36399 - DNA, 583 bp, Homo sapiens
cccctaacctttagggatttcttgctcttccaaaccctagcaactcctagcgaagcctaatgtattattagttacctattgctgtgtaacagattactccacactgtaaaacaacaaatacatattatctcccatagtttccgagggtcaggaatctgggagtggcttagcaggtggctctggctcagagttgctcataaggttgtgttcaagctatcggccagagcccagcctttggaacacttgactgggctggagtatccacttccaagctcgcctgtgaggctcttggcaggagatctcacttcttcttcactttgtcctccccatagcgctactcaacatcatgtcagatggcttttctaaagtgagtgatgagagaaagacagacagacaaaagactaagattgaagctgcaatgccttttataacccaatcttgggatgtaaaaaccatcacgcttatttgttacactgactgctacctttggatacaaggtgagaggtgactacttaagggtgtgaattacccgaaggtgggggttgtttagggggccacctgggaggctggcttgttacacctg

SEQ ID NO: 36400 - DNA, 385 bp, Homo sapiens
ctggcgacagagcaagactgtctaaaaaaaaaaaaaaagaagtgtcaggagcacaggcttgaggtcagatccgagctgggttctggtcccagttccaccacctgttagccgtgtaacttcactaagtttccgtcttcccatctttaaaatgggaataagggttggttggggtttctatgaagtaatctgtgtaaggtgcatcacagaagtgtctggcatatggcaaactttccatcagtgttatacaccctttgcatatgcgaatgctcccaggcttggatgtttaggttaacattccaaattataaagagtttggaaaatttgagcatctcggatgttgtttggaccgagtcagggtttacgctttatcagtagtttcctattt

SEQ ID NO: 36401 - DNA, 1090 bp, Homo sapiens
  misc_feature (1087)..(1087): n is a, c, g, or t
  misc_feature (1089)..(1090): n is a, c, g, or t
aaatcatcggccattggttatcagctcaactctcaacccatttcctctccacttgatcttagccaaaaggccgagaagcgattcccatttcctctcatctttcctgggggaggtgggggaggtatgctgaaaatcccaaccctttaatcctgtggttgcttgctgtggtaaccagcaccccatcttgtggttatctaggggctttccacaaatcacctcattagcataaactccggtgttgtggaaggggcttgttaggaataacagaagtcacttctttcacctttattggcctggagctgctccagagctgtttcaggacaaaagaccaaatattttaacaaaagataagctatgagtgaggaattgtggaagaagaccaaaatatgtatttcttattatatcacaactatactttggtatttctgtgtttttcattttacttctttgagtttagtgagatgtcatgaatttttttttttcagtcaagtttcctgattatattggtcaggtttcttttgactgtaagtgacataatgcattctaaactagctgaagccagaagtggaatttgtggatcaccatattctggcttacataaccagaccaagggaaggacatgggtatgctggcctctggtacaaatgaaaccaggactttttttccatctttccctgtcattggtgccatctttgtttccttgggctactttttgctgttcaacaggaaacaatgtccatcagtagctcctggcctcacattttataacttcatcagtagagagcttcttcccttaattccaatttgaaaatcctggggaaaaaccaagatgggcctggcttggaaacacctgcccaccccagcagccagtggacgacctctgcgatgggcaacaactttcacagaacaggatagttgcaatgagggggagcgcccctcagaggaggtgagggtactgatcagaacaatagctgtccctgcactggggttcagccaaggccccaaaacgctttttcagcataagaattaatactacttttatatgtaatgatagtttttattcctaatcttaccctgaaacgcttgnann

SEQ ID NO: 36402 - DNA, 434 bp, Homo sapiens
ttgaaacagtgttcgtaagatgctggttcctgtctgatttattactgggtccctacacttttccacctagcactgagagacacgttgcaattttttccgtcagttggctactgtgctgatatgcctagattttcttaatgcttttttaatacttttattgtaaaacataaatatcaaaaagccacacaaaacaaatgtacacaacttagtgaattattacaaagcaaacacccatatatatcactagcatttaggtcaagaaatagaactttgccagagggaccaaaattttacatcccatcctgatcacatttccctctgttcctccaaaaataaatgccatcctgactttatagtaattacttccttgcatctctttatggttttattacccaaatgagcagcctgacccactgagttttagtcttacccat

SEQ ID NO: 36403 - DNA, 454 bp, Homo sapiens
aactaacctgcacattgtgcacatgtaccctaaaacttaaagtataataataataaaaaaaactaaaaaaaagagatataattgacaaaaattgtatatattatggtgcgcaatatgttttgatgtatgtatacattgtgaaatgcttgccacaatcaaactaattaacatgtctatcatctcacatagttttgtgtgtgtgtagtgaaaacatttaaaatctactcttagcaacgttcaagtatacagtactttatcattagctataatcaccatgctgtacaatagacttacagaatttattcatcctgtctaactgaaacttttatttttcataattttaaaatcttgttaaaataccgttcactttaaggtctacattgtattctactaatttcatagttttatgtttcacaattgggttttaatccatcaggagttcacctttgtaaaa

SEQ ID NO: 36404 - DNA, 911 bp, Homo sapiens
atacaaattactggtgatttaagatgattcttccaccagaatgccagtggaaatttgtacagtgtaaactgtgaaagtgctaagtagagtgaacttcagaaatattttgagtagccgccatcgaggatggaagggttgcagggcgtgattaaccagcagaaagttatgaggccccctgtgtggctgctgtggcatctccatcctgcctcatcactgggggtcttgcacgtggcagtcacatagtgtgtgttgttcatggggactctgcactgctttcgagagagatgaatgacatgattagctttatagccagtgtgattttgaggtggggtttcgggattgagcataaggtatacaaagtgaaagagagaaaaggggagataaaaaggagaacttgagctctacaatcagaattagcttttttcttcagctcagatgattctcacactggctttaaggttgtgattgttttttaatttcctggcgcttaattgttgcaacagtgtatgtgtcaattttaaaaaaacataggttttctttagttgaaaagttggactctctgctgccctatgtctctgtaatatgaataccacaaaattattgtaccaccatttaatgtagaattgatcaagaatgtgaccaaagtcagtgaatttgatgtctgttcatggataaaattattccctggtaacaagtttatctgcattcttagtaatttgataaagaccatttaaatcagcctgattcctatcgatataaaaatcacaaaaatgtttaagatgcctatttctcctgagaacaggaatgctagctgtcagttttctagttttgctttcataccatggaattccttagaaatctgttttgtgagttctaaatcatgcatattcctgtgttccaggatttctctc

SEQ ID NO: 36405 - DNA, 303 bp, Homo sapiens
gatgtaggtgagaaatttggacctaaataaagaaagactgtaagtgaagacataaagaaaaataaagtttttttccttatttttaattctacatggaaactgtttaaaattatacttttaacagtgtattcagtgccaaaacacatgagtaagtaaaatgaatggcagtaatatcataaggaataggagtgaggaatttggaatactcttataagttatctgtactacatgtgaaatgtcagattttaatttgaaggcaggtttagattagttaaaaatgtgtattacgccgggcgtgatggc

SEQ ID NO: 36406 - DNA, 597 bp, Homo sapiens
  misc_feature (594)..(597): n is a, c, g, or t
cagaaatgaaaagtctgccttatggaagacaaggcaccgacgctttccctgacagcatcatcatcacccaactagggcagctgacccgcgtcttcctcacgacgtggaatggtttgagtcaagggttttcatggccatgagccacgtggaggctgtgctttttgtttcctgtgagaaatcttcaaccagcgccactctcagcctcccctctgccagcgcttctgtggctgcacctgcattcgtgggctgtggctgcgaagcacaggaataattgatggctctggggcactttgctgggctgcttccagaaaagttgacccctccctgcaaaccagcactgcccagcattcttgtcccgccaagcctgactgtgagctgttgtgacgttgccactttgctcggaaaggaccccttaccttttatttcccttgcatttctttcaattctaccattgaccatttctcatacgtgtggtcatcattgtatttcgcccccattttgtgaggtttagtgtattcttaaagtttcctgggttttgatgagagcatattctgtcattatatttaacaggtgttttccccagcttgaaaaaannnn

SEQ ID NO: 36407 - DNA, 363 bp, Homo sapiens
atggtctccttagaaacattagcagactttaaaaaatgaaaatagcccatgttcattgtgaaaaagtgagccatggcctccggggcaccggagccacagagccaccacgctttgcttttgtttctcactcccctactctccccacataggcaccgacgctttccctgacagcatcatcatcacccaactagggcagctgacccgcgtcttcctcacgacgtggaatggtttgagtcaagggttttcatggccatgagccacgtggaggctgtgctttttgtttcctgtgagaaatcttcaaccagcgccactctcagcctcccctctgccagcgcttctgtggctgcacctgcattcgtgggc

SEQ ID NO: 36408 - DNA, 1507 bp, Homo sapiens
  misc_feature (1269)..(1269): n is a, c, g, or t
  misc_feature (1272)..(1273): n is a, c, g, or t
  misc_feature (1278)..(1278): n is a, c, g, or t
  misc_feature (1282)..(1282): n is a, c, g, or t
  misc_feature (1311)..(1311): n is a, c, g, or t
  misc_feature (1316)..(1316): n is a, c, g, or t
  misc_feature (1321)..(1321): n is a, c, g, or t
  misc_feature (1323)..(1323): n is a, c, g, or t
  misc_feature (1331)..(1331): n is a, c, g, or t
  misc_feature (1351)..(1351): n is a, c, g, or t
  misc_feature (1367)..(1367): n is a, c, g, or t
  misc_feature (1379)..(1379): n is a, c, g, or t
  misc_feature (1389)..(1390): n is a, c, g, or t
  misc_feature (1395)..(1395): n is a, c, g, or t
  misc_feature (1416)..(1416): n is a, c, g, or t
  misc_feature (1422)..(1422): n is a, c, g, or t
  misc_feature (1430)..(1431): n is a, c, g, or t
  misc_feature (1435)..(1435): n is a, c, g, or t
  misc_feature (1464)..(1464): n is a, c, g, or t
  misc_feature (1470)..(1470): n is a, c, g, or t
  misc_feature (1475)..(1475): n is a, c, g, or t
ccgaaaaaaaatctatttatatatatatagtccaccctcacctctatctaatctagtggttctccaactttaatgtgctcaggaatcacctggagaatttgtgaatttatgaaaacagtttcctggggcccttcccaaatatgcagattcagtaggagtggcagggcccatgaactcacattctgtgacgttcacacagaggggctggtgctgctggtcaaagatcaccattagagcaatgctggatcatctattcagcctactctccctaactgtttccccgcagaggcttcagggcttttgagggttacttagccaagtcattgcctctgttcccggagccatctgccaatttcaagtgccacatcatctgggtatcatgagagcccatctccatctgccagcctggaagcagccatggcaaatgggatgtgtcccactgcccccgtttggtgccacagttgggtttattctcacagctgcaaacccacgtgctgggctgcacagctgcctgaacgaagctggagcgtgcagaacaaactgcatggaatgtcacgtggggttttccactctcgcccacagtgagttggcaatgcctggccacgtgtgctctgtggtctttgaacttgatctgggaggacagaacttcaaaaggaagatgaaggccccagcaagggaggtattcctgtcttgagcagaaggtaaaggtagaaggtgcagattaggtactgggaatagtcatggtttggtttgaatggagtagaagattccagaggaagagcagtggggcacagtggggagtgaagggggccatggcagtctgatgcagggaagggatacgcccaagatggccaggagagaagagccgaggggcagggtgagcaaaaggtgaataagggctcagacgacatgacggcaccggggatggcaagggctggacgcagcaggaccgtggtctgttctgtgatggattgtcgggagaaacgggagcgtgtgaggaattgaaaaggaggcaacattctgattctgagtctggatgcctgaaaaatagaagtcccagagatcaaaatagtagaggctggaagaaaaatggatggggaagaagtgagcttgaaagaatccttagaagtcactgttatgggcttagttgtatcctcttaaaattcatataatgaagccctaaccctcccagacctcagaatgtgactgaatatggaggaagtgtctttcaagaggtaattaccgcctgtaatcccagtactttgggangcnnaggcnggcngatcacttgaggtcaggagtttgagaccngcctngccancntggtgaanccctgtctctactaaaaatncaaaacaaattagccnggtgttgtggcnggcacctgtnntcccngctacttgggaggctgaggcnggagantcgcttgnncccnggaggtggaggttgcagtgagtggagatngctccnctgcnctccagccagggtgactgagactccacctctg

SEQ ID NO: 36409 - DNA, 381 bp, Homo sapiens
gaataggaatattacctgtctcatggggttgttataagggtgaaatatatgagttcatacatgtaaagcgcttaaaacagtgcctggcacttagcacagcgagggtactgttctccgccatatttgacagggccctagtcactgctttcagttgcattgctccttgcttcaacagccctgattgaatgccttctttagttgcatccacactaaaatagatccttcagttcctagggcacgcacggggcagcagcatcttcagagaacagttctctcttccacgtccacttgaattcttatttcattctccagcctgggcaacagagcgagcccctgccttataaaaagaaaatgtgtgtgtgtgtgtgtgtgtgtgtgtgt

SEQ ID NO: 36410 - DNA, 475 bp, Homo sapiens
gctcattcttgagctgctcctgcatagatctcgtcctgttcaacacaccaaagattgacagctgaactgagagaccatcacccacagacacaactggccactgggtggtgcacaagtcagacagaactgaatagtcctgtgaagactttggacactgaactgactttggaaccagactgcagaatggaggggtgggaacttgtggcttgaacctaatcaggtagattgcctggccaaaatgaaaatacctatcatctccataggatttaatttcattcaatgattttttttttagtaaatttgcaatgttttacagccatccccaaaatctaattccaaaatatctctatcaccccaacaagagactccattcaggttggcagtcacatgcactcccagatttcccctctgcccagcccttggcaatcactagtctactttctgtgtctttgagtttgcctactctggatatttc

SEQ ID NO: 36411 - DNA, 233 bp, Homo sapiens
ccaggaaagaaaagaacatttggcctgtttccggcaactcatctaacttacaaatgggatccccaaatatctcatcataatattgagagtgatcagcttttccatttctggatggaattgagaggtacagaaaaaaaaaacagtaaatagaatgatggtctcttccaaataaccaacatgaagctccttcatttaaaacagggaaaagtacaagaaactccaaagaaagcatg

SEQ ID NO: 36412 - DNA, 260 bp, Homo sapiens
gtgatctgcccacctcggcctccccaagtgctgggattacgggcgtgagccactgcgcccggcctcagaatgcaatttttttaatctttatttttgaatatttgcagtgtactttccatttcagcatccttgtttgtctgttttttgagacaaggtctcactcccattgcccaagctggagtgtggtggtgcagtcacggctcagtccagtttcagcttcctgggttcaggcgatcctcccgcctgggcctcctgagtgg

SEQ ID NO: 36413 - DNA, 829 bp, Homo sapiens
aataatcttagaaaatatgattctttaaacatatgcataccacatctttaaacataaacataccacacagtgcaccatcacttccttaaccattttccaattgttcacttataacatttgcaattttttattataaatcatattgtgatgaatactttcatccataagttttattgcaaggcttattgtttcttctaatgtcttctaatttcaaagaagtggcttactggttcaaacagtgcacatacgtggttttaaggcttttagtatactttaccaaataatctccagaatagctccaacaactcctaccaacagtatgttattgtgcccatagggtggacttgataacagcaaagcaaattcaaccacagatatattagattctcacccatctcaaaactatcacatcagagaagcaaggagacatattattggtgaggaagccaaattcaaattcttttaaaaaatcactcagctttagatcagtaaaataatcaacaaaaatggtcaccgcaaagtctaccgggtttttcaaaaaataaaaagagagaaagagaaaggccaggcgcagtggctcatgcctgtaatcccagcactttgggaggcctaggtgggccaatcactaggtcaggagttcgagaccagcctggccaacatggtgaaatcccatctctactaaaaatacaaaatattagctgggtgtggaggcgggtgcctctaatcccacctactcgggaggctcaggcaggagaatcacttgaactcgggaagtcgaggttgcagtgagccgagatcgcaccactgcgctccagcccaggcgacagtg

SEQ ID NO: 36414 - DNA, 892 bp, Homo sapiens
caagtatatttattttcatacctgttataactgctactggaaaggagaaatactgttgtcttattttccaagagatatacacagccttgttgattttagaatcattaaaatttttaaaattgcagaccatacaaaagtacacaataatgtaggcttgttcctcattccagagattacttcaaaattcgttcaatgaaacctctgcctcccaggctcaaaccatcctcccacctcagcctctcaagtagctgggactacaggcatgtgtcaccacgcctgcctaatttttttgtattttcagtagagacgagttttgcatgttgcccatgctgatctcgaactcgggagcgtgaagtgatggcccacctcagcctccctcaggattacaggtgtgagccaccgtactccgcccatgatgggctttttgtttgttttactgtatgcttttgcttttctccattttcaagattagtgattgtactgttggcatgcctcagaaaatgtttttctttcctttatcttccctcttttcttcaattcttaaaactttctttctttttagaaaacctgtaatgaagcactattctctgggttttcttctctttctgttttactgttgcacagcctagattttatatgaaaggctgggccgggcgtggtagctcacacctgtaaacccagcactttggcaggctgaggcaggcagatcacttgaggtcaggagttcgagaccagcctggctaacgtggtgaaactccatctctactaaaaatatgaaaattaggctgggcctgatggcacacacctgtgatcccagctactcagggaggctgaggtgggagaatcacttgaaccccggggaggcggaggtttgcagtgagccgagatggtg

SEQ ID NO: 36415 - DNA, 420 bp, Homo sapiens
aataacaatagctaacatttgaaatgcatccatgctcttgtataatcagagtcaagtatatttattttcatacctgttataactgctactggaaaggagaaatactgttgtcttattttccaagagatatacacagccttgttgattttagaatcattaaaatttttaaaattgcagaccatacaaaagtacacaataatgtaggcttgttcctcattccagagattacttcaaaattcgttcaacttaaggcctggcaaggtggttcatgcctgtaatcccaacactttgggaggccaaggtgggtggattgcttgagtccaggagttctagaccagcctggacaacatggtgaaacctcggctctactgaaaatacaaaaaactagcagggcatggtggtgtgtgcccgtagtctcaa

SEQ ID NO: 36416 - DNA, 565 bp, Homo sapiens
gctcacctcctgcacacctggaacaccccctgtcacctgtgcaccttaggctttatgtcaagccaggatagaagatggacaggccatggggtacctgcagcagaggatctccacttcagctacctggagggaatccactttcagggttgtcagcctagctattgtcacaagaagtaaattcccctgtccaaccagcccacaaaaccagaacagaactgctctgtgactgtccaggcatacactctgagacctgaggcatgtcttgccccctcacgggtgacttctcaaaaggctttcccctggcagagcatccgttttccttctgttgccaataaaaatccccagctctgttctttctccttcgcatccttctattgcttctgacagagtttgccagttagctgaggtcaggatttcctttttacaaacaacctgttttcagtcagcaaggccagaggtttcttaaattacaaaccctttcatttcttttgccgcaagtcatcctgtcagtttgtataatgacatagaatggagagaaatggagatgtgcagagagacactgaaa

SEQ ID NO: 36417 - DNA, 371 bp, Homo sapiens
caaaactttacaggaagccaatattgtagctgtactcatcttgctgctattgctctagaagaaataataattaataactaatttgtagcagtaggtttaagaggaaaacaaagtgcagctattctgttgagttaaactgtagaaccacttgtgttaacattcaggcaagttggcaatagaattaatatactttcatggaagctgaagaccatgacaaaagtaagtactgaaagagagggccagcctatgtcctctgcatggagaaaggccaaggagagatttttgggctgggccaagacattcctcaagaagtggttttgggtttgacaaagcagacaaatggggcctcaaaaccacaggttctacctaac

SEQ ID NO: 36418 - DNA, 154 bp, Homo sapiens
gtaccttgaataatgagaatagattgtcattgataaagtaattgtgtgcaaaatatgtagagaactcttataactcaataatgaggaaaaaaactcaaaaagtgggcatttggacaaacaccacagaagatttttaaatgacaaaaaaaagaca

SEQ ID NO: 36419 - DNA, 377 bp, Homo sapiens
tttttgttattttaggagtgagtttctaattaattcagtttatatgcatttcctatctaaagtcttttcacattttcaaagctcctgcacgagtgacagaaaaacacaagcttaaaatatctagagaaacagcaccacagaaataggatagatagataattgagaaggcatctgccctctatccagcacagggtcagtactacttctggtacttaccctgctcacatatgaactgactaatatacaagattatctattggagcattatctgcaataccaaaagactggaaataaacaggtgtccatcatcaggggctggttaattactccatgggtagtaaatagttacataatgacatctaatgaatttctcatcc

SEQ ID NO: 36420 - DNA, 348 bp, Homo sapiens
taatttattttataacaatccaaaatgcatgatgtcatgaataggtgctgacaggagagaattggtatacagaatattgagaaaaatgtgctcttgagggataattattcatctaagagagattgtctttttgttgaaatgccaaacatttgcttattttttaaagcacttgggagaatcatatctaagggggtggcatgctgtacttgacttagggaaaaaaggtattcagtgggtttgagagtcaagattaaaacagctgtcaaattaacctgaagagctagtgactgtagcctgccttagaactataaagtagtgaccaccttcccaaatgagactggtttaatt

SEQ ID NO: 36421 - DNA, 646 bp, Homo sapiens
taccatcgtggctcgctgcaacctccgcctcccaggagaattgattgaacctggaggcggaggttgccgtgagctaacattgcgccctacactccagcctgccaacagagcaagactccgtctcaaaaataaaaaaaggatctacttttgagaatactggcattggttgataaaatacagcagaaacttgtgaagaagctattttccatattcacctggcatgtttggagatgattgccatcaactttgtgactgtgaaggagaaaccttctgccacccaaaaactgaaaaatgcctctgcccccgtgggagaactggagccagatgtgatgctggttagtctcctgtattgggcgttcagcatggatgttgcctttttctgacctcaagacaactatccaactttccctgtgtccttcacgatgcaaccactaaagctctactgaagtctctaattctgagaaggcaccttaaaaatttgaatctaataacttgcttggatcatatggctcctaagtggagcagaactcaggtttgcctcattccagaggccacgttcttgactacagcatgcatgcgattataaaacactaccatcgaggatgaaaatctatacccgtaaattttggaaagtaataaaattttg

SEQ ID NO: 36422 - DNA, 568 bp, Homo sapiens
agggaatgcaaatatgttattcataagatgcattgagtattgtaaataaaacaaaccatttttgatttgtttaaattgctcgttacagttctcttgtggggagggactttgtcagtcattttgcatcttaagctagactaaactttttgttgttgttttcctaaaaccataggtgcaagctttgccgctgggaagtcatattgaattaagcacttttgaaaatgtcactgtttgtgacacacaatgttctctacagaaaacttcttctatcttatgtcattttagcagtagatgtaactgcctgccaccaggtgcaatatgtcatttgcatcagccttttcagttaaggaaattaaaacttggcatgcattagttcatatgtatgaggttggctgtgtccccaaacagcaattgcttgtacaagatagaagtttgcttctcagctgggcatggtggctcatgcctgtaatccaagctctttgggaggccaacgcgggaggattgtttgagcccaggagtttgaaaccatcctgagcaatagagagacccccatctcgacaaaaaaaaa

SEQ ID NO: 36423 - DNA, 627 bp, Homo sapiens
agaaaaagtaaagaagagttaaataaatggagaggtatatctctttcatgggtcaattttgttaagattttccccaagttcatttattgattcagtgcaattccaattttaaataaacttaacaagctgattctaaactcatatggaaattcaaaaggcatagaatagctgaaagaactctgataaagaaggataaaatgggagggaaactctgattctaagactttttatagagctacaataatcaaaacagtgtagcattggtgtaaaaatataaaaatcaatggaacagaccagggaatgcagacctggacccatgcatatatggacaagtgatttttgacaaaggtacaaaggcaacaaagtggaaaaaggatagccttctcaacaaatggtgctgaaatcattgcccattttcaaaaaaattaactttgatttatacactccaccacatacgaagtaaactcaaaatggataatatacccaaagataaaggctaaaaccataaaatatctagaagaacacatatgagaaaatttctatgactttgggttaggcaacaatttcttagacatgtcactaaaagcatgattcattagagaaaattttaataaattcgacttcatc

SEQ ID NO: 36424 - DNA, 1068 bp, Homo sapiens
ttatcttatgggttatttagaactgtcatttagttactagatacgtgaggattttccagatacccttccgtttttgctttctaattaagtgatgttcagctttgttactttggtgcataaacatttacaattatgtcttgatgaattgaccccttttccattctgaagttaacccactttgtccctcgtaatagtatttgctctgaaatgtactttggccaatattagtgtaaccactccagctttgtttcgaatagtgttagcatggcatccctttactgtatttgtgtctttgtatttgaaatgagttccttataggcagtatgtagttgggttttgtttttctaatcagatatcataatctctgccttttaattgtggtttgtagaccatttgtatttaatgtgattattgacatgatgagttttaaatctaccatcttgcactttgtttctactttatttttggctttagttgttttttaaaatataatttatgtcttttattaacttactagctataactgtagttattttatttatttatttattttgagacaagctcttgctgtgtttcccaggctggtgtgaagtaaggcaatctgggttcactgcagcttggacctcctgggctcaagcagtctgccccacctcagcttcctgagtagcagggattacaggcacatgccaccacacctggctaatgttttgtgttttttttttttgtagagacaggattttgtcatgttgctcaggctagtctttaactcctgagctcagacgatccaccccgccgtggcctcccgaagtgctgggattacagggatgtgccactgctcctggccagttattttagttgcgttagtatacatctttaactcaaatcagtttgcctttaagtggtattacacatcttcacatacagtctaacaactttatcaaagctccttttttccttctggcctttgtgctgctattgtaatacatttacttctgcatatgttgtaaccctccccacagtgttgtaataatttttactttaagtagtccgttattgttcaaatattta

SEQ ID NO: 36425 - DNA, 350 bp, Homo sapiens
gtagggaataacaatgtatttgaggtcgttgtatccccatatcatagaatctgtatacaaaaatgaacattgaacaagatgggtcatgcctgtaatcccagcactttgggaggccgaggtgggtggatcgcgaggtcaggagtttgagaccagcctggccaacatggcaaaaccccatctccactaaaaatatgagcattagccgggcatggttgtggacgcctgtagtctcaggtacttacttgggaggctgaggcaggagaatcacggaggttgcagtgagccgagatcatgccactgcactccagcctggacgacagaaggagactccttcttaaaaaaagaaaata

SEQ ID NO: 36426 - DNA, 468 bp, Homo sapiens
ttttttttgaggctataatcatttaattatacacaggccacaattgcaggatggaaaggcagtgggcacttggaagtgactacacatggcaataagcagcctatcttctttaccaaccagaagtttcttggggcatgtgatggtaggccagaccctttccaagggaatactactacactaagcctacactgtactgtgagagtcatggtggaacaaggccacagcgagtgggaggaaatgtgatgactcactgtgtcagaattctaaggcccagcatgatcaggatgtaaggctccataatttttcaaaccagaaattatgagaagaacagaattcggcatcagctatggttttttgcttttttttttttttgagacagagtctcactctgttgcccaggctggagtgcagtggcacaatctcgggctcactgcaacctccgcctcctgggtccaagcgattctcctg

SEQ ID NO: 36427 - DNA, 413 bp, Homo sapiens
gaataactcattcttatgaaaagatttagttctcattataatatagttgtaaaaatgtcaatcacttgtaataacttaagtattgaattttaccactgtgcagcatagctatttatttgtgtatgtgggagaagaaaaaagagaatctgaacaaatattgaagaatacaaaaccaaacaatcagatgaaagctgaggtaattaagaactttttttttttgaaatggagtctcactccagcctgggcgacagtgagactctgtctcaaaaaaaaaaaaaaaaaaattagtctggtgtggtggtggtggtgagtgcctctagacctagctttggcagctgaggccggaggatcacttgagcctagaagttcaaggctgcaatgagctatgattgtgccactgcactctggcctgg

SEQ ID NO: 36428 - DNA, 1776 bp, Homo sapiens
atgtccattttacagctagacacaaaatttagtgggtccaaattgttcaatcacttctatgttatttgttcagaatagtggatctttgcttaattcacttctgttttaatcccatcatattcctttaggccaagaaaaggaaagctgatttggattatatttatgcttaatatcaacatggtttataagtggacagaaaaacactcactcacgtattcagccacgtatggtctggagtgctctgtagaacagcccgaagtgtacaccatgtctctgcacttgaagctcatggaatgtgttggaggagactcaagctccatgtgggaacagtgtggcccaagagccagcatggaggagggctgtgtgagcagactgctatagaatgctaaagttataatcctagctggtgtctcgttctgtttaaaaaaatcaaatttctgtatgtaattgacgtattggtccttatagtcagtaccatcaggtcttagattgttaagtcattttgctgccaccagaccagtgagagtcactcacttatttgtaatgattcttgggaagtttagtcaagagaatatccttgaataaagaagtacatgttttaagtattttcatcgtagtctagatgggctgtaaaacccatttccacacgagtataaatttaaaacagaaacatcaaggtgtcagcaatcatgattttgttttgcttgttcacaagtttgaaaaggtgcatgaggcaccaatcagtgacactggaatgctttaaggatggtttgtgactttaccccattgtgccttatcatttgtcagcaaacttactgggccaaacacaaatggctgagacactcctggcccatttcttgtcatcgctgccatccccaaagacagactctgggaaacaacttgggaactgcttcaagtccatgccaggtcatggcttcgtccgcctcccagcatgtacctggacttcctttgggtgccggcttttctgctggactaagagattcatggaaagaaccccagggcaaggtgaggagaagcagctggtacagactgatgacgaaggagaggaccagaaaagctgcttgggtgtggtggaagtttcagtgtaatgtgattcctagtaggcacatctgtgactcccttaaataaaaagggccagagatgaggggacgcctggtgaaaatggtgtttgttgtaacatcttggtatcattgtgggtaagtagaacaaatatttacatctgttatgaaaagctacctttagccgtagataaacattaaaaggaagactcagccccagagtatatttgatctattggttaactcatctgtcagcaaatggttaagtaagtaaaattaatttttccatttggtgtgtatttcacagggtaacaatgaagtgctccaatctgcttgtgagaccagttagattagtagttgcagttgagaccattcctcctgtatgtctttacaagcaaattgaaacgacatgctcttctttgtactatacagaaggacacaccacagatcctctttttaaagcaggtaataaagtagctttttccttttgaaacatcattgtaaaacagtgctttttaaactatccatggtaaaggatgagttttaaaaattctaatcctttgcaggttggtagttttataaatacgataaaaatatagcaccaagattagattgttataaaagtttctaaacactttcagtttctgtacttaatcttgcagtgtggtaataaagacttctacactttagtagcact

SEQ ID NO: 36429 - DNA, 658 bp, Homo sapiens
tcttcattgacctctacagtccctgcctgtttggaaacatctatggttttgtataacccctgtcatttaactgacagtgttagaagatatccccctgatgtgttactgtaaccaagaaagcatgaacgttaccctttctggtgacagcctgccatgggctgctgtggctgatacttatagaattgttgctccaaaattttggctccacttgagctgtccagaagtgtacctgacatttgtgtattaccactcaccttggatctccttactagtgtaattatttccacatcaatccaggactgaaaggaaaaattttttcaccaggattggcagcctgtagctctgtgacctcagtcaacccatcatgttgtgttgtgggcggggggcaagaattctttagagaaccaagttgcgagaaagatttcaatccagtgaaagtaaaaagtaagaagacatttagatagttgctatattttgggaagatgtcaaaacaggtttttagggaggaggtatgaggtgttgtgttgttttgtttgtttttattcagttgtataatgaatataacaaattaagtagccagaaggagctgcatgtaaattagcaccacttttaaatgtcaacaataaatttgaggtgagcttcctgggtgatgccaaca

SEQ ID NO: 36430 - DNA, 939 bp, Homo sapiens
tcttcattgacctctacagtccctgcctgtttggaaacatctatggttttgtataacccctgtcatttaactgacagtgttagaagatatccccctgatgtgttactgtaaccaagaaagcatgaacgttaccctttctggtgacagcctgccatgggctgctgtggctgatacttatagaattgttgctccaaaattttggctccacttgagctgtccagaagtgtacctgacatttgtgtattaccactcaccttggattttcagtgtaatgtgattcctagtaggcacatctgtgactcccttaaataaaaagggccagagatgaggggacgcctggtgaaaatggtgtttgttgtaacatcttggtatcattgtgggtaagtagaacaaatatttacatctgttatgaaaagctacctttagccgtagataaacattaaaaggaagactcagccccagagtatatttgatctattggttaactcatctgtcagcaaatggttaagtaagtaaaattaatttttccatttggtgtgtatttcacagggtaacaatgaagtgctccaatctgcttgtgagaccagttagattagtagttgcagttgagaccattcctcctgtatgtctttacaagcaaattgaaacgacatgctcttctttgtactatacagaaggacacaccacagatcctctttttaaagcaggtaataaagtagctttttccttttgaaacatcattgtaaaacagtgctttttaaactatccatggtaaaggatgagttttaaaaattctaatcctttgcaggttggtagttttataaatacgataaaaatatagcaccaagattagattgttataaaagtttctaaacactttcagtttctgtacttaatcttgcagtgtggtaataaagacttctacactttagtagcact

SEQ ID NO: 36431 - DNA, 561 bp, Homo sapiens
tatttggagatatttaaatgaaatagaaagccatataacatagctataattactacctgtttgctatttttgtttaacttattttgtagcttcctcactggtttgtgttgctaagcaaacgtatacaaacagaaaaagagcttcctaaattgcacatttttgcacctcttgtgcattctgcaagaagacaatgaatccatgtatttctatataagtatcttcttcatttttaacctgttttcatttgtaatgatgctacataattttgtggctccctaatgcaataatgtacagaagataaaaaaatttataattgaacaatttgtctttctgttcgctgaatatattgcaggtcatgctcccatgcccccctttctaagccgatatcaacaagactggaatgtttgtgatatcaggggcaagagttatcatagaacaacaaaatagagtggactcttttagagcatctatatctgcaacctgtaaatggtaaaatgtctgtgtatttttttaaatgtaccttttcaataaaagtacaaaaaataaaatctgtttgtattt

SEQ ID NO: 36432 - DNA, 314 bp, Homo sapiens
tgtcagagatcatggagtattaagatgaatggatctagaaatattgcttctctaacagaagttgaaaccaggaattctattacatagtgtgctgttcaagatcacctggatggttctggaactaaggaaaatccttacagaaatacacagaccatatcttgtcttgtattgccatcattaaaaaaaacccacaaaattcacagttaaaaattactgatagagaacagtaatagttggtaattagtgttatcgagttactattagttatattgttggatttttttaaagcatcaagctattagtttctgtatctg

SEQ ID NO: 36433 - DNA, 505 bp, Homo sapiens
agactcagacgccaaataggaatcttttcagcccttcgacggaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggttgctttgcttaaatgtccccttgggggaggggggttctgcttctgtcggcaggggttgggagctccgaatctggccccaccttcaatctcccagaacagcaagttgcctcctaatgatagggagaaagataacggggaggtggggatgttcactggaggggttgggggcggagaaatcacaggccttcttaaggctctcctgacttcaaggctctggaagcctctgggaagaatggagccacatctgggtc

SEQ ID NO: 36434 - DNA, 2737 bp, Homo sapiens
  misc_feature (146)..(146): n is a, c, g, or t
cggcctcaggacgcaccggagccgcctttccgggcctcaggcggattctccggcgcggccggcccgccctcggactccccgggccgccccggccccattcgggccgggcctcgctgcggcggcgactgagccaggctgggccgcgnccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaa

SEQ ID NO: 36435 - DNA, 3391 bp, Homo sapiens
  misc_feature (146)..(146): n is a, c, g, or t
cggcctcaggacgcaccggagccgcctttccgggcctcaggcggattctccggcgcggccggcccgccctcggactccccgggccgccccggccccattcgggccgggcctcgctgcggcggcgactgagccaggctgggccgcgnccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacatggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaa

SEQ ID NO: 36436 - DNA, 2042 bp, Homo sapiens
ctagacgcagtgactcgtattatggtctagctgtttccatgatgtaaacccttcgacggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaa

SEQ ID NO: 36437 - DNA, 2710 bp, Homo sapiens
ctggtagctggagcacgtgatggtcaccgtgtcccctggccgcaggtccctgttgggctccagggtcaggaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaa

SEQ ID NO: 36438 - DNA, 2643 bp, Homo sapiens
  misc_feature (146)..(146): n is a, c, g, or t
cggcctcaggacgcaccggagccgcctttccgggcctcaggcggattctccggcgcggccggcccgccctcggactccccgggccgccccggccccattcgggccgggcctcgctgcggcggcgactgagccaggctgggccgcgnccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacatggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaa

SEQ ID NO: 36439 - DNA, 1867 bp, Homo sapiens
ttggagccaatggtgctgtcctccgggacatggggccaggcatgacagtctcactgttgctacttttcctctcggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaa

SEQ ID NO: 36440 - DNA, 1940 bp, Homo sapiens
aaggcaacagtccactgaaagagaacaggtatgtacttgagtactccctttgtagagaaagaattttgcccatctcaatggtgtgtagctttcattgatatctaaggcatttggaattacttaggatcttggtgttaaaaaaaaaaaatggcagggttaaattctctttggttctcattctgaatcttaagacttctgtttgtttcttcctggtacccataaccttctcagaacaccgtcgaagagagagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaa

SEQ ID NO: 36441 - DNA, 2663 bp, Homo sapiens
  misc_feature (146)..(146): n is a, c, g, or t
cggcctcaggacgcaccggagccgcctttccgggcctcaggcggattctccggcgcggccggcccgccctcggactccccgggccgccccggccccattcgggccgggcctcgctgcggcggcgactgagccaggctgggccgcgnccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttctcttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaa

SEQ ID NO: 36442 - DNA, 2778 bp, Homo sapiens
  misc_feature (146)..(146): n is a, c, g, or t
cggcctcaggacgcaccggagccgcctttccgggcctcaggcggattctccggcgcggccggcccgccctcggactccccgggccgccccggccccattcgggccgggcctcgctgcggcggcgactgagccaggctgggccgcgnccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaaaaaaaacctcttcacccccatcctctcatcaaaaaaaacaa

SEQ ID NO: 36443 - DNA, 2516 bp, Homo sapiens
  misc_feature (146)..(146): n is a, c, g, or t
cggcctcaggacgcaccggagccgcctttccgggcctcaggcggattctccggcgcggccggcccgccctcggactccccgggccgccccggccccattcgggccgggcctcgctgcggcggcgactgagccaggctgggccgcgnccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacagtccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaa

SEQ ID NO: 36444 - DNA, 2737 bp, Homo sapiens
  misc_feature (146)..(146): n is a, c, g, or t
cggcctcaggacgcaccggagccgcctttccgggcctcaggcggattctccggcgcggccggcccgccctcggactccccgggccgccccggccccattcgggccgggcctcgctgcggcggcgactgagccaggctgggccgcgnccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattacatcactggggtatattggaagatttggctgggggggggtgcgtgtt

SEQ ID NO: 36445 - DNA, 2690 bp, Homo sapiens
  misc_feature (146)..(146): n is a, c, g, or t
cggcctcaggacgcaccggagccgcctttccgggcctcaggcggattctccggcgcggccggcccgccctcggactccccgggccgccccggccccattcgggccgggcctcgctgcggcggcgactgagccaggctgggccgcgnccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgttctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaa

SEQ ID NO: 36446 - DNA, 2326 bp, Homo sapiens
  misc_feature (146)..(146): n is a, c, g, or t
cggcctcaggacgcaccggagccgcctttccgggcctcaggcggattctccggcgcggccggcccgccctcggactccccgggccgccccggccccattcgggccgggcctcgctgcggcggcgactgagccaggctgggccgcgnccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaa

SEQ ID NO: 36447 - DNA, 1739 bp, Homo sapiens
  misc_feature (146)..(146): n is a, c, g, or t
  misc_feature (1709)..(1709): n is a, c, g, or t
cggcctcaggacgcaccggagccgcctttccgggcctcaggcggattctccggcgcggccggcccgccctcggactccccgggccgccccggccccattcgggccgggcctcgctgcggcggcgactgagccaggctgggccgcgnccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagatttggataaaaatttaaaacaagggnacagtgaggcactaattatccatggagtga

SEQ ID NO: 36448 - DNA, 1648 bp, Homo sapiens
  misc_feature (146)..(146): n is a, c, g, or t
cggcctcaggacgcaccggagccgcctttccgggcctcaggcggattctccggcgcggccggcccgccctcggactccccgggccgccccggccccattcgggccgggcctcgctgcggcggcgactgagccaggctgggccgcgnccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatatttatgttctgatctgagcaaccatgccattagtttcagacaaagacactttgcatcccagacggggatcctctggaacagctatgtca

SEQ ID NO: 36449 - DNA, 1413 bp, Homo sapiens
  misc_feature (146)..(146): n is a, c, g, or t
cggcctcaggacgcaccggagccgcctttccgggcctcaggcggattctccggcgcggccggcccgccctcggactccccgggccgccccggccccattcgggccgggcctcgctgcggcggcgactgagccaggctgggccgcgnccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtctacaagtatgcgtgtgcccaacgcgcgctggagtgtatcctcatagagt

SEQ ID NO: 36450 - DNA, 288 bp, Homo sapiens
agaggagaatgacaagccacagagtggaactgggacctgggactggggcttgggacagcaacatagggccccttcccttgtgctatgaagtggtcccactctgctgacttgtcccgccccttccagccctcactcctccctctgcctgactccctaccccaccacttcccatggttcctccctcaccgtgtgcgccttcctttttttacagccctgcagcctctgaaacactctgacagcaaagaaggtaaagacacctgggcttgaggttgtgtctgtgtatgcaca

SEQ ID NO: 36451 - DNA, 453 bp, Homo sapiens
aaaaaaaagtcagcttggttttgaagagttgctggagaatgtggcctggatgggcaaaccagtttgcttcctaaccctgctccttggtgaggcagcctgccccctcagtctctggccatgctggacaaccacagaggcagtgcccagatgggggagctcttctcctctccccagggacatacagagccccaagaatgggtgagggagagggcaggggaagggcccaagcccttcttcccaagtctccattcagcttcagatgcagagtggggtctgaaagatgagtctttgggatggccctccacatggagacaggaagcccaagggaaggaggagggcccctgccgtgtcactctcagggaaaccagtgtggaggggacactgggaaggctgcctgctggacgagggagttgggccaggccttggagggtggatgggatggacaaacaggag

SEQ ID NO: 36452 - DNA, 2146 bp, Homo sapiens
gggagagggcaggggaagggcccaagcccttcttcccaagtctccattcagcttcagatgcagagtggggtctgaaagatgagtctttgggatggccctccacatggagacaggaagcccaagggaaggaggagggcccctgccgtgtcactctcagggaaaccagtgtggaggggacactgggaaggctgcctgctggacgagggagttgggccaggccttggagggtggatgggatggacaaacaggagatgagaagggaaaagtgttgcacgtagagggagagtggagggaagtgtatcgggctgtgggcctgtgggtactgagagggggctgcgtgaggtggtccccctcaggtgccccggcgtgcctggcacctgcatctgtgtctgggcctccagggccgtggtcagcacgggggctgtccgttgggctgctgtctcacacacactccccacttgaagtctgaccaggtgcttgggcttctggcataatcccaaaaatagatcttctggcatctaatgcttttcccttcccttttttttcttcccatcatgaaatgaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcagactgactgaccccctgccttatttcaccaaagacacgatgcatagtcaccccggccttgtttctccaatggccgtgatacactagtgatcatgttcagccctgcttccacctgcatagaatcttttcttctcagacagggacagtgcggcctcaacatctcctggagtctagaagctgtttcctttcccctccttcctcctcttgctctagccttaatactggccttttccctccctgccccaagtgaagacagggcactctgcgcccaccacatgcacagctgtgcatggagacctgcaggtgcacgtgctggaacacgtgtggttcccccctggcccagcctcctctgcagtgcccctctcccctgcccatcctccccacggaagcatgtgctggtcacactggttctccaggggtctgtgatggggcccctgggggtcagcttctgtccctctgccttctcacctctttgttcctttcttttcatgtatccattcagttgatgtttattgagcaactacagatgtcagcactgtgttaggtgctgggggccctgcgtgggaagataaagttcctccctcaaggactccccatccagctgggagacagacaactaactacactgcaccctgcggtttgcagggggctcctgcctggctccctgctccacacctcctctgtggctcaaggcttcctggatacctcacccccatcccacccataattcttacccagagcatggggttggggcggaaacctggagagagggacatagcccctcgccacggctagagaatctggtggtgtccaaaatgtctgtccaggtgtgggcaggtgggcaggcaccaaggccctctggacctttcatagcagcagaaaaggcagagcctggggcagggcagggccaggaatgctttggggacaccgaggggactgccccccacccccaccatggtgctattctggggctggggcagtcttttcctggcttgcctctggccagctcctggcctctggtagagtgagacttcagacgttctgatgccttccggatgtcatctctccctgccccaggaatggaagatgtgaggacttctaatttaaatgtgggactcggagggattttgtaaactgggggtatattttggggaaaataaatgtctttgtaaaaa

SEQ ID NO: 36453 - DNA, 1619 bp, Homo sapiens
  misc_feature (146)..(146): n is a, c, g, or t
cggcctcaggacgcaccggagccgcctttccgggcctcaggcggattctccggcgcggccggcccgccctcggactccccgggccgccccggccccattcgggccgggcctcgctgcggcggcgactgagccaggctgggccgcgnccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacccacaaccttagttctctaagtcatcctgcctgctgccttatttcacagtacatacatttcttagggacacagtacactgaccacatcaccaccctcttcttccagtgctgcgtggaccatctggctgccttttttctccaaaagatgcaatattcctctatgctggctctcctctgccctttcttcccgtgctctccgttcctcgtcttcgt

SEQ ID NO: 36454 - DNA, 1462 bp, Homo sapiens
  misc_feature (146)..(146): n is a, c, g, or t
cggcctcaggacgcaccggagccgcctttccgggcctcaggcggattctccggcgcggccggcccgccctcggactccccgggccgccccggccccattcgggccgggcctcgctgcggcggcgactgagccaggctgggccgcgnccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggagctgaggaccaggatggggagggagaaggctccaagacagccctgcagcctctgaaacactctgacagcaaagaagatgatggacaagaaatagcctgaccatgaggaccagggagctgctacccctccctacagctcctaccctctggctgcaatggggctgcactgtgagccctgcccccaacagatgcatcctgctctgacaggtgggctccttctccaaaggatgcgatacacagaccactgtgcagccttatttctccaatggacatgattcccaagtcatcctgctgccttttttcttatagacacaatgaacagaccacctcgaagggtgtctacatcaggagacagctagcaccataatacgagtcacgccgtc

SEQ ID NO: 36455 - DNA, 1948 bp, Homo sapiens
  misc_feature (146)..(146): n is a, c, g, or t
cggcctcaggacgcaccggagccgcctttccgggcctcaggcggattctccggcgcggccggcccgccctcggactccccgggccgccccggccccattcgggccgggcctcgctgcggcggcgactgagccaggctgggccgcgnccctgagtcccagagtcggcgcggcgcggcaggggcagccttccaccacggggagcccagctgtcagccgcctcacaggaagatgctgcgtcggcggggcagccctggcatgggtgtgcatgtgggtgcagccctgggagcactgtggttctgcctcacaggagccctggaggtccaggtccctgaagacccagtggtggcactggtgggcaccgatgccaccctgtgctgctccttctcccctgagcctggcttcagcctggcacagctcaacctcatctggcagctgacagataccaaacagctggtgcacagctttgctgagggccaggaccagggcagcgcctatgccaaccgcacggccctcttcccggacctgctggcacagggcaacgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacatggtgaccatcacgtgctccagctaccagggctaccctgaggctgaggtgttctggcaggatgggcagggtgtgcccctgactggcaacgtgaccacgtcgcagatggccaacgagcagggcttgtttgatgtgcacagcatcctgcgggtggtgctgggtgcaaatggcacctacagctgcctggtgcgcaaccccgtgctgcagcaggatgcgcacagctctgtcaccatcacaccccagagaagccccacaggagccgtggaggtccaggtccctgaggacccggtggtggccctagtgggcaccgatgccaccctgcgctgctccttctcccccgagcctggcttcagcctggcacagctcaacctcatctggcagctgacagacaccaaacagctggtgcacagtttcaccgaaggccgggaccagggcagcgcctatgccaaccgcacggccctcttcccggacctgctggcacaaggcaatgcatccctgaggctgcagcgcgtgcgtgtggcggacgagggcagcttcacctgcttcgtgagcatccgggatttcggcagcgctgccgtcagcctgcaggtggccgctccctactcgaagcccagcatgaccctggagcccaacaaggacctgcggccaggggacacggtgaccatcacgtgctccagctaccggggctaccctgaggctgaggtgttctggcaggatgggcagggtgtgcccctgactggcaacgtgaccacgtcgcagatggccaacgagcagggcttgtttgatgtgcacagcgtcctgcgggtggtgctgggtgcgaatggcacctacagctgcctggtgcgcaaccccgtgctgcagcaggatgcgcacggctctgtcaccatcacagggcagcctatgacattccccccagaggccctgtgggtgaccgtggggctgtctgtctgtctcattgcactgctggtggccctggctttcgtgtgctggagaaagatcaaacagagctgtgaggaggagaatgcaggtgagtgtgtgtgtatgtgtgtgcgtgcgcatgcacacttatgtgtcttggggtatgttgctgtctttgatgtcaatagagtgtcactttctagtgacagaacgagtgtgtgtgtgcagatggggctggatttgtctgtgtgtgaccttgagtctacgtcttgtgtgtgtgaacaagcgtgagcctgtctgtccatgtgcagataccacaggatga

SEQ ID NO: 36456 - DNA, 295 bp, Homo sapiens
agatgcctctaaaagccgcatgtacaaaggaagcccacgtctatcctgtctgtttatatttgcttttcctgttttgtaacctctttgtactttgttcatggtgacttgtaagctaaggggaaggggtgcctagatgcctttgtatctctccatgtcacgcgctcctgggccagccggcctcccttcctctccttgtatgtaatacctttttttcccctttctagcaagtactttcaaaagaactctgtacattttaacataaaaaataaattatgttgagccattttggatgtct

SEQ ID NO: 36457 - DNA, 1496 bp, Homo sapiens
gccatgtcactggctcaggctcagctgctgggtcaccaggagaatggacgcttcctccacctcagctcagagcacagtgatgattcgtgactttcccaatagaacttcaaatctctgaagacggggggtggggggatgtgcttgagtgtttgtactcatggtcttattctcggagtgacaaagctggaacacaatacctctatgcatgaaaaggttgtcacttgtcacaactaacaggctttcacctcatggaaatttttttaccttgtgtacttttcccctggcagtggacatggctgcactcttccaagaagcaagcagctgtcccgtctgctcagactatctggaaaaaccaatgtccctggagtgtggatgcgccgtctgcctcaagtgcattaattcactgcagaaggagccccatggggaggatctgctttgctgttactcttccatggtctctcggaagaacaaaatcaggcgcaatcggcagctagagaggctggcttcccacatcaaggaactggagcccaagctgaagaagattctgcagatgaacccaaggatgcggaagttccaagtggatatgaccttggatgccaacacagccaacaacttcctcctcatttctgacgacctcaggagcgtccgaagtgggcgcatcagacagaatcggcaagaccttgccgagagatttgacgtgtccgtttgcatcctgggctcccctcgctttacctgtggccgccactgctgggaggtggacgtgggaacaagcacagaatgggacctgggagtctgcagagaatctgttcaccgcaaagggaggatccagctgaccacagagcttggattctggactgtgagtttgagggatggaggccgcctctctgccagcaccgtgccgctgactttcctcttcgtagaccgcaagttacagcgagtggggatttttctggatatgggcatgcagaacgtttccttttttgatgctgaaggtggttcccatgtctatacattcaggagcgtatctgctgaggagccactgtgcccatttttggctccttcaattccacctaatggtgatcaaggtgtcttgagcatctgtcctttgatgaactcaggcactactgatgctccagtccgtcctggggaggccaaataagccctcactccaaaaaaacaaaaaacagggtaagaaaattacttgggtgggtagacttaggaacgctctacttcgtaaaagcattatacaaagtcacgggagaaaaatatgggacatttcttgattatacttaatctaatttgattagattatagagtcctaagtattaattattgccaccatcaaactcattgagtcctatggttcacatcttgtttcctatagaaatgtcctgtattctgggatcaatttccaaatgctttacttttttatttctgcaagttcaaattaatgtattatagaagttatgagttaaataaagattggaatatcaaaa

SEQ ID NO: 36458 - DNA, 1394 bp, Homo sapiens
gccctgagaaggagctacatgccacgggctggaggctagagcctgtggcaccatgatttgcctccgatggaggtggctgaattaggcttcccagagactgcagtgtcccaatccaggatctgtctatgtgctgtattgtgtggccactgggactttgcagacatgatggtgataaggagcctgagtggacatggctgcactcttccaagaagcaagcagctgtcccgtctgctcagactatctggaaaaaccaatgtccctggagtgtggatgcgccgtctgcctcaagtgcattaattcactgcagaaggagccccatggggaggatctgctttgctgttactcttccatggtctctcggaagaacaaaatcaggcgcaatcggcagctagagaggctggcttcccacatcaaggaactggagcccaagctgaagaagattctgcagatgaacccaaggatgcggaagttccaagtggatatgaccttggatgccaacacagccaacaacttcctcctcatttctgacgacctcaggagcgtccgaagtgggcgcatcagacagaatcggcaagaccttgccgagagatttgacgtgtccgtttgcatcctgggctcccctcgctttacctgtggccgccactgctgggaggtggacgtgggaacaagcacagaatgggacctgggagtctgcagagaatctgttcaccgcaaagggaggatccagctgaccacagagcttggattctggactgtgagtttgagggatggaggccgcctctctgccagcaccgtgccgctgactttcctcttcgtagaccgcaagttacagcgagtggggatttttctggatatgggcatgcagaacgtttccttttttgatgctgaaggtggttcccatgtctatacattcaggagcgtatctgctgaggagccactgtgcccatttttggctccttcaattccacctaatggtgatcaaggtgtcttgagcatctgtcctttgatgaactcaggcactactgatgctccagtccgtcctggggaggccaaataagccctcactccaaaaaaacaaaaaacagggtaagaaaattacttgggtgggtagacttaggaacgctctacttcgtaaaagcattatacaaagtcacgggagaaaaatatgggacatttcttgattatacttaatctaatttgattagattatagagtcctaagtattaattattgccaccatcaaactcattgagtcctatggttcacatcttgtttcctatagaaatgtcctgtattctgggatcaatttccaaatgctttacttttttatttctgcaagttcaaattaatgtattatagaagttatgagttaaataaagattggaatatcaaaa

SEQ ID NO: 36459 - DNA, 1346 bp, Homo sapiens
gccctgagaaggagctacatgccacgggctggaggctagagcctgtggcaccatgatttgcctccgatggaggtggctgaattaggcttcccagagactgcagtgtcccaatccaggatctgtctatgtgctgtattgtgtggccactgggactttgcagacatgatggtgataaggagcctgagtggacatggctgcactcttccaagaagcaagcagctgtcccgtctgctcagactatctggaaaaaccaatgtccctggagtgtggatgcgccgtctgcctcaagtgcattaattcactgcagaaggagccccatggggaggatctgctttgctgttactcttccatggtctctcggaagaacaaaatcaggcgcaatcggcagctagagaggctggcttcccacatcaaggaactggagcccaagctgaagaagattctgcagatgaacccaaggatgcggaagttccaagtggatatgaccttggatgccaacacagccaacaacttcctcctcatttctgacgacctcaggagcgtccgaagtgggcgcatcagacagaatcggcaagaccttgccgagagatttgacgtgtccgtttgcatcctgggctcccctcgctttacctgtggccgccactgctgggaggtggacgtgggaacaagcacagaatgggacctgggagtctgcagagaatctgttcaccgcaaagggaggatccagctgaccacagagcttggattctggactgtgagtttgagggatggaggccgcctctctgccagcaccgtgccgctgactttcctcttcgtagaccgcaagttacagcgagtggggatttttctggatatgggcatgcagaacgtttccttttttgatgctgaaggtggttcccatgtctatacattcaggagcgtatctgctgaggagccactgtgcccatttttggctccttcaattccacctaatggtgatcaaggtgtcttgagcatctgtcctttgatgaactcaggcactactgatgctccagtccgtcctggggaggccaaataagccctcactccaaaaaaacaaaaaacagggtaagaaaattacttgggtgggtagacttaggaacgctctacttcgtaaaagcattatacaaagtcacgggagaaaaatatgggacatttcttgattatacttaatctaatttgattagattatagagtcacatcttgtttcctatagaaatgtcctgtattctgggatcaatttccaaatgctttacttttttatttctgcaagttcaaattaatgtattatagaagttatgagttaaataaagattggaatatcaaaa

SEQ ID NO: 36460 - DNA, 397 bp, Homo sapiens
gattaatgaaactctgcaatagtggatttcttaagagaaggaactaaaggaagtgagacagttcgttagatgatacttacttacattaaagtaattcccaccaaaaggtaaaacttctgcagtcaagggggaaaaaatgacagctccatctgagatgtataggataacctgtgaaaagaaatgagaaaggattggctatattggagtttatatttttaaaattgtcaattccaggattagataccaagccaaatttgagcatttgtttcccagaaggtgagggcaaaccactgagatctttatttcctttgcagtctgtcccctggggatggtaacagacttgactaatctgcagtctcagaaacgccctgacatcatggaatgtcttggccttatt

SEQ ID NO: 36461 - DNA, 486 bp, Homo sapiens
ttccataatacttgatggagaaagaaatgagcaaaccaaactgggatccttccaatgagcctggggccctttgtgatatagcttctgttaagagaaccgggaagaggggagagagtcactcgaatcctggcattttcactcagtggggcctcctctaccccaacctgaggttttctcctgataaaatctgcttatgaagaatgctaagggtggctatagctcccagggtgaatcctgcaagtgctttggctggcttattaccctcaggttacagtatattatgctttttaagtataacataatgagggctcatacagtgagacaaccccacccagattgtaatcaatgtctgagaatgcatttatttagcacttttgctcctgctcaatatgcatgcaaagatttcaactttccaggaaacctttctcaagctgttctcttttccagcttttgtcttctgtctcccctttcattctccctcatcac

SEQ ID NO: 36462 - DNA, 398 bp, Homo sapiens
ttggcgggtactcagtaaatgatagttgaacaatgaatgaaagaggatggaatctgaagccagacagatcagaatttaccactgtgtgacctcaggcaacttgcttaattaacagttttaaaatttgtaaattggaatagcattacttacttacaagagtgtttttaggattaagttaatgaatggaggggcctgataagtgatgttcctttggattctgattcagtaacataacaaagattggaacatagaatcacagaattacaaagcaactaagagaaaactagcctaatttctgcctggctaagtcctaatcctttggatctcagtttaaaaattatttcttccaagaagtttttcttatctacttcctgtctccattgtcccctgagtaggtt

SEQ ID NO: 36463 - DNA, 142 bp, Homo sapiens
ataataaaataaataaaataaaataaacgttggcttatttcagtgtgaagtaaggcaataaacggagggctaacagttcccttcgtagagctcagacattttaagaagcgaggaggccgcgtcctggaaaccgtgagcaaaa

SEQ ID NO: 36464 - DNA, 559 bp, Homo sapiens
gaataccccatctgtaactctgttctaggtgatgtggtatcagtaccagaatgttgtactgtttctgaaaattattttcagtatagcagttaaggacattaaggcttcaaagccattggtccagttttgataagaaatgaagttggaagttgggtgtagtggctcacacctttaatttcagcactttgggaagggccaaggtaggagaattgcattagcccaggagtttgaaaccagcctgggcaacacagggagacccccatcttctagaaaaataaaaaataaaaacaattagctggggcatggtggcatgtgccctatagtccccaactaagtagttctctgctaagcccgggaagtcaaggctgcagtgagccatgattgcaccactgtgttctagcctggaagacaaagtgagaccctgtctcaaaaaaagtaaaagtaaaaataataataataataataataaagctggaaatcaaggatatattttcatcatctcttcacttgacaccaagacaagtcacaaacctgaagagtattgcctatttattcctat

SEQ ID NO: 36465 - DNA, 264 bp, Homo sapiens
ggttaccgagcccgatcagcagagactctctttagactagattgcattctcaggattctcttacttcgtatctttcaactatccttgttttctatttatatttcagttccagtatcacatttatagccagtaagagatctcatagatcatagagctaaaggtaaaacaatgtaatgtatgtagccatggaagaacctgttcacacctgttcacagagttaccaaacccgtatccaacgttctctctatgaccaggctaaatagg

SEQ ID NO: 36466 - DNA, 474 bp, Homo sapiens
aataaaattaaaatgcatataaatcatcttataaaccaaattcttacagaatatgatagtgtaacatagtttcaaagttaacctctgagacattcattaacaaccagttctagagctgttagtgtctagagctcaagccttctggccacatctgccctcattttcttattgttctgccttctgaaacacttgtccggatcactgactactttttgtagcaccacttccaaattaggcagtgctctggaagggaagctacttcaaacaataaaattgataaatggccagagtctgctattttggtccttattttcattttctccactcagcaactgtccctttcatggttacacttttatttgaaatttgactttgtactacaagtggagatagaaaagcagttgataacttgcaatagataacacctctgaaatcaggaggttaccaaatattaaaaggactttgacttgatta

SEQ ID NO: 36467 - DNA, 234 bp, Homo sapiens
ggaatggcatgggtatgactgaaaagaggcaaaaggaaactttcaatatcccgatccaggtagccattttataggtatatacacatataaaaataaattgtttaattgaacccttaaaatgaatgaattttatggcattcaaattatacttcaataaactgttactgaaactccagctctacatttaagatatgtgcacgtcaggaagtttctgattatatgcattagctcaat

SEQ ID NO: 36468 - DNA, 1259 bp, Homo sapiens
agggaagtgcctgtttatcagctgatacaagatcatctcactgttttacccaccagcatagctaaaattgtgtatctggatgaatgtcaaacacacctttgtcaagagacttggagagagggatgggcgaggtgttgggggacacaggggtgctctagaccctgtgagcactgactctgcccctctctcctcttagctggctccagtgcccagacccaagccccccactgctcaatggacacccccagcccagacccgttgccttcgcctttgcccggggaggaagagaaacctctggccttatctcctcctgttccccggggccgccgaggccgtcgtcctgggggagccacctcctcaaatcggacactcaaggcctccctccctcgcaagcggggccgcccccccaagtcagggcaggagcccccactggtgcaggtgcagggggtgacagccccagtaggcagcagtggcgggagcgacctcctcctgatcgatgatcagggtgtgccctatacggtctctgaaggttcagcggctgggcctgagggctctggccccaggaaggccccacacttctgcccggtgtgcctgcgggccttcccctacctctccgacctggagcgccacagcatctcgcactcagagctgaagccgcaccagtgcaaggtttgcggcaagaccttcaagcgctccagccacctgcggcggcactgcaacatccatgccggcctgcggcccttccgctgcccgctgtgcccccgccgcttccgcgaggcgggcgagctggcgcaccaccaccgcgtgcactcgggggagcgcccgtaccagtgccccatctgccggctgcgctttacagaggccaacacgctccggcgccatgcgaagcgcaagcacccggaggccatgggggtacccctgtgtgcaccagatccagggtctgaaccgccgtgggacgaggagggcatcccggccacagcaggggccgaggaagaggaggagacagaggggaaaggggagccggcctgacccacacccccggccatcgctccctgggccaggtttagagcagggagtttggctggtgctgggcctgagccagggggccgggacacccttgtttccggtggtcttcccgttgtgggagcaggtggagggtggagacctaaactttggggtccagctgccttcagcccccctcccccagactaacagacccttggaggcaggggctgtggaaataaatctctgcctgctgg

SEQ ID NO: 36469 - DNA, 1125 bp, Homo sapiens
gcgccggccccgttgcccccgcgcgcgcgcacactcgcgagccccggcgacatgcaaatgagctggctccagtgcccagacccaagccccccactgctcaatggacacccccagcccagacccgttgccttcgcctttgcccggggaggaagagaaacctctggccttatctcctcctgttccccggggccgccgaggccgtcgtcctgggggagccacctcctcaaatcggacactcaaggcctccctccctcgcaagcggggccgcccccccaagtcagggcaggagcccccactggtgcaggtgcagggggtgacagccccagtaggcagcagtggcgggagcgacctcctcctgatcgatgatcagggtgtgccctatacggtctctgaaggttcagcggctgggcctgagggctctggccccaggaaggccccacacttctgcccggtgtgcctgcgggccttcccctacctctccgacctggagcgccacagcatctcgcactcagagctgaagccgcaccagtgcaaggtttgcggcaagaccttcaagcgctccagccacctgcggcggcactgcaacatccatgccggcctgcggcccttccgctgcccgctgtgcccccgccgcttccgcgaggcgggcgagctggcgcaccaccaccgcgtgcactcgggggagcgcccgtaccagtgccccatctgccggctgcgctttacagaggccaacacgctccggcgccatgcgaagcgcaagcacccggaggccatgggggtacccctgtgtgcaccagatccagggtctgaaccgccgtgggacgaggagggcatcccggccacagcaggggccgaggaagaggaggagacagaggggaaaggggagccggcctgacccacacccccggccatcgctccctgggccaggtttagagcagggagtttggctggtgctgggcctgagccagggggccgggacacccttgtttccggtggtcttcccgttgtgggagcaggtggagggtggagacctaaactttggggtccagctgccttcagcccccctcccccagactaacagacccttggaggcaggggctgtggaaataaatctctgcctgctgg

SEQ ID NO: 36470 - DNA, 439 bp, Homo sapiens
ggagatacatagtaactatttgttgaataaatatctgagtgcaaaattctgcatttaagtaagatgttccctcagtgacttataaaaacccatggttcttttaaaaatccatgtccagcattgtaagaaagtagctaagcttgggtaaattatgatgaaagctctgctgtccttatagcactcagatttactttgaaagggaattgatatcagcgactgggaactgtaaattatctactaattttaggtcattagttgttcttcttgtggaatattaaacaattcccaactaacattttttttaatgttgttctaaaatatatgcctctgcctagccaagtcatttggcggtctttccgtcctgcaaagctgatccatcatctttccagtttaagaaagattttagctgaaaacatgtttagtgtcagtaactcctaaa

SEQ ID NO: 36471 - DNA, 472 bp, Homo sapiens
ggagatacatagtaactatttgttgaataaatatctgagtgcaaaattctgcatttaagtaagatgttccctcagtgacttataaaaacccatggttcttttaaaaatccatgtccagcattgtaagaaagtagctaagcttgggtaaattatgatgaaagctctgctgtccttatagcactcagatttactttgaaagggaattgatatcagcgactgggaactgtaaattatctactaattttaggtcattagttgttcttcttgtggaatattaaacaattcccaactaacattttttttaggagttactgacacttaacatgtttccagctaaaatctttcttaaactggaaagatgatggatcagctttgcaggacggaaagaccgccaaatgacttggctaggcagaggcatatattttagaacaacattaaaaaaaatgttagttgggaattgtctaatattcca

SEQ ID NO: 36472 - DNA, 1263 bp, Homo sapiens
attgcgagacccaatgcatgtatagaggttgtcataaagccaggcttgttaacatgaacatggtacctaaaactttgaccaaacaaaattgtcatttgtagtgaactttttcaaaaaccagaatatggcatttttaagttttgaaaatatattatcatagtcttttgtaaaatatggctttcataatttaggccatacctataatataggtataaaacttctagcaggccttttgtaagcattgatagtagcaacacgtacttcattttcaattcaaaaaggcctataaagttgcttaacaaagcaaacatttcattgatttaaaaactttttattgagcatctagtgtatgtgaagtgcgagctgtacactcctaggttgtggtatacggtagttaatagtccctggcctcacagggtttacgtcctgggggagggatagaatacatttagtaaataaataaatagatgataatttctcctagtgatacgtactatgaagaaaattaaatgtgtgtgtgtgtgtgtgtgtgtgtgtgtgtgtgtagggtggtagcagtaagggatgctgctttagttagagtgatcttggaaggcttatctgaggaggtggtattacaactaagtactcaagaggagttagcagccacacattgcctggaatgataacaaacctgtttctagcagaactagggcaaaggactggagagtagaaacagtgtaatgtgtttgacagcagaaagaaagctggtatggctggagcagagtgagtgagaaaagtgaagctgagaaatgggttcaagatattggcagaggcctggtcatgtaggacttcgtagacaatttagagtttgaattttatttgaatctttgtatcattagaagtattaagaagtgatatgggtcatgtcattaatgcttagcactttgagaagctctccatttgttgctttgtggagaactgcctgttggggaacagcaggagcagaagcagacaggaaaccaattaagaggtaattgcaggccaggcatgatggcttttgcctgtaatcccagcgctttgggtggcccaggtggtcagatcactcgaggtcaggaggtggagaccagcctcgccaacatgatgaaacgccgtctcttctaagaatacaagaaaattagccggtgtggtggcatgtgcctgtaatcccagcaacttgggagcttgggaggccaaggcaggagaattagttgaacccaggaggtggaggttgcaataagccaa

SEQ ID NO: 36473 - DNA, 295 bp, Homo sapiens
gccccgcgcacactggtagtcagcgcacaggacagtctcgtcgttcgagaagcgattcctcgggatacatccagagctttaaaacgatcagacccttcgaccaataatccgactggtaaacatctaaactgaggacatcattttcaatcagagaaagctctgtgcctttctcatgtaactcaaggtggttttgagggagcaaaagattggcaccaacttacacttccagaagagagtggttcaggaaattactatgcttaatagaatattaaactttagaaaaatgaattttatg

SEQ ID NO: 36474 - DNA, 1242 bp, Homo sapiens
atccaaaagttgtcttaccggtgataaaccatgaccatattaacatgtttgggcagcattaaaagatctatggcaacatcaatgtttctctttgagccgactctcagagcagtcatcttttgatttgtcctaactcccacatgatgcagaagagaggctttgccttctgttttctgttcctgcctcacatttctgccccatcccttctttttcatcattgtcggcaatgcttctgcagccgtcctcagttgggactctccacactgggggagccgagaaccctgaagaggctacaaaggggtcataatttaaaattaagtaggagttcccagaatggtgcgaacttgatttgaaccaaataaaccaataataatagctgaaggaggaaggaggaggcaagcacagatgttatcacaggtcttaaaacagtcctaaaggactcttaaccatgtgctgctccatgtgtcatggccctgatgcttccattgaggagcttgttctggtttactgaattttcgttgtcagtctaccgaagctttttctttgtgctcacttggttgttgagcggctgaatcctaaaaggtacatgtactgtacttatcagtatgcagtgattttataaatttgctaatttcagcattctctatgttttgaaaataatattgcttattgaagcaatcatgcttatcaaagacacacatacctggagttaaggtacacgtgccatttgccattagcaaattttttgataggtgcaacactctctaaaactcttgacagattattttactttattttatttttttattttttatttgttttgacacagagtctcactctgtcacccaggctggagtacaatggtgcaaacttggctcactgcagacctccacttcccgggctcaggcgattcttatgcctcagcctcctgagtagctgggattacaggtgtgcaccaccacacccagctaatttttgtgtttctggtagagactgggtttcgctatgttggccaggctggtctcaaactcctggcttcaagtgatccacccgccttgacctcctaacgtgctgggattacaggcgtgagctatcatgctcagccgacagattattttaaattataagtgctaattagtattttgggggaaaatttttatttataaaatgtcaagattatactttagagaatgtttataaaatcataaagaaattatgctgtttttttttcttaaaaaaaaa

SEQ ID NO: 36475 - DNA, 254 bp, Homo sapiens
gctattatattcattttattcatgcccaggacgtgagtcccgatttaagcctttgtccatttgggtaataagaaatcctttatgtgggattacaggcgtgagctatcatgctcagccgacagattattttaaattataagtgctaattagtattttgggggaaaatttttatttataaaatgtcaagattatactttagagaatgtttataaaatcataaagaaattatgctgtttttttttcttaaaaaaaaa

SEQ ID NO: 36476 - DNA, 149 bp, Homo sapiens
tacaatttttaaattttacctgctgaaattttatctccttgtactgagtaagaaaaactattttaaaattctcatgattccaatatttgaaactcctgtggatattattttattatgttgtatctgctggattgttgttttgtttgttt

SEQ ID NO: 36477 - DNA, 409 bp, Homo sapiens
ctttttatttatctctgaattttctttcagtaagtatgacgtcatacttatgatgcatcattttatctgcccaatacactctctcctttgaggtctatcacattcttctggaaaaataaacaaaccaaaaaccttatgcatggatgcatttatttgtctctttgcccctacaccaaagctgctgaatatttagaagattttaaaaccaggcagactagtatcactttattggtctccaattttgaaagaaatgtatattctgaccaggcatctaatgttttcctattcaagtttctcctattctctatagttcttatttcaaacttttctcatgctcttcaaatatcccaaactattcccaaatattccaacataattgacagttaaccctaactcctcctttggagag

SEQ ID NO: 36478 - DNA, 427 bp, Homo sapiens
gatcacacgccactgcactccagcctgggtgacacagtgagactctgtctcaaaaaaaaaaaaaaaggtggttattagttttggggtggtagtcacaaaacacataaccaaaacaatgtgtacttagaaaatctaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaa

SEQ ID NO: 36479 - DNA, 473 bp, Homo sapiens
tagcataataattgtcttctaagcctgcactataaagtatttcagtggcctcattattaaaggaccaaggtgcccaaagaaacaaaatttagtaatcataaacaagagacaaacctacttcttttcccccagagttctggccacattgaaataaggtgtttgaatgcttaataagaattattttggcccacacagtggctcatgcctgtaatctcagcactttgggatgccaaggtgagcagatcacttgaggccaggagttcaagaccagcgtggccaacgtggtgaaaccccatctctactaaaaatacaaaaattagcccggtgtggtggtacacgcctatagtcccagctactcgggagactgaggtgggagaatcacttgaacccgggaggccaaggctgcaatatcgagatcacaccactgcactctagcctgggcaacagagtgagagtgagactctttctcggaa

SEQ ID NO: 36480 - DNA, 398 bp, Homo sapiens
gtctcactatgttgttcaggctggtctcaagcttcctggctcaagcaatcctccaaccttggcctcccaaagtgctgggattacaggcattagccactttaataatgctgctatgtggggctttctttctagtcctcagtaggaaaatttctagaaagtgttatattattgccttttactcttatcatgttatataatttgttcaacagtcacagtgtttattagctgctctcctttaaccacaacagatgttacatattgtaccttatcctgcactttaggtctttcttcttaaaaacaaatatgttatttagaaaaatatcaaataataagcattatgtgtaaggccataaaaagcaaaagagcttagccttggtgacagtgtgagacccagtctt

SEQ ID NO: 36481 - DNA, 824 bp, Homo sapiens
gagcaaggggtagaatggcatctaaccagagcaaagccatttctttgagggctcaagccataaacaaatatgctcccctaaacatattcggcttgaaaaagttgttttggggcagctgtggtggtgcacccctgtaatcccagccctttgggagtcagaggcagtcagtcacttgagcccaggagttcaagactagcctgggcaacacggcgaaacctcgtctctacaaaaaatacaaaaattaaccaagcgtggtagtgcacgcctgtattcccagctacttgggaggctgaggtaggaggatggcttgagcctgggaggcagaggttgcagttgagctgagatcgcgccactgcactccagccggggtgacagagccagaccctgtctcaaagcatatttcaaccctaaaactagactcttctgcccacagtgcagtcttctaagggttaccctctggtatatgttcttttgctaaatgaaggcttggagttggagggaagaaggggagatggagtggtgagggcgagtcaaataaaaggatttgagtgtctcgtttttgactaatgaagatgattcaataaacatcctgtaagaagggttcctatgtgcaagttgaggtgctactaagtacattaagacacaattgctgctctcaaggagttagcagctggtctcatgcagggatctcaccacgtggttatgtattttgtttctgatgaggtgcctttcttagcagatgctgccttatttggccactgaaacaatcaaagctaataaatgcttaaagaaaaatatctgacaataaaaaggtttaaatcaaa

SEQ ID NO: 36482 - DNA, 384 bp, Homo sapiens
gcatgtttctctttttttctgaaaaacagaagttagatactgtcactgacatttacatactgatattttaagccaaataaattctaagaaaaaccacaaggctccccaagtctctgagagccaccctgggattttctccaaggacaatgtccccccaccatgatgtgtggagtccctgtgaaggcagaggctccatcgccctacccaggtgcgtgttttcagagtcgtttctgccaggagcgcttggctggtctgctctcaccttcatcatgggtctgtgtctgcagctgaaacagtcactccaggacccacggacaggagtaaatagattagatgttccgctccccgttggcctcttgtgcccaggctggctcactggtttgc

SEQ ID NO: 36483 - DNA, 300 bp, Homo sapiens
ggggagtattttttttatatcattctctgttttgtgctttgttttcttttgcttctttgtgcctgacaaaagtacagacagaatacactaaagataaatgaaggctcccagatgctggcacggtctttaagaaaagttcacattatcttccaacgagtccaattcatctgctctcttttgaaattattcctagaaatgttgtcttcatgaaggaacgaagtcactacagcaacaaaaccatctgatgtgttatgaacatttcagggctgtgtctcagtgggaatatttctaaatacgaca

SEQ ID NO: 36484 - DNA, 2986 bp, Homo sapiens
  misc_feature (759)..(759): n is a, c, g, or t
  misc_feature (2313)..(2313): n is a, c, g, or t
  misc_feature (2546)..(2546): n is a, c, g, or t
  misc_feature (2563)..(2563): n is a, c, g, or t
taagctcagctgccaggattccccacccccagccctgccccatccattccattactattgagttacagtggcacgtggaacagagaaatgaggagctggaatgtgaacagccacagggcttagggaggagagaggacttttcacagacagctttttttttaatgagatggagtctcactgtgtcgcccaggctggagtacagtggcgtgagctggctcactgcaacctctgcctcctggtttcaaatgattctcctgcctcaggctcccaagtagctgggattacaggtactcaccaccatgcccagctaattttttgtatttttagtcgacacggggtttcaccatgttggccaggctggtctcaactcctggcctcaagtgatccacccgcctgggcctcccaaagtgttgggattacaggcgtgagccactgcgcccagccttcagagacagtttcctaacctgaatctttttcatagggcttgaaggctcttatgccaaagaaaacaataaacaactctttaaacaaaaatccaccaacaggatttctccaccagtcaaagaaatagcagcaaagttatacaacagagcgaccacctttgacattttatttttgtggagaaagggcatttgagaacttcattttttgaagtatatttaaaaagtgatgtcctgaggaatttattcagttttttcttttctcttttctcatgttattttcttagccctatgaaatagggttgggctgacgtttccncgttactggaaggcaagtgaactctgcagttaagggtttcttctctgacaatcaccactacagcctccataggctgcacccccgttccagggatacggtcaaagggcacctcgtcctgccttcttgtcttgctgattagtaaatctgacttgcatttcacaacatttaagaaaagaaagttttttttttaagtataaacatttctttttaattgtaaaaagaagttacaagtccatgatgtttcaatgctctaggataattttgaaaacacaggccacatagcatccacccagcttccatgagaccctgacctgcggccgagcaatcccgcagcccctccgtcctcagcggcatgctcgcttggtttctgtcaaatttcggcttcaaaggtgcaccacgggaatctctgccactgcaccaaaacgggcttctgcactcgcatttcggttctatacctgtctcattttcattccacttttaactccgtagctttttacagatcgtgcttctccctcaaatcaatttaatttgcaagtctttaaaacagaacttgtttaacaaacattaaatgattacctcattcattcccatcttgcccaattatgaacattcgtgcagtccttggctactgcccagaaagagctcctgctggcagagctgcccctcccgccagcgggcggaggcctcaccccagcccaggaatcctttggcaatgaacctaattcctcttccgttctttcccatcccatatgctctgacctctaacgctgcctaccccaaagcagcaggaagagaaatgccaggtgccttcctagacaacctgatccctcttttgtctctggcatcccaggaagccaaacccctgaaagagcagccgagcacgggcttcacggagagcaagtctgcacgcaggaagcaagcgtcgcggcagggaccctcagagcccacgtgcatgccagcttcctgccatcaggctttctggggtgctccctgaagtctagggaaggaccaagagaatcccgcaggtgaggaatacagccctgattgcaacttttcgttctggttcatctgggggtggcccagctaagaggagtcctgcagggagggcatggggcccgcttacctgctcaccccgggagggcgtggggccagcttacctgttcaccccgggagggtgtggggctgacttacctcccaaccccagaggccaccctcgcacacgcacacactcccctggggccttcctgggcatctttccacatccgatcaacggatgttcatggaattcatgggaataaatgggggtactttcttttactcaaggacttcaacttcatcagggtttctcgagaatctaagcagccaccctggcaggaggctcgatgtgccccttggctcaggcaggagactcagagggatacgctgcctccaggggcagggacagtggggggtggggttcaggattccaggcaggaccctggaacactggtcgcagattgaaatatgaggaacaaaagcagccattgttaagatgcctatcacatacccacggangcactgagtgtcttctgggaattcctgttgaaccccaccaaagtcccaggtgtcaaggtcacccagccagcagccagtcacacgcaggtgtgtgtggtcccaactcccgggatctcagacactcccttcctactgatggaacatggatgtgtactcagaactcagagaacagaacctgatcgcaggggatctttccaggctgggaacttcactgtcacttttcacagtgagtntaagcaaaagcccattntgagtcctaaagtcaaacctcctgagctccagcagcctgtgagtggtgtctgcacacacagccccgaaggaccctgctcaaaaatgccacggtcgggcctgcaggaaggggagcttattcggaatttctctattcgacttcaaggcagctttaagcagaatctgctgtggatgagcatccactttaaaacacgattaggcattttcaagatgccacctcaaatacggcaactctgcattctcacaagaaccaaggacttttgggtggtgcggccttgtctcctggtgaacactagagggtgcattaggcctaagaatccctcctcccttctgtgttaggattaaacagagctctggctttgaaggtttcaggagtgagagcgaccacgtacgctttaaaaaaaaaaaaaaaaaaaaaaaaaaa

SEQ ID NO: 36485 - DNA, 420 bp, Homo sapiens
tcagcctcctgagtagctgggactacaggcgcgtgccaccatgcctggctaatttttgtatttttagtagagacaaggtttcaccatgttggccaggctggtcttgaaatcctgacctcaggtgacctgcctgcctcggcctcctaaagtgctgggattacaggggtgagccactgcggccagcccctgccagtttttctaagagctgaggacacagagttgaataagacatcatccttgccctgcaagaggtcacaatctgggagtggacagtgataggaaaaactatggtcatttgccatcataatagctaatacttattgaagtcatccaaaatgggagacatggtcctcagtgcttgacatggatcatctaattttaaccttcacaataaccctattaggtgggtgttattatcct

SEQ ID NO: 36486 - DNA, 939 bp, Homo sapiens
ggaccaagttagaaccggagtcctatttggatgatatggtgacttgcagccagatcgtatacaattataatcctgaaaagaccaaaaaggattctggatggagaacagccatttgcccagattattgtcctaacatgtatgaagaaatggaaacattagccagtgtacttcagtcagatattggtcaagacatgcgtgttcataacagcacatttctatggttcatcccttttgtccagtccctcatggatcttaaggatttgggtgtggcttacatagcacaggttgttaatcatctgtactctgaagtcaaagaagtcctcaaccaaacagatgctgtgtgtgacaaagtcactgaattttttcttctaattttggtatcagtgattgaactgcatagaaataaaaaatgtttgcatttgctgtgggtaagttcccagcaatgggtggaagccgtcgtcaaatgtgccaagcttcctaccactgcgtttacacggagttctgagaaatcatctggaaattgctccaaaggaacagcaatgatatcttcactgtcattgcattccatgccatctaactctgtacaacttgcttatgtgcagctgattagaagtctccttaaagaaggttatcagcttgggcagcagtctctttgcaagcgattctgggataagctcaacttattccttagaggaaatttatctctaggttggcagttgactagtcaggaaacccatgagctacaaagttgcttaaagcaaattattagaaacataaaattcaaagcacctccatgtaacacttttgtggatctgacttctgcatgtaaaatctctcctgcatcttataataaagaagaaagtgaacaaatggggaagacgtctagaaaagatatgcattgtttggaagcttccagcccaacattttctaaagaaccaa

SEQ ID NO: 36487 - DNA, 443 bp, Homo sapiens
ctcttagttcagttctcatagtttttggtttgctgtttaggttgagatccatgccatgttcagctctgggatgaagccaggagtttataatcaactttatggattcactttgctgtgagttcctccctctcagcaatttcctttatactttctgctgccgacctcttttcagtccttgagaggaaaagctgggtctttttctactctgctcacttcctgtgattgcacccacatccagggctaagtggtaggagtacagagaggaaaaaaaagttgatggagagaggttgcctactctcttgaaacaacagcttctgggatagtggaggaatgtttccctccctcagagttttaggtacctgtgggcgcctaactgttaactgccaggatccttttcccagtttcttaagcctgaactggagggcttctcctggatctctgca

SEQ ID NO: 36488 - DNA, 457 bp, Homo sapiens
aaaacccgacagtctctgcaagcctgagattgactgttagaggtgtcccacgttgggcatgaatggccttgctcagctactgatggaggctgccctgagaatagcatgaccttggctgaaagctgagatgaaccctgaggggctaacagctggaggctgtcagctaactgtatttcccacttcatagccaatcgcagggagatctgagtagcacatcttcttgtctgccacatacggtaaataatttttagtcaattagttttaatttcaccaaaattgtgccagactagaatatcataaagaattatttactgaactgaagcagacagtatcagtgctcattggctggtccaatgtctcccctactcctcctcaccagggaactgcctcaatcaatgaccaatagaagttgggtaggccaggcatggtggcctttttgaagccacccaggtgggca

SEQ ID NO: 36489 - DNA, 424 bp, Homo sapiens
aagctgatccttcaagtgccacacgatgggtggctctgatactcgcaggctgggcctcccagcatccacggagcctggaaaacggccccaaagaggcaagctgcttttctctcacggtcagtgccatcgtgctttaatcccttcatgactgccgctggcaaggaaaccacataaaccagcttgctagaggcggcgggggtggggaggggtgtagggccctctcgaggtcttcccggctcgtggggagaagtgcaggtgagcagcttcctcaagccttgccctgctcttgccgtgaagcgctgactctcgcctgtcattccagggctgacagctcagagccttgcgatcccagaaggtgtcaccagaggcctagtgtgctgcctcgtgcaacatggagggccttgttttctgggcctgcgaggga

SEQ ID NO: 36490 - DNA, 569 bp, Homo sapiens
tctattattaagaaaatctagacctgaaatgttttctcaactcttattgtactgtgtatatttatattgttgtcgtggcggctgtttttaaagggaaagtgttggttctattaatttgttaagtgtccatccaggtgggcctacctgattccacatatataagtacatatctgcttataaagcgctgtaaatggcagcaaggctgtttttggagaagagtttgggttttcctaccatccctttgaatgctacacatccgtctattttaacccaagtagttcatatttcagatatattttctcctttcatctcctctcactactgcagagtccagtaatacctagcatagggattctgtcctgtgtcaaatggctaaaataaatttttgccccaatagacatgctgcctcattcaaaagagctgccgctgtcatcttgaggttccaggtagtgagagaagaaactcgacctgccagggtcaacagccatgaagaggtggggggagtcatgattcataaacactgaaagaagtcaaggcttttggcagagagtgttgatttagatttttag

SEQ ID NO: 36491 - DNA, 430 bp, Homo sapiens
agaatcagtaaatgttagctggtttcattattcataaaaagaacattacaatgtctatttccaatgatatatattttaaagatatttagttgcaacaatagaaaccacttatcttgctaacttaacttgccaacaatctgctaaattaccttccgtatttcctccacgtgcccattgttcatgggcaataaaaaaggaatttattggaaggacacagaagagcttcagaatcacaggaagagcagaataatgtggctttggaaaatacaggacacaggagagaggctggctaacctcagggtacatgtatacgccatagtgaggggaggcaaggatccctggctgatagtcagccagggggacaagttccctgaaagggaaattgggatgctattttagaagagaagaagaaataagtgcctggtaggaa

SEQ ID NO: 36492 - DNA, 368 bp, Homo sapiens
cttgtaggccatgtcagacctgacacaaaaaaggatcccctcagctaagtctccccattctggggaaaataagaatagaaggaccccaaaggcccttgatactgaggacattaacaatgtatgctgccaccctgccacaaccacagatttctatagcctatgccattgaggtgtctgcagttattgctaacattgaacacagctgaagaagctacacagagactgtaccactacacttacctggacagagtcattgtactcttcctaatcagcacactaagttccaactataggtgaaagtttttctctatgaaaaccactttagaaagttttcaagaggcagttgttgctccagctgcacaaacatc

SEQ ID NO: 36493 - DNA, 501 bp, Homo sapiens
tgattaatatgctttgttaaatcagtattcagaactgtttcttcatttgtaaactgagagaaaatacttaaacctgcacccctcacaaaattgaggatcagataagactatgtgacatttccttggagaagtgctttgcacatatgaggggttagtgttttgtttgctttccagtcatttgctttatgactgtcataggccgggcatgatggttcatgcctgtaatcctaacattttgggaggccgaggcgggcagatcacttgagcccaggagtttgagaccagcgtgggcaacatgctgaaaccctgtctctacagaaaaataaaaatagaaaaaaaattagcccggtgtagtggcacacacctgtagtcccagctgctctggaggctgagatgggaggattgcttgagcccagaagatggagactgtggtgagctgtgcaccactgccctccagcctgggcgacagtaagaccctgtctccaaaatggaaaaaaaaaa

SEQ ID NO: 36494 - DNA, 283 bp, Homo sapiens
gtcacccaggcagctacacggtcgatgcaggtgcacaggcgtgcgcgccattctcccgtgtcacacagcaggacggaataactgcacgcactgggagcgatggatctcgcggtccgggatccgagacgcattcagagaccaaatgtcacctcatccctcctctagccaattcgagcttcctccgcggacccccaccttccatccgaagtggctcggtccttagttgagaggactctgcccagaccctcgcaccagtagagacctctgcccgggcgcctgcaac

SEQ ID NO: 36495 - DNA, 1174 bp, Homo sapiens
gcttctttttgctccaagctattttgtataactctgggttctggtttttctatgcaacattcatgcaaccatctttattttttttctcacttatagtgtggatctttcatagttagaaatgcctcatgcttaactagctgtaagcgtacagataggaattctaaaattaaacaatgtaaggttaattccatttatccatattttgagcaggggtggtttcttagaaattttttttctattcaagagatgcatgtcagcagagtgtgggaggagcaggcaggtttcaggtatacctgtaggaaatgggaaattaaatgtcctgaatagctaggagttgttatagattggcatactgtttcccagaggattagagttcaattaaaaaaaaacaaaacttctgaccactgagaatgtcctgagaccctgtctcagaaaaaaaaaaaaaaacatcaaaaataaaaataactggtgtgactgatgaaattgatttgaaatttagtttaaatagctgcatgtgtctaatggctactgtaacagacagtgcagatttagaaatacattaacatgttgcactggaaaattttaaaattatgcatgtatttaaacgaaatgcctttaaactacttatgttagtttcagcaacttcctcaggaactgaaacagaaataaacaatgtaaaatgcttttagtgaattcttattttcctattactatttttaattttataaaaacacagaaagcattttagtgtaactatgttttctacagagaaacctggctggtgaaaccattggataatttgcaggactattttaatggctgagcagatttttgtttgtttgttttagaaaactatactaaatgggcactgagtttgaaaagatttattagaggccaggcatggtggcttatgcctataatcccagcactttgggagcatgaggcagacggatcacttgtgaccagaagtttgaggccagcctggccaacgtggtgaagccctgtctctactaaaaatacaaaattagctgggcgtggtggcacatgcctgtaatcccagctacttgggaggctgaggcaagagaattgcttgaaactggaaggtagagtttgcagtgagctgagattgtatcactgcactccagcctgggtgacagaacaagactgtctcaaa

SEQ ID NO: 36496 - DNA, 471 bp, Homo sapiens
ctttattctctctcatggttacaggagtttggggagggttaaggtaggtgcttgtggatcagagtctcatgtggttacaggccagatgatcagagggttagggtaggtctggacttgtggggcctctttgtgtctctgtctctgtttgtcttccctcctcctctccttatttcccccctgtccatagtctcagtgctcttccatgtggtccctgtgccagtataggcttcctcacactaccatgacctcaggactcccaagcacagttctgcagaaacatggtgcaagttgcatctcctttgttgcccaagcctcacttttgttggctgcttccctgtgggcttgttacgtgctggctctgttgctagacaggtcagactccctgcaaggtggggcccctcctcacacctctctctccttccccttgacccttcaggtggaagtgcagtaacatctctatccctgtggttt

SEQ ID NO: 36497 - DNA, 804 bp, Homo sapiens
cgcaatggttcatgcctgtaatcccagcactttgggaggccgaggtgggcagatcacgaggtcaggagatggagaccatcctggccaacatgatgaaacccgtcgctactaaaatacaaaaaatgagccgggcatggtggtgtgtgcctgtaatcccagctacgtgggagactgaggcaggggaattgcttgaacccaggaggcagaggttgcagtgagctgagatcgcgccactgcactccaacctagagaaagagcaagactccgtctcaaaacaaaaacaaaaacagactgcaggccagatttggtctacagatggtagtttgccaactgcacctctcatggaatgaaaatcacctgcctgacatttttattcttgttatctcattatgtctacagagcttagatgtcatacagaattgagagcaaagaacaataattccggcccggcgcggtggctcatgcctgtaatcccagcactttgggaggctgaggtgggcagatcacgagatcaggagatcgagaccatcctggctaacacggtgaaaccccatctctactaaaaatacaaaaaattagccgggcgtggtggcgggcacctgtagtcccagctacttgggaggctgaggcaggagaatggcgtgaacccaggaggcggagcttgcagtgagccgagctccagcctgggcaacagagtgagactccatctcaaaagaaaaaaaaaaaggaacaataattcccaaacctggtcactgctgcagtcacctctgttgcagaaaacgcacagttgatttcttactatat

SEQ ID NO: 36498 - DNA, 523 bp, Homo sapiens
ccctgtctccatcttataaggacccttgtatcacattgggcccatcctaataatccaggataatcccctcatttcaaagtcttaatcatatctgcaagtcccttgtaacatgtaaattaacatactgacaagttctggggttcagaatgtgaacacctttaggggacattattgagcttaccacaaaaacaatctgggaacctggaaaggggcagaatgagaagtcacaccctggctcatgtctaagaaaggagaagcaacagttaatgtgttcaattgacaacaaacattggcaacaaagccttctccaagaaaataaagccctcaaaaggagacttataaaaactctttataaggccagaagttattacttcaagcatgtttaataatgtgacacctagctgggtgtagtggcacatgcctataatcccagaactctgggaggctgaggcgggtggatcacttgaactcaggagttagagaccagcctgggcaacatggtgaaaccccatttttaccaaac

SEQ ID NO: 36499 - DNA, 495 bp, Homo sapiens
tttggacagagtccttccactgggctccaacagaccaaagcaaaccagaatagtgtcacttgtgctacctgacatgtgctcaaactgaactttaaaacgggccagttttccaaaaatcaggagatttacagcaaccaactgaaagtgaagtggtgtcattcatctggggtgatacctgaggttcactgcctcatgccaaagaaatcgaggatgcagacacacacagagtgagtttaacaggcgaaagaaagagaataggtctctctcctgcagagagggggattctcgagtaggtcttccggttccatggtgaaatgcacagggttttatagatgatcttgaggaggcagtgtctgatttacatagggcccaaaggttggttggaccaggtgtgtcatttacataacgtgcgaagaagatggctaccccaccctaatcttttattatgcagatatgtgccatattgcctgtttctttactgtacacgtggtgaca

SEQ ID NO: 36500 - DNA, 391 bp, Homo sapiens
accctcaaaccttgttacaatgtgggcatattacccatctgacatgaaaaaaatttaaaaactagacagacgcctgtagtcccagctactctggaggctgagctttgtatttttttgtagacatggggtctctctatattacccaggctggtcttgaaactctgggctcaagcgatccacccacctccacttaccaaagtgttggaattacaggcgtgagccattgcaaccagtcgagtgtttccatttctttccctgatttcaactttattccctttgagaaaggtagagcaacttttactccttacagatggagaaacttgaaggtcaaatgacatactagtagttcattcatattcattgattcaacaaatgcttctcctatgtgaca

SEQ ID NO: 36501 - DNA, 664 bp, Homo sapiens
tttccacatctttttgtttttgagacaaggtctcgctctgtcactcaggctggagtgcagtggtgcagtcttggcccactgcaacatcagcctccagagtagctgggattacaggtgtctgtctagtttttaaatttttttcatgtcagatgggtaatatgcccacattgtaacaaggtttgagggtggcacgtttcacatgttcacatgaacaccaaatcatcacacttatgaactacaaaagagtcgcccaccagcctgggcaacatagcaaatcctcatctttacaaaaaatatataaaatatatatatatatatatatatatatatatatacaggcacacgcctgtagtcccagctactctggaggctgagctttgtatttttttgtagacatggggtctctctatattacccaggctggtcttgaaactctgggctcaagcgatccacccacctccacttaccaaagtgttggaattacaggcgtgagccattgcaaccagtcgagtgtttccatttctttccctgatttcaactttattccctttgagaaaggtagagcaacttttactccttacagatggagaaacttgaaggtcaaatgacatactagtagttcattcatattcattgattcaacaaatgcttctcctatgtgaca

SEQ ID NO: 36502 - DNA, 387 bp, Homo sapiens
ccttttgacagcaggttttttatttggtggtgctatttggttgccattccagtaggtggcacttaagaataagaaccagctcacccttgagtagtctgataatgaatagaggcaactttcctgactggggagatccttttggactgcactgaggtctcttggggaaggggtggtgagggggaagttgcactagcttctcaacctgggccagcaagcatgtaatccacttccctatcacaccctagttgcattgctcatgaccttcagttcttatagacattgccctttgactccctgctgcagtgtgggtgtggactgcaggaatgcccctttgacagctaccaccaaagtgggctcagtgcagagcctcttataccagtccaaagc

SEQ ID NO: 36503 - DNA, 464 bp, Homo sapiens
cagtgacatgttcatagttcactgtggcctcaaactcccgggctcaagcaatcttcctgccttagtctcccaggtagctgggactcaggcatgcagtaccatgcccggctaattattgtattttttgtagagatggggtttcgtcatgttgcccaggctggtctccaactcctgagctcaagcgagctgcctacctcagcctctcaaagtgctggaattataggcacaagccacagtgcctggcctgatgctgaatttagtgcagacacctgatcagcatagcacactatagccccaaactcctgtgcccaagcaatcctcccaccacagcttccggagtagttgggactatgggcgcatatcactgtgcctggcacaattacctttgtgcctccagtctttgtcactcctgctgtcaatgttcctacacatgcagctagaatcatatcttaaaacactgttgg

SEQ ID NO: 36504 - DNA, 442 bp, Homo sapiens
ctgttaatcacctcataacatgtttttgtgagagcctagagaattctttaatctgtagtgagatgagataaatctcccacttcattactgggaagaaaactctgtcagtgttctacccatctacactttgccccctaacttccatcagaaaagttaggccagtggctcgctcccagcctctgaatcacccagacctccttttacattaactggctctgcgtgcaaggggttttacaccactaagttctgtcttgaagggttggtgtgtctagactcatgcccaggtgttctcaccacactagctgtttaggagactgcagagcatggggcataagtcacagtgcagctctgtttccaggtcttaggatgtctctgatatcatcaaagaccaagcagggcctttgatcatcacgtgatctctggtgttatcaaagttccagcc

SEQ ID NO: 36505 - DNA, 1151 bp, Homo sapiens
gattacaggcacacaccacattgcccggctaattttgtatttttagtagatggggtttctccatgttggtcaggctggtctcacactcccgacctcaggtgatctgctcgccttggcctcccaaagtgccgagattacaggcttcagccaccggcgcctggctggttatagctttttaaaacaatttgcttattgtttcttagtttgtagaaagtttctcttggagatttgtgaaggaaatacatgtgatcgcttttgtgatgtgttcagatggaaagaaaatctaactttcataagaaaaattgtatcacactagatgcaggaaaaaaatagatattcgaagaaccacataccagatgcagatgaaatgtaatgtataaagactatttttataatgattttttaaatttagatttttacaatatggattttaaaattttatttcacttttaattgactaattttatacatttataaggtacaatatgttgtttcaatacatgtatacattgcaaaatgatcaaatcaggctaattaacatatctatcaccttacattcttattatttctttgtagtgagaatatctaaaattgaaatacagtcctttttattgtaactgagagaaacaagagcaatgtatatgtggtagaatttaaaagtcatatgtgtatatttatatatgtacatctacgtacaattgcctgtgtacatataattatctgctatatattatgcatatgtaatacatatgcacctgtgtaagttggaattcttatctattctatagaaagaaaagttctacattgaaatatagccaacatccagttaactctgaaaaaaaatcacatcattgcttggctttttctgttgttacttcctgttggcctagtggcaatgattcattataatgcaatgtaattcaatatcacatggtgaatttaaatggctgtataggaaatctgtaacactgttcttgcttaaaaatgtaaaacttcaatagaaggcggttcatcagagaatttggtaacaccaaatagtaaacgctttgatttcagtaatactaagaccctgatagaattaaaatgtgactgaattttacttcttagtaattattttatagctaatatgtaaaaaaaaaaaaaccaccctt

SEQ ID NO: 36506 - DNA, 573 bp, Homo sapiens
cgaaccataagccagagcctctgctgcacacaccaccagcccctgaggtggggatgacaaacataacagagaacggaatggtaaggcgtgagtgcggttctgcaggcttatggtatttctgccatttgagtgcctgcttcccttcctagatgtcttgacctcattgagcagtttattcattgtcatatcccccagtagtgtccacggtgagtgttcaataaatgatatttgttaaccacacagaagtgacagcagcaccatcaagagaacatgtgctttgagctgcttttccaagaatggaaatggatttgctttgatccattcatgtgaccaggggcacgctttgtaagggttaggaacataatacatgaccactgactctttcaggagtgaacaagaggccttgtcctccttggccagccccacatttacttaaaatgatgaaattagggcgcagatgagtccaagaactgaccagggaggcttgagcataggcgagaagtaaaagcagaagaaaacccttaactggttcacccgcagaaacccagactgtacttttagagaagttaaaag

SEQ ID NO: 36507 - DNA, 127 bp, Homo sapiens
aatcttccatgaatctagcagcttaaagagccctccacaggtgcatcatgatatggccagctgtctccagtttgttctcaccatccttatcctagaggcattgaaaatgattccttggaatataggt

SEQ ID NO: 36508 - DNA, 273 bp, Homo sapiens
gtttttactccccattccctcaggagtggttgctgttgttacaatctggaggctcttgcagagctctctgttctatgccattgatatggtttggctgtgtccccacccaaaatctcatattgaattgtaatcctcataatccccataatccccacgtgtctagggagagaccaggtggaggtaattgaatcatgggggcaggtttctcccataccattcttgtgatagtgaattctcatgagagctgatggttttatacgtgtttggtagttc

SEQ ID NO: 36509 - DNA, 642 bp, Homo sapiens
ttgctaaaaaactacaataattaaaacggtaggatttgacataaatataggtaattaaatcaatggaacacaacgtagggtctagatgcgcaagcataaagtcagttgactataaaaaacaaaaattccaagacaattcggtaatgaaagtctgttcagcaaatggtgctgcaatgactggataaacgtatggaaaagggaagcagctcaacacttacctcactacacataacttaactcaaggtggctcacccacctaaatgtaaagctagaagctctagaaacaagcacatctttgccaccttggtgcaaagatttttctagagagaacacacaaaaaagctaaacactaaagaaaaaatggataaattggactttatcaaaatatatcattaaggaaaaaaaaatatttgcaatactatatctgacaagaatttttatccaaaatatatagagtttttacaaatcagtaacaagatgaacagctcaatttaaaaatgggcaaacaagaccaggcacagtggctcatacctgtaatcccagaactttgagaggctgagcgaggcaggaggactgcttgagcccaggagtttgagaccagcctgggcaacatagggaaaccctatttctaccaaaaaaaaa

SEQ ID NO: 36510 - DNA, 443 bp, Homo sapiens
attcgcggccgagtcgacattcaaccctacaagataggtgttatacagattataagagattaatgaatgaaaaccacctaacactgcacctgatgatgcctagtagctgccccaataattagtttccttcccattttccattttatggaatctaatcctgtcttcccaactgtaatgaatttaaggcagagctaatcctttaagaatcctttggccgggcacggtggctcatgcctggcccaagatgattcttagtgttaaggaaaggttgtgaaccactggtctagagcgccacagatccctgagtagccagctctcagcctgtgctctcctgtgtcccagcacctgctgccccagtcatcaggagactcacaggagccccagagggcaaggaggaagagaaggggaaggaaagggagggaggagagggaaggggaggaagc

SEQ ID NO: 36511 - DNA, 516 bp, Homo sapiens
ctttatgacaacagaacctaaagcacctgagcaagtatatttagtaattatttctccagcacttcagaatattgttccaacccttttaccagatgatggagctctgtagtaggtctcgacagcagtacaagaagccctgctatatccttcaacagaccctatggtattacaggaatctgtggtgggaaagaatgctggggatagttgctggtgatcaatctcaataagagaatcacagcatagaccccctaggattctggagaagggccatattatctgtagtaaacaacaatataccattctaaagttcttggctggttgtggtggctcacacctgtaatcccagcactttgggaggccgaagcaggaggatcgcttgagcccaggagttcaagaccagctttggcaacttagagagaactcatctctacaaaaaatacaaaaatattgagtgtagtgatgtgtgtctgtagtcctagctgcttgggaggctgaggtgggaggatcacttgggcc

SEQ ID NO: 36512 - DNA, 1070 bp, Homo sapiens
tccttccacctagaatgccttttccttccttttctcacatagcaatctttgacatatccttgaagactgagctctcccatcagcctgggaggcctggcctgatctggaagacggttcagcacgtctttctctgttgccatagtgcgggatttttgtctattttcagcaggtcgttccagactgcaagcctctggagggcagtgactcgatcccattcagctccatatccccactaccagcatggcatgcattgggggtgtccatacatatacagaacagaaactttcagggtttggccaattttacttttccttagcatgtattatcataaagtgatgtaagtactatatgcctggatttgtcttattactacatctatttgttagtaaaaggaggttacatgtgccctaagtggtttctttgcacttaaatattttttaaattatttggttcttggctgggaacttagtccaatatgtctgctaaagtatttcccatttcttgccacctctacaatagtgccataatttccaagttgatttgacatgtatcatctttattctcacaatcctgagaggtatatagagcaagaattaagttctacatttaacaaaagagaaaacacacagagattgattggctctaggttatatagctaactggtaacaaaccaatttttattaaaattaattttaaaaatttaacttttaaagtttatcttaaatgatgaacatcgcttgtgtttttcttgcatgtagtttctattttaggagaatttgcctaggggtagttctgaaaccaagtaaaagtaattggattatgaaggtcttctaccttaaactagctgtcaactttaaactcaaccatttaataattaaatttaaactttacatttgtttaatttagtaatgtttcttcacattaatcaatttttcaaattaggaaagtaataaatgacaaaaatggaagaacatttattaaagatagaaaaaatgtttaatggtcttgtacatataaatggtgttaatgttttggcttcattttaataaagcttttattaaatagtgaca

SEQ ID NO: 36513 - DNA, 713 bp, Homo sapiens
ctttcttccccccccccgatgtgataattaagagggggttaccgggtggcttgaggggttccacccttcttatattaattgaaacccataggtttgaaggagggaaactcgcctcgggtttcccaataaaagcttttcgaatttcgcgcggctttcggaaaggcccataatttccaagttgatttgacatgtatcatctttattctcacaatcctgagaggtatatagagcaagaattaagttctacatttaacaaaagagaaaacacacagagattgattggctctaggttatatagctaactggtaacaaaccaatttttattaaaattaattttaaaaatttaacttttaaagtttatcttaaatgatgaacatcgcttgtgtttttcttgcatgtagtttctattttaggagaatttgcctaggggtagttctgaaaccaagtaaaagtaattggattatgaaggtcttctaccttaaactagctgtcaactttaaactcaaccatttaataattaaatttaaactttacatttgtttaatttagtaatgtttcttcacattaatcaatttttcaaattaggaaagtaataaatgacaaaaatggaagaacatttattaaagatagaaaaaatgtttaatggtcttgtacatataaatggtgttaatgttttggcttcattttaataaagcttttattaaatagtgaca

SEQ ID NO: 36514 - DNA, 635 bp, Homo sapiens
gaagccaggtcctcagccatggaaggtctggggaaggggcactgctgtcctgattgggacgatggaggcctggaggtgtctggatggtagaagtctttgaggcacagaaagctgccttagcagggaggtgtaagggttcctgggaggaaggtggagagcatgatcctgaggaacagggagtcttgcatcacggcaatggagggactctgattctaagggataaggatgcctgaggtttttccagagagctatggggttccatgggcaggctctgagcctgtgcccgccactaaccccactgaagcccgtcccttcaggctgatgctggtggaggaggagctgcgccgggaccaccccgccatggctgagccgctgccagaacccaagaagaggctgctcgacgctcaggtggaaattacaatgtcatttatcttctccgtgtcccatccccatccatcccactgtctttcgtgcactcactacaccagccacctagccccatcaccatctgtctctcatagtctgctgtttgtccactggctgctcctggcagccccctagtgaccccatcttcatcccatcgtctgtgcctttgtcactcctggcagcgtcagcccaactcctgtgccttccca

SEQ ID NO: 36515 - DNA, 463 bp, Homo sapiens
cccacctagttccaagaacccctgccccttctttgctcactcctattcaagccacgttgttcagcttcctctgcgctcttgggccagagggctagaagctgccgttttctggaatagagcacagggcagtatgatctgtagtttctccaggccctggccggtaccctgaaaacttggggacccatcacctctgttctcttggctccctaattttcctgtctccttggcagctcctgcatagcttcctcttcctgactcttcagatcttgaaggccttccatcctgtaacctccctttgccctcagtatttaagtccagcctccctctggcctccctcccactctggccctcagaccttcccagctgcctgctgcccagcagcaccagcacgaattcccttagcaccagcacgaattcccgtggcaccagcacgaattcccttagcaccagcacgaattccctg

SEQ ID NO: 36516 - DNA, 5888 bp, Homo sapiens
  misc_feature (2365)..(2365): n is a, c, g, or t
gacagcacagaggaggcacaggcaggagcagatggggggcacacatagcacagtgagctgacaccacaatgggaagccaggaccactgaagggtctgacgtctatttaaaaggattctactggctgtccacctcctctgtgctgtcggacagcacagaggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccccaccccactcccagccttatctatcccccctcactgtccccttttctccactcccagccccatttcctttttttctggagtgtgtggtgaaacagaaaaaaacatgtttaataaacggagattgttcttttatcgctgtgccgactttcttaggcagggctctccagacctgtacggtggtaagatctgctttctgaaaggaagctgacagcctgagangaaaaccgtatatccccacctgatgccacactctcctcatagaatgtcactctcccctcccaatgagattttttatattttagagcaggagttttgcaccggccaaacttctccaatctaactctcccctcaccactgtgtcacttagtccgaggccaggaacagcggcgttatctgataaaagagttcatgtatatatccacatttatctcttttaaaaattacctagaaataaggtttctttaattgctggttaaaatgctcccgtgcagaaaacaggaaagaacctgcctggttccttagcaaatctgagttccagtcccaggtccactactattagctgagtgacgcttccagcccgtttcccccgcctggaaactgaggacggcaacccccaccctcgcagggccggtgggaagacacaaagtgatgtgggcaagtgccaggcccacatggtaagtacccaactaatctcgcccctctcaggacctaccgggggcgggtgctacacttaatcaccgggaaacgcagctttccggggcggctgacggcccaccccctccgaccgggctgttctctcccgggccctgcctctcggtcctctgcagcggggaggacttcagcagctccccgggacgcccgttgcgaggacaccctgggcctgtgccctcctactagcaccgccctcctcgtctgcagtagccaatcaacacgaggcttgtaggctgccgttcctcgattggctacggctctagctccgcccgccgcacttggcgacggtgtccggcggggaggcggcggcttccggtctgggacggagctgtagcggcactgtaactgcgagggcagcgccgcgtgtgtaacggcgggggcgtgtcggcgggaaggacaatcgggccgggactcgcggtgtccgggtgaccgcggcttcccgggagcagacctctgtgggcactgtgaggcggaacggagcggcggggcaggagctgttgtgggcagccttcatcccgcgtggagtctacccccaagcccttctcctcttcccaattcttgtcaccttcgaggaggccatggaaaccccaacacctttgccgcctgtacccgcctccccgacctgcaacccagccccacggacaatccagatcgagttcccacagcatagctcgtcgctgctggaatctctgaaccgccacaggctagagggaaagttctgtgatgtgtccctcctggtgcagggccgggaacttagggctcataaagcagtgttagctgctgcctctccttacttccatgacaagctgcttctgggggatgcgcctcgtctcactctaccgagtgtcattgaagccgatgccttcgaggggctgctccagctcatttattcagggcgtctccgcctgccactggatgctcttcctgctcatctccttgtggccagtggccttcaaatgtggcaggtagtagatcagtgctcagaaattcttagagaattagaaacttcaggtggtggaatttcagcccgtggaggaaactcctaccatgcccttctttccactacatcctctacaggaggctggtgcattcgctcttcgcctttccagaccccagtacagtcctctgcttctactgaaagccctgcttccactgagagccctgtgggaggggagggaagtgaactgggagaagtgctgcaaattcaggtggaagaagaagaggaggaggaggaagatgatgatgatgaggaccaggggtcagccacactctctcagactcctcagccccagagagtatcaggggtttttccccgtcctcatggaccccacccactgcccatgactgctactccccgaaagcttccagagggtgagagtgcaccacttgagcttcctgcccctcctgcactgccccccaaaatcttctacattaagcaggaacccttcgagcctaaggaggagatatcaggaagcggaactcagcctggaggagcaaaggaggaaaccaaagtgttttctggaggggacactgaagggaatggggagctagggttcttgttgccttcagggccagggccaacatctgggggagggggtccatcctggaaaccagtggatcttcatgggaatgaaatcctgtcagggggtggaggacctgggggagcaggccaggccgtgcatgggcctgtgaagctaggggggacaccccctgcagatggaaaacgctttggttgcctgtgtgggaagcggtttgcagtgaagccaaagcgtgaccggcacatcatgctgaccttcagccttcggccttttggctgtggcatctgcaacaagcgcttcaagctgaagcaccatctgacagagcacatgaagacccatgctggagccctgcatgcctgtccccactgtggccgtcggttccgagtccatgcctgttttctccgccaccgggacctatgcaagggccagggctgggccactgcccactggacttacaagtgactgctgaggctatacactagcttctagaacaagataaccactgctgctgatggatacttttccctcactgccatggcacaccagtcatggatcttgtaatcatgccaagagaatagatacattatggacctcttgttcttagatatgggcctctcagcctggcagatgtggaaactcaaatttctcgtcccactccaggttttggctagccaaccctgcaggaaagtggtttataggccattcatacttaagttgatcacttgcccatggtggacatttttgtggtggtgatgtccattaaggaaaccagattttcaattatttagtgagagaagagttagagcaaaagacagtggtaaatgttttattccgtctccatgaggaattgaaggagttggtctccacctagagatacatttgatttacagcttaagtaattcagaggctaagctctaagcttttttctctcattgctggaatgatttaagcagaagtccttttgtgtacttttaaaattgtatctttccaggagcccctcagattgtaccttgctttctcaccaatagacaccttcccgacacttttttaatgttgtagctgagcactttaacaagttgagcattccatgtttcattcttagaaccttctttaatagagggtcttccctcaacagcctgtgcctctggtctacctttgaccaccactgataactaatatattggtcacaatgactggaatgtgactagtgatctcaggagatggcactgtcctaaagtgctgtcagggtggcaccactgctctctgaacaacttaccttggtcagagggactcaggtttgggacagcacaagctgaaggctggagagtaacttgcatagtaggaccatacctcttcctttcccatcccacccacatatgatagacagcccctctgttgagatatggaggggacagatactggaatcgggggtgggacttgcagttacttaaaattttttaataaactgtgccctgaaacctaaaaaaacagtg

SEQ ID NO: 36517 - DNA, 2604 bp, Homo sapiens
gacagcacagaggaggcacaggcaggagcagatggggggcacacatagcacagtgagctgacaccacaatgggaagccaggaccactgaagggtctgacgtctatttaaaaggattctactggctgtccacctcctctgtgctgtcggacagcacagaggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccctacacatacacccagccggggccaaatttatacttatataaaagttgtaaatatgtgaaattttatccctgtgccctttccccacctcaggccctacccctggaccctccccaaccttccttctctcttctttggctgttgtaattatctggggtttgtactgtacatatccggggtgtgtgtgtgtgggctgggggcaacccttctgtacagagcttcctggccccctccccccccgcccctctgcttccctccccacccaccacctcaagggtagggagttgctcttcctacctgttttattttgttttctcgttctccctccccaccccactcccagccttatctatcccccctcactgtccccttttctccactcccagccccatttcctttttttctggagtgtgtggtgaaacagaaaaaaacatgtttaataaacggagattgttctttta

SEQ ID NO: 36518 - DNA, 1055 bp, Homo sapiens
gacagcacagaggaggcacaggcaggagcagatggggggcacacatagcacagtgagctgacaccacaatgggaagccaggaccactgaagggtctgacgtctatttaaaaggattctactggctgtccacctcctctgtgctgtcggacagcacagaggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcagctcctcatcaggtaattctcctggttccgctttggccacgggcggaggacacagggggaggtgactccggaccactgcaggttggtcgtgaagcccactccctccaacacctccggagcctctcccctctcactgctgccctccacacccagagaacctccacagactccagccctccgacacctgcacagatccatctcccaagacaccacccaaagagagcatttgctgctgcttcccagaactgtccaacaataccttagcaacaccaagagttgggccctagatgggcccagcacattcacaggtcacacccacttccctgcaaaacccaccccctcccagcctcctcctgactctaagccctcctcttcctctaaa

SEQ ID NO: 36519 - DNA, 719 bp, Homo sapiens
cccatccatcccactgtctttcgtgcactcactacaccagccacctagccccatcaccatctgtctctcatagtctgctgtttgtccactggctgctcctggcagccccctagtgaccccatcttcatcccatcgtctgtgcctttgtcactcctggcagcgtcagcccaactcctgtgccttcccatccagtcttcccactcctctctgcatctcaggaccttctctaccagaaccttggtctttctgcccctagaccccacctagttccaagaacccctgccccttctttgctcactcctattcaagccacgttgttcagcttcctctgcgctcttgggccagagggctagaagctgccgttttctggaatagagcacagggcagtatgatctgtagtttctccaggccctggccggtaccctgaaaacttggggacccatcacctctgttctcttggctccctaattttcctgtctccttggcagctcctgcatagcttcctcttcctgactcttcagatcttgaaggccttccatcctgtaacctccctttgccctcagtatttaagtccagcctccctctggcctccctcccactctggccctcagaccttcccagctgcctgctgcccagcctctcttctcacaagccagcttctaggacctcccttctgcacccttaccccttgctttcccaaaattctgctcattttccta

SEQ ID NO: 36520 - DNA, 6493 bp, Homo sapiens
  misc_feature (2719)..(2719): n is a, c, g, or t
gggggccagccgcctccattgcagaggggcaagtctcagcagttgacagtcagcgcagcccagaaaccccggccatccagcgggaatctattgcagtccccagagccaagttatggccccgcccgtccacggcaacagagcctcagcaaggagggcagcattgggggcagcgggggcagcggtggcggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccctacacatacacccagccggggccaaatttatacttatataaaagttgtaaatatgtgaaattttatccctgtgccctttccccacctcaggccctacccctggaccctccccaaccttccttctctcttctttggctgttgtaattatctggggtttgtactgtacatatccggggtgtgtgtgtgtgggctgggggcaacccttctgtacagagcttcctggccccctccccccccgcccctctgcttccctccccacccaccacctcaagggtagggagttgctcttcctacctgttttattttgttttctcgttctccctccccaccccactcccagccttatctatcccccctcactgtccccttttctccactcccagccccatttcctttttttctggagtgtgtggtgaaacagaaaaaaacatgtttaataaacggagattgttcttttatcgctgtgccgactttcttaggcagggctctccagacctgtacggtggtaagatctgctttctgaaaggaagctgacagcctgagangaaaaccgtatatccccacctgatgccacactctcctcatagaatgtcactctcccctcccaatgagattttttatattttagagcaggagttttgcaccggccaaacttctccaatctaactctcccctcaccactgtgtcacttagtccgaggccaggaacagcggcgttatctgataaaagagttcatgtatatatccacatttatctcttttaaaaattacctagaaataaggtttctttaattgctggttaaaatgctcccgtgcagaaaacaggaaagaacctgcctggttccttagcaaatctgagttccagtcccaggtccactactattagctgagtgacgcttccagcccgtttcccccgcctggaaactgaggacggcaacccccaccctcgcagggccggtgggaagacacaaagtgatgtgggcaagtgccaggcccacatggtaagtacccaactaatctcgcccctctcaggacctaccgggggcgggtgctacacttaatcaccgggaaacgcagctttccggggcggctgacggcccaccccctccgaccgggctgttctctcccgggccctgcctctcggtcctctgcagcggggaggacttcagcagctccccgggacgcccgttgcgaggacaccctgggcctgtgccctcctactagcaccgccctcctcgtctgcagtagccaatcaacacgaggcttgtaggctgccgttcctcgattggctacggctctagctccgcccgccgcacttggcgacggtgtccggcggggaggcggcggcttccggtctgggacggagctgtagcggcactgtaactgcgagggcagcgccgcgtgtgtaacggcgggggcgtgtcggcgggaaggacaatcgggccgggactcgcggtgtccgggtgaccgcggcttcccgggagcagacctctgtgggcactgtgaggcggaacggagcggcggggcaggagctgttgtgggcaggtgaaggcaggctggtggctgaaggacctccttcttatcttccacaggggctggaagttaaaacccctgttggtgtttagtggtggtggttgttgttgtttgtttttgctttcttggtgtgcgggactgatttgcagaaaccgccactgacttaaaagtttccagttattgctcgtggggagggggttgtttgagaagatgtggctccctttatccagggcttctgtgacctccatctttttcctctgcagccttcatcccgcgtggagtctacccccaagcccttctcctcttcccaattcttgtcaccttcgaggaggccatggaaaccccaacacctttgccgcctgtacccgcctccccgacctgcaacccagccccacggacaatccagatcgagttcccacagcatagctcgtcgctgctggaatctctgaaccgccacaggctagagggaaagttctgtgatgtgtccctcctggtgcagggccgggaacttagggctcataaagcagtgttagctgctgcctctccttacttccatgacaagctgcttctgggggatgcgcctcgtctcactctaccgagtgtcattgaagccgatgccttcgaggggctgctccagctcatttattcagggcgtctccgcctgccactggatgctcttcctgctcatctccttgtggccagtggccttcaaatgtggcaggtagtagatcagtgctcagaaattcttagagaattagaaacttcaggtggtggaatttcagcccgtggaggaaactcctaccatgcccttctttccactacatcctctacaggaggctggtgcattcgctcttcgcctttccagaccccagtacagtcctctgcttctactgaaagccctgcttccactgagagccctgtgggaggggagggaagtgaactgggagaagtgctgcaaattcaggtggaagaagaagaggaggaggaggaagatgatgatgatgaggaccaggggtcagccacactctctcagactcctcagccccagagagtatcaggggtttttccccgtcctcatggaccccacccactgcccatgactgctactccccgaaagcttccagagggtgagagtgcaccacttgagcttcctgcccctcctgcactgccccccaaaatcttctacattaagcaggaacccttcgagcctaaggaggagatatcaggaagcggaactcagcctggaggagcaaaggaggaaaccaaagtgttttctggaggggacactgaagggaatggggagctagggttcttgttgccttcagggccagggccaacatctgggggagggggtccatcctggaaaccagtggatcttcatgggaatgaaatcctgtcagggggtggaggacctgggggagcaggccaggccgtgcatgggcctgtgaagctaggggggacaccccctgcagatggaaaacgctttggttgcctgtgtgggaagcggtttgcagtgaagccaaagcgtgaccggcacatcatgctgaccttcagccttcggccttttggctgtggcatctgcaacaagcgcttcaagctgaagcaccatctgacagagcacatgaagacccatgctggagccctgcatgcctgtccccactgtggccgtcggttccgagtccatgcctgttttctccgccaccgggacctatgcaagggccagggctgggccactgcccactggacttacaagtgactgctgaggctatacactagcttctagaacaagataaccactgctgctgatggatacttttccctcactgccatggcacaccagtcatggatcttgtaatcatgccaagagaatagatacattatggacctcttgttcttagatatgggcctctcagcctggcagatgtggaaactcaaatttctcgtcccactccaggttttggctagccaaccctgcaggaaagtggtttataggccattcatacttaagttgatcacttgcccatggtggacatttttgtggtggtgatgtccattaaggaaaccagattttcaattatttagtgagagaagagttagagcaaaagacagtggtaaatgttttattccgtctccatgaggaattgaaggagttggtctccacctagagatacatttgatttacagcttaagtaattcagaggctaagctctaagcttttttctctcattgctggaatgatttaagcagaagtccttttgtgtacttttaaaattgtatctttccaggagcccctcagattgtaccttgctttctcaccaatagacaccttcccgacacttttttaatgttgtagctgagcactttaacaagttgagcattccatgtttcattcttagaaccttctttaatagagggtcttccctcaacagcctgtgcctctggtctacctttgaccaccactgataactaatatattggtcacaatgactggaatgtgactagtgatctcaggagatggcactgtcctaaagtgctgtcagggtggcaccactgctctctgaacaacttaccttggtcagagggactcaggtttgggacagcacaagctgaaggctggagagtaacttgcatagtaggaccatacctcttcctttcccatcccacccacatatgatagacagcccctctgttgagatatggaggggacagatactggaatcgggggtgggacttgcagttacttaaaattttttaataaactgtgccctgaaacctaaaaaaacagtg

SEQ ID NO: 36521 - DNA, 6214 bp, Homo sapiens
  misc_feature (2691)..(2691): n is a, c, g, or t
gacagcacagaggaggcacaggcaggagcagatggggggcacacatagcacagtgagctgacaccacaatgggaagccaggaccactgaagggtctgacgtctatttaaaaggattctactggctgtccacctcctctgtgctgtcggacagcacagaggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccctacacatacacccagccggggccaaatttatacttatataaaagttgtaaatatgtgaaattttatccctgtgccctttccccacctcaggccctacccctggaccctccccaaccttccttctctcttctttggctgttgtaattatctggggtttgtactgtacatatccggggtgtgtgtgtgtgggctgggggcaacccttctgtacagagcttcctggccccctccccccccgcccctctgcttccctccccacccaccacctcaagggtagggagttgctcttcctacctgttttattttgttttctcgttctccctccccaccccactcccagccttatctatcccccctcactgtccccttttctccactcccagccccatttcctttttttctggagtgtgtggtgaaacagaaaaaaacatgtttaataaacggagattgttcttttatcgctgtgccgactttcttaggcagggctctccagacctgtacggtggtaagatctgctttctgaaaggaagctgacagcctgagangaaaaccgtatatccccacctgatgccacactctcctcatagaatgtcactctcccctcccaatgagattttttatattttagagcaggagttttgcaccggccaaacttctccaatctaactctcccctcaccactgtgtcacttagtccgaggccaggaacagcggcgttatctgataaaagagttcatgtatatatccacatttatctcttttaaaaattacctagaaataaggtttctttaattgctggttaaaatgctcccgtgcagaaaacaggaaagaacctgcctggttccttagcaaatctgagttccagtcccaggtccactactattagctgagtgacgcttccagcccgtttcccccgcctggaaactgaggacggcaacccccaccctcgcagggccggtgggaagacacaaagtgatgtgggcaagtgccaggcccacatggtaagtacccaactaatctcgcccctctcaggacctaccgggggcgggtgctacacttaatcaccgggaaacgcagctttccggggcggctgacggcccaccccctccgaccgggctgttctctcccgggccctgcctctcggtcctctgcagcggggaggacttcagcagctccccgggacgcccgttgcgaggacaccctgggcctgtgccctcctactagcaccgccctcctcgtctgcagtagccaatcaacacgaggcttgtaggctgccgttcctcgattggctacggctctagctccgcccgccgcacttggcgacggtgtccggcggggaggcggcggcttccggtctgggacggagctgtagcggcactgtaactgcgagggcagcgccgcgtgtgtaacggcgggggcgtgtcggcgggaaggacaatcgggccgggactcgcggtgtccgggtgaccgcggcttcccgggagcagacctctgtgggcactgtgaggcggaacggagcggcggggcaggagctgttgtgggcagccttcatcccgcgtggagtctacccccaagcccttctcctcttcccaattcttgtcaccttcgaggaggccatggaaaccccaacacctttgccgcctgtacccgcctccccgacctgcaacccagccccacggacaatccagatcgagttcccacagcatagctcgtcgctgctggaatctctgaaccgccacaggctagagggaaagttctgtgatgtgtccctcctggtgcagggccgggaacttagggctcataaagcagtgttagctgctgcctctccttacttccatgacaagctgcttctgggggatgcgcctcgtctcactctaccgagtgtcattgaagccgatgccttcgaggggctgctccagctcatttattcagggcgtctccgcctgccactggatgctcttcctgctcatctccttgtggccagtggccttcaaatgtggcaggtagtagatcagtgctcagaaattcttagagaattagaaacttcaggtggtggaatttcagcccgtggaggaaactcctaccatgcccttctttccactacatcctctacaggaggctggtgcattcgctcttcgcctttccagaccccagtacagtcctctgcttctactgaaagccctgcttccactgagagccctgtgggaggggagggaagtgaactgggagaagtgctgcaaattcaggtggaagaagaagaggaggaggaggaagatgatgatgatgaggaccaggggtcagccacactctctcagactcctcagccccagagagtatcaggggtttttccccgtcctcatggaccccacccactgcccatgactgctactccccgaaagcttccagagggtgagagtgcaccacttgagcttcctgcccctcctgcactgccccccaaaatcttctacattaagcaggaacccttcgagcctaaggaggagatatcaggaagcggaactcagcctggaggagcaaaggaggaaaccaaagtgttttctggaggggacactgaagggaatggggagctagggttcttgttgccttcagggccagggccaacatctgggggagggggtccatcctggaaaccagtggatcttcatgggaatgaaatcctgtcagggggtggaggacctgggggagcaggccaggccgtgcatgggcctgtgaagctaggggggacaccccctgcagatggaaaacgctttggttgcctgtgtgggaagcggtttgcagtgaagccaaagcgtgaccggcacatcatgctgaccttcagccttcggccttttggctgtggcatctgcaacaagcgcttcaagctgaagcaccatctgacagagcacatgaagacccatgctggagccctgcatgcctgtccccactgtggccgtcggttccgagtccatgcctgttttctccgccaccgggacctatgcaagggccagggctgggccactgcccactggacttacaagtgactgctgaggctatacactagcttctagaacaagataaccactgctgctgatggatacttttccctcactgccatggcacaccagtcatggatcttgtaatcatgccaagagaatagatacattatggacctcttgttcttagatatgggcctctcagcctggcagatgtggaaactcaaatttctcgtcccactccaggttttggctagccaaccctgcaggaaagtggtttataggccattcatacttaagttgatcacttgcccatggtggacatttttgtggtggtgatgtccattaaggaaaccagattttcaattatttagtgagagaagagttagagcaaaagacagtggtaaatgttttattccgtctccatgaggaattgaaggagttggtctccacctagagatacatttgatttacagcttaagtaattcagaggctaagctctaagcttttttctctcattgctggaatgatttaagcagaagtccttttgtgtacttttaaaattgtatctttccaggagcccctcagattgtaccttgctttctcaccaatagacaccttcccgacacttttttaatgttgtagctgagcactttaacaagttgagcattccatgtttcattcttagaaccttctttaatagagggtcttccctcaacagcctgtgcctctggtctacctttgaccaccactgataactaatatattggtcacaatgactggaatgtgactagtgatctcaggagatggcactgtcctaaagtgctgtcagggtggcaccactgctctctgaacaacttaccttggtcagagggactcaggtttgggacagcacaagctgaaggctggagagtaacttgcatagtaggaccatacctcttcctttcccatcccacccacatatgatagacagcccctctgttgagatatggaggggacagatactggaatcgggggtgggacttgcagttacttaaaattttttaataaactgtgccctgaaacctaaaaaaacagtg

SEQ ID NO: 36522 - DNA, 6295 bp, Homo sapiens
  misc_feature (2691)..(2691): n is a, c, g, or t
gacagcacagaggaggcacaggcaggagcagatggggggcacacatagcacagtgagctgacaccacaatgggaagccaggaccactgaagggtctgacgtctatttaaaaggattctactggctgtccacctcctctgtgctgtcggacagcacagaggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccctacacatacacccagccggggccaaatttatacttatataaaagttgtaaatatgtgaaattttatccctgtgccctttccccacctcaggccctacccctggaccctccccaaccttccttctctcttctttggctgttgtaattatctggggtttgtactgtacatatccggggtgtgtgtgtgtgggctgggggcaacccttctgtacagagcttcctggccccctccccccccgcccctctgcttccctccccacccaccacctcaagggtagggagttgctcttcctacctgttttattttgttttctcgttctccctccccaccccactcccagccttatctatcccccctcactgtccccttttctccactcccagccccatttcctttttttctggagtgtgtggtgaaacagaaaaaaacatgtttaataaacggagattgttcttttatcgctgtgccgactttcttaggcagggctctccagacctgtacggtggtaagatctgctttctgaaaggaagctgacagcctgagangaaaaccgtatatccccacctgatgccacactctcctcatagaatgtcactctcccctcccaatgagattttttatattttagagcaggagttttgcaccggccaaacttctccaatctaactctcccctcaccactgtgtcacttagtccgaggccaggaacagcggcgttatctgataaaagagttcatgtatatatccacatttatctcttttaaaaattacctagaaataaggtttctttaattgctggttaaaatgctcccgtgcagaaaacaggaaagaacctgcctggttccttagcaaatctgagttccagtcccaggtccactactattagctgagtgacgcttccagcccgtttcccccgcctggaaactgaggacggcaacccccaccctcgcagggccggtgggaagacacaaagtgatgtgggcaagtgccaggcccacatggtaagtacccaactaatctcgcccctctcaggacctaccgggggcgggtgctacacttaatcaccgggaaacgcagctttccggggcggctgacggcccaccccctccgaccgggctgttctctcccgggccctgcctctcggtcctctgcagcggggaggacttcagcagctccccgggacgcccgttgcgaggacaccctgggcctgtgccctcctactagcaccgccctcctcgtctgcagtagccaatcaacacgaggcttgtaggctgccgttcctcgattggctacggctctagctccgcccgccgcacttggcgacggtgtccggcggggaggcggcggcttccggtctgggacggagctgtagcggcactgtaactgcgagggcagcgccgcgtgtgtaacggcgggggcgtgtcggcgggaaggacaatcgggccgggactcgcggtgtccgggtgaccgcggcttcccgggagcagacctctgtgggcactgtgaggcggaacggagcggcggggcaggagctgttgtgggcagccttcatcccgcgtggagtctacccccaagcccttctcctcttcccaattcttgtcaccttcgaggaggccatggaaaccccaacacctttgccgcctgtacccgcctccccgacctgcaacccagccccacggacaatccagatcgagttcccacagcatagctcgtcgctgctggaatctctgaaccgccacaggctagagggaaagttctgtgatgtgtccctcctggtgcagggccgggaacttagggctcataaagcagtgttagctgctgcctctccttacttccatgacaagctgcttctgggggatgcgcctcgtctcactctaccgagtgtcattgaagccgatgccttcgaggggctgctccagctcatttattcagggcgtctccgcctgccactggatgctcttcctgctcatctccttgtggccagtggccttcaaatgtggcaggtagtagatcagtgctcagaaattcttagagaattagaaacttcaggtggtggaatttcagcccgtggaggaaactcctaccatgcccttctttccactacatcctctacaggaggctggtgcattcgctcttcgcctttccagaccccagtacagtcctctgcttctactgaaagccctgcttccactgagagccctgtgggaggggagggaagtgaactgggagaagtgctgcaaattcaggtggaagaagaagaggaggaggaggaagatgatgatgatgaggaccaggggtcagccacactctctcagactcctcagccccagagagtatcaggggtttttccccgtcctcatggaccccacccactgcccatgactgctactccccgaaagcttccagagggtgagagtgcaccacttgagcttcctgcccctcctgcactgccccccaaaatcttctacattaagcaggaacccttcgagcctaaggaggagatatcaggaagcggaactcagcctggaggagcaaaggaggaaaccaaagtgttttctggaggggacactgaagggaatggggagctagggttcttgttgccttcagggccagggccaacatctgggggagggggtccatcctggaaaccagtggatcttcatgggaatgaaatcctgtcagggggtggaggacctgggggagcaggccaggccgtgcatgggcctgtgaagctaggggggacaccccctgcagatggaaaacgctttggttgcctgtgtgggaagcggtttgcagtgaagccaaagcgtgaccggcacatcatgctgaccttcagccttcggccttttggctgtggcatctgcaacaagcgcttcaagctgaagcaccatctgacagagcacatgaagacccatgctggagccctgcatgcctgtccccactgtggccgtcggttccgagtccatgcctgttttctccgccaccgggacctatgcaagggccagggctgggccactgcccactggacttacaagtgactgctgaggctatacactagcttctagaacaagataaccactgctgctgatggatacttttccctcactgccatggcacaccagtcatggatcttgtaatcatgccaagagaatagatacattatggacctcttgttcttagatatgggcctctcagcctggcagatgtggaaactcaaatttctcgtcccactccaggttttggctagccaaccctgcaggaaagtggtttataggccattcatacttaagttgatcacttgcccatggtggacatttttgtggtggtgatgtccattaaggaaaccagattttcaattatttagtgagagaagagttagagcaaaagacagtggtaaatgttttattccgtctccatgaggaattgaaggagttggtctccacctagagatacatttgatttacagcttaagtaattcagaggctaagctctaagcttttttctctcattgctggaatgatttaagcagaagtccttttgtgtacttttaaaattgtatctttccaggagcccctcagattgtaccttgctttctcaccaatagacaccttcccgacacttttttaatgttgtagctgagcactttaacaagttgagcattccatgtttcattcttagaaccttctttaatagagggtcttccctcaacagcctgtgcctctggtctacctttgaccaccactgataactaatatattggtcacaatgactggaatgtgactagtgatctcaggagatggcactgtcctaaagtgctgtcagggtggcaccactgctctctgaacaacttaccttggtcagagggactcaggtttgggacagcacaagctgaaggctggagagtaacttgcatagtaggaccatacctcttcctttcccatcccacccacatatgatagacagcccctctgttgagatatggaggggacagatactggaatcgggggtgggcctcgttctctcacaccccactccatcatctccacccctctaaccatataccaccactccctcttacccttcccagccccactctatctctcacccttcatcttctcacaaccattccacttctctatcctctcacccg

SEQ ID NO: 36523 - DNA, 2278 bp, Homo sapiens
gacagcacagaggaggcacaggcaggagcagatggggggcacacatagcacagtgagctgacaccacaatgggaagccaggaccactgaagggtctgacgtctatttaaaaggattctactggctgtccacctcctctgtgctgtcggacagcacagaggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcaggagaggcagcttccccccttgggtccaacaaacccgcgtgtgacgctggccccaccgtggaatggcctggcccccccagccccaccacccccaccccggctgcagattacggagaacggcgagttccgaaacaccgcagaccactagcccacccagcatcagagaccttctcttcctttcctgtgcaccccaccctgtaacagcaccaaccaccaggattggacatcaccgaggaacagcgggattgcctccccgaatgcctccctgggaggcacactgattgcccacccccaccactgcaccatttccaggagggagagtggggaccctcagccgcccccttttccttcccattggggtgctgccctctctttgacccccagggacccttgccccaggacaccgcctaccccgtacagaccccttcactccggggtgctatccccatcctctgcctcatcgttcccctgagcactgggggacagaccctcacccccaccctgggggtgtggcacctccaaactttcaacttcagggtgatttttttagcagtaaccagagctgacaatctaactcccctccaccgccccattttggcctcccctgccccccttgttatggggaggggaccccgggtgagggggccctattaccccttgatttctcaggagcgtctgggggggctcagcacgcacaaactccttctccttctaccactcttaaatttactccctccccacccagaacccagatggggtggagggggccaccggggcagggagggggcggcaaggggggaatgggagttgtctccccttctccccacacctgatctgctctcggctggtcccagagcggggtgagggggcttatgcccccccctcccccagtgtgttgggtggggtggaattgaggttagggtgaggggtcagggtttaggagggtgtgtatgttgggaggacaggctagttgatctgtcctactctgacacacagtcccctctgccccttccttctctcttcttggtctctactcccagggggaggggggaacttactctaggaaaagccatgtctctctcccccagggtggggggacctgtgttggaggaggggtgttggggggcccccttccatgactctgtcccctgggggaggtaggacagggctgggcttccctctcatcctccccctcccaatctccttccacctccctccctcccgccagctccacgatttttcggtgtttctctgtacatagttttctggcgggataggggaggtaggatggatggggtttggggtgggtaggccatgggaggggagaagcccctccttggcaccccctcttccctgactgctgtcccctacccagccttgcccccttcatccttttgcgtttggtattgagactctcctagactctactcctctttcttttgtatggacagttccccttcagtcccatccccccaccccactcccagccttatctatcccccctcactgtccccttttctccactcccagccccatttcctttttttctggagtgtgtggtgaaacagaaaaaaacatgtttaataaacggagattgttctttta

SEQ ID NO: 36524 - DNA, 901 bp, Homo sapiens
gacagcacagaggaggcacaggcaggagcagatggggggcacacatagcacagtgagctgacaccacaatgggaagccaggaccactgaagggtctgacgtctatttaaaaggattctactggctgtccacctcctctgtgctgtcggacagcacagaggagggggtggggggctgaagccctccatcaccaagcagcattctcagacaccatccacattgaaccccacaatgccagcctctgagcggacagtggcctgggtctccaacatgcctcacctgtcggctgacatcgagagtgcccacatcgagcgggaagagtacaagctcaaggagtactcaaaatcgatggatgagagccggctggatagggtgaaggagtacgaggaggagattcactcactgaaagagcggctgcacatgtccaaccggaagctggaagagtatgagcggaggctgctgtcccaggaagaacaaaccagcaaaatcctgatgcagtatcaggcccgactggagcagagtgagaagaggctaaggcagcagcaggcagagaaggattcccagatcaagagcatcattggcaggctgatgctggtggaggaggagctgcgccgggaccaccccgccatggctgagccgctgccagaacccaagaagaggctgctcgacgctcaggtggaaattacaatgtcatttatcttctccgtgtcccatccccatccatcccactgtctttcgtgcactcactacaccagccacctagccccatcaccatctgtctctcatagtctgctgtttgtccactggctgctcctggcagccccctagtgaccccatcttcatcccatcgtctgtgcctttgtcactcctggcagcgtcagcccaactcctgtgccttccca

SEQ ID NO: 36525 - DNA, 443 bp, Homo sapiens
tattagtcagaagcatttggtaccttatacactttggatatttttcccctccaaatcacatgttgaaatttgatccccaatattggaggtggggcctggtgggaggtatttgaatcaagagggtggatccctcatgaatggcttggtgccccccttgtggtaattagttctctttagtgagattttattcttttagttaccaggagatttaactcttaaagagtctggcacctcctccctgttgctcctgctccctctctcaccatgtgacacgactgccccctgttcatcttctgccatgagtaaaagcttactgaggcctcaccagaaactaagcagatgctggtgccatgcttatacagcctgcagaaccatgagccaaataaacttcttttccttataaattacccagcctctgatattcctttacacattaagttgtt

SEQ ID NO: 36526 - DNA, 1599 bp, Homo sapiens
  misc_feature (1196)..(1196): n is a, c, g, or t
tccgttgctctgcttgagccagtcctatgtagaaagtggcaaattacacattttttctccccttttagtctctggtggacatcttgtctgtgtcacagtttgatactaccaaattgaaaggattcttcactgcttcagatggggagggtgacagaagctgagctgtttcctgggtcagataatggcctctgtcaaagcaaagaatagttgtagagacacaaactgggcccttgaagctgtgactaacattttggcaacatgcatccctttgccaaataacttcttttcttcttgagtgtgattgttgatctccttctcaaagtaggctcttgttgctactattcttcacacaactcccaagcaaaagttggcagagttccggttgactgactgtgtcttgagggatatgccccggattagagtggatggggcgttccatgtcaaaatgaggttcattggcagatcctgagagctgctttgcaaagaaatagaggcagtactctttactgaatgttcttgcggtcctttatctttcttctaaattcaagtctgttcttattcatctagtgattaaatgcagaatcattgcctttgcctagcttcgtgggcattgtggaagagaagacagtatttccaactttttttttttttttcttttctcacaagccattgagcctgaggaactacaggctaaatttatgagcatttcttgatatctacagagggctactaaaaaaaaaatgctgaatagacctttatggggaacaacaatgttaataggaaaaaaaggtgatatgtttgctaatgtctatgtcagtcttaactctctttaagattttggctcattttggcttaagagcctgcagaagtatgtaagttatcaaataggggagccaggaattggtttcttccttgccatttaagcttggcaaagttagagcaatttggaatggctatccaacaatgtgttctacttagtaaatactctcttgtttttcaggggatagttagctaaaggtagggttatctccaatatgttttgggatggatcgtgaagatcattccctttttattttgagacaggatctctctctcttgcccaggctggagtgtggcggcgtgatctgtagcctcgacctccccaggctcaggctcaggtgttcttcccacttcagcctcctgtgtagctgggactncaggcgcacgccactatgcctcactaatttttattttttgtagagatggggtttcgccatgttgcccagcctggtcttgaacttttgccggcctcccaaagtgctgggattataggtgtgagccaccaggctcagccattataattgattttcaaaaaaaatttagtttcttaagcttcatggattcaaattgagtgccatttggattttgaggcccctcagtggaaataatttgtttttagcaagtaattatgatatttctaaagtgcaaattcactgacctactttctgtgcttctggaaatgctgaatcgaataatctttttttttcctcccaataatccctctgactgtgaaaacattctccatatgtattcagattgggatagttggtaaaaaaaaaa

SEQ ID NO: 36527 - DNA, 1880 bp, Homo sapiens
  misc_feature (1477)..(1477): n is a, c, g, or t
acgcttaagtaggagacctgtctggatggagagacgccacctgagtggtccacacagcctgtggggactggggcttgaggtggggaaccttctgctcaagaaaagcaggataggccaggccatggtggctcacgtctgtaatcccagcactttgggaggcctaggtgggaggatcgcttgagcccagaagttcaagaccagcctgggcaacatacggagacccccatttctaaaaaagttttaaaaattagctgggcatggtagtgtgcatctgtggtcccagctactcaggaggccgaggtgtgaggatcgcttgagccccaggaggtcgaggctgcagtgagctatgattgcatcactgcactccagcccgggcacagagcaagaccctgagaccttgtcagaaagaaagaaagaaagaggagagggagagggagaaagaagggggggggagagagagagagagagagagagatatcaaagaatagttgtagagacacaaactgggcccttgaagctgtgactaacattttggcaacatgcatccctttgccaaataacttcttttcttcttgagtgtgattgttgatctccttctcaaagtaggctcttgttgctactattcttcacacaactcccaagcaaaagttggcagagttccggttgactgactgtgtcttgagggatatgccccggattagagtggatggggcgttccatgtcaaaatgaggttcattggcagatcctgagagctgctttgcaaagaaatagaggcagtactctttactgaatgttcttgcggtcctttatctttcttctaaattcaagtctgttcttattcatctagtgattaaatgcagaatcattgcctttgcctagcttcgtgggcattgtggaagagaagacagtatttccaactttttttttttttttcttttctcacaagccattgagcctgaggaactacaggctaaatttatgagcatttcttgatatctacagagggctactaaaaaaaaaatgctgaatagacctttatggggaacaacaatgttaataggaaaaaaaggtgatatgtttgctaatgtctatgtcagtcttaactctctttaagattttggctcattttggcttaagagcctgcagaagtatgtaagttatcaaataggggagccaggaattggtttcttccttgccatttaagcttggcaaagttagagcaatttggaatggctatccaacaatgtgttctacttagtaaatactctcttgtttttcaggggatagttagctaaaggtagggttatctccaatatgttttgggatggatcgtgaagatcattccctttttattttgagacaggatctctctctcttgcccaggctggagtgtggcggcgtgatctgtagcctcgacctccccaggctcaggctcaggtgttcttcccacttcagcctcctgtgtagctgggactncaggcgcacgccactatgcctcactaatttttattttttgtagagatggggtttcgccatgttgcccagcctggtcttgaacttttgccggcctcccaaagtgctgggattataggtgtgagccaccaggctcagccattataattgattttcaaaaaaaatttagtttcttaagcttcatggattcaaattgagtgccatttggattttgaggcccctcagtggaaataatttgtttttagcaagtaattatgatatttctaaagtgcaaattcactgacctactttctgtgcttctggaaatgctgaatcgaataatctttttttttcctcccaataatccctctgactgtgaaaacattctccatatgtattcagattgggatagttggtaaaaaaaaaa

SEQ ID NO: 36528 - DNA, 732 bp, Homo sapiens
aagctacttacctcttgatagtcacttcaaatcctgcctgcctcctctctgaaatctcttctaaatagattttgaactccttgtacataataggtgctgaaaaattttcattgaaaaaaagtatataaagatattttataaaatataaacaagaagtaaaaagaaaaagaaaaattttgttgcctataataccacaatcctgaggtagccactggtacagtttatcttttctataaatagctgaattattattaagtataattataaagctaaacactgggtgcttaaggcctgcttcctgtaagtcagtgtgatgaaatggaaaaaccctttacttgctagagtttgcagcggtcaataataaagtattaactaacctgagagaattgagaatatgtaactaacctaagaacagctaggtattttacattcagttttgcattcatgtagtattttgaacttgtttaacaaacaaaatttgtgctaaccatgatagcttctattaaaaaaaaaaaattctaacctaccctaaaagctagggctgtatttagaaggcattacttttttcatcctcctctcttgccttaaagagggctctgggccgggtgcagtggctcacgcctgtaatcccagcactttgggaggctgaggcgggcggatcacaaggtcaggagatcaagaccatcctggctaacatggtgaaaccccatctctactaaaaatacaaaaaaa

SEQ ID NO: 36529 - DNA, 6224 bp, Homo sapiens
agcggagctccgctcgcgctctcgccgctcctgccggctcgcccggccccgcgctccgccgtctcctcgccgcccgcccctccgccagccccggggaccgcgcggccgcagcctgagccagggccccctccctcgtcaggaccggggcagcaagcaggccgggggcaggtccgggcacccaccatgcgaggcgagctctggctcctggtgctggtgctcagggaggctgcccgggcgctgagcccccagcccggagcaggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaataccaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgttcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttatttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctccaactccttgtctctcaacgtattggctatgacgcagcaagcagaatgaatttggactcagttacaggctgtcaatggtctgctctgtagcagtctcagagcctccccgacccactacctggagatagccagatagccagatgccctgctcctggccacctttaaagcccctgcatatgacacaggttaactaaagtcaagattggggctgctgcattccaggttccctagactcacaagctggtccttggccaggtgcagtggctcacgcctgtaatcccagcactttgggaggctgaggcaggcggatcacctgaagtcagaagtttgagaccagcctggccaacataattaaaatgtctctactaaaaatacaaaaaattagctgggtgtggtgacgcttgcctgtatcccagctactcaggaagctgagacacgagaatcacttgaacctgggaggcagaggttgcagtgagctcagatagtgccactgcactccagcctgggtgacagagcgagactccgtctcaaaaaaaaaaaaagaaagcagaacctcatggctatagagttggcattttagccccagcttctgtagctctgaaagcctaaagaaggtattctctccatctgttaaacacagtatagtggctctcagcccttggggcatgttatcatgggagggaagtcaaataagaggagagaaaagaactcaagggggaaactgcatttttaggctttgctctcttaccttgccctttctactcagaaccaataacttctgcatcaaaacatgttacagcctgcatcaagggctttaccccaacctgcagcccagccttccctgggtgagcttgctatgcgcagccacatttaccatgtggggctccctattctgatggcctgttcggtgccgggtttactcactgccctgttctgatgtcagtgcctgtacatacctccaaaggcaggacttgcctgataaatatttttcctcctctgaactggattttataggcattaaagacaagtcgggtggctagagggctccttgagacatacctagcagggaactgcaggtggattctgttgagaggcaaagcacctgagtggttgggacacaggcagctggcatgggagggactttttttgagacagggtctcactgtgtcgcccagggcaaggatgcccaaagacaccaggttggagaggcacctgccaactacttgctttccctggagcctgcatgtgcctgtggggtggggaggcgtaggggtctacggctgcctgagatgggtgtgcacagtgtgtgaagtacctacctccttgccttgctggactgtcagccagtcgcagggccggccacaagacccatgtctccatctggtcatactccatagctaccaagttaacctgctctaaactttggagaactggatctgtccaataaacgcttatttggccaagcctgatggctcgtgcctgtactcccagcactttgggaggctgaggtgggagggttgcttgagcccaggggtttgagaccagcttgggcaacaacaacaaaaatgccaggtgtggtggggtgcacctgtagtcccagctactagggaggctgagccaggaggatcacttgagcccgggaggttgaggctgcagtggggggtcataatcatgccactgtactccagcctgggtgacagagtgagaccctgtctccgaaaaaaaaaaaaaaaaaagaacggaaaaagaaatgcttacattgtcagggatcctgtagacaatcattaactctatgagatgcttggttctatttttttgggagactttgtccaagtgttttggcttaagaaatccataggcctctcttggtgacacatctctagtactttttgtcataaacaaacaggccatctgccgccaaatacatccactccccatgccactgacatcctatgggtcagccaggcttgctttgactgaggccgaggcatctggaactttctctgcctgcaggggctagcagcagaggcttcaccgcatcaccaccccttcctccactcctgacattctttcccttcagggatccaaaatggttggccgagctcccagtgggaaaacgtgtgctagagttggggagtgagatgagtggtgctgtccatggaatcaggccacagcaggaactgccccactggccatttgagacacacacaggtggtaaatgctctgctggtgggctgtgcttccctcattcagagagctctgttacagcccactgtgtcctttagaagcttgaaaggaacccaactctttgctgcactgtcctttttcttcctcaaattcagaccctccttccaccggcacccccctactccaccctcagctcttccttgcctggtttatcaagcagagctgaggccccacgtttccaactctgattgtcacttgcatcttcacaaaggataaaccacggagcaactggaaaaccatcagccaagcgttcggatgagtctggttattggtccacccccgaccagattcccttacacttaactcacttctttctttggcaatgaccctcatgacatgtataaatgggtatgactaagaagaggctgtgatctaacatttatttgctgccattttttactctggggagaagcagccccaactcatcactgggaaagaactccccctgcaaaccagctaaatttgataatttaaaccccctgcccctaaaacttctcacagagctggggagttggtggcaactttccaagtcaaggtcttgcttagaaagtccttcactacatggccaggtgcagtggctcacgcctgtagtcccaggtacttgggagcctgaggcaggaggattgcttgagctcaggagttcaaggctgcagagagctatgatcatcccactgcatttgtttaaaaataaatttttaaaatttgtgtgttttatcaggggtctcctgtacagtgtatctgtgtatgtttgtgtgtgtgtttgtatacagccttgtttaatgttttgagcaataagatatgcacacacaggtattttgttgctaaagagattggacaaggttgtagctgtgctcaggcttcagcttggtttgttaaattgagagataaacaatgacaagagctgccagccaaccacactattcaaaaagcaaagtgttcaccactaaagctaaccattcatctggttgcaggcaaggctaaggctctctctcctctagttcctggaacagactcacagattggcatgaagcactgatcaggggctgcactcagactccctggccaagcaaacctacaccagaagagtcagtgtcacagatatgatgcggccaatctctgtctccaaaaacctacctgaacttaatggtagaattcaaagatctggggactgagggcacccagccttctaaaacacaatgtattcatgtgtttagtgtaaactctctgcatggattctcagtgttaataataaaaggaagcattcttttacaactcctgctgtgtgcaaaagaaagtgcaaaggatttggagtggcattccgaagatcaccacacataccttggttctgatggctgctgaactccgacttcttcgctgagacatgactgtgggaacagcctccagctatctgctcatcagaggtgctttcctcaacctcctgcaccacctccaagagaaacagcctaaaaagaaaccccagctgtttacttatattggtctgtaaatccctggaagtaaaccccatgcatttttatctactgtctgaggacatacaataaatctgagaaagtcatatgctgtcac

SEQ ID NO: 36530 - DNA, 2395 bp, Homo sapiens
agcggagctccgctcgcgctctcgccgctcctgccggctcgcccggccccgcgctccgccgtctcctcgccgcccgcccctccgccagccccggggaccgcgcggccgcagcctgagccagggccccctccctcgtcaggaccggggcagcaagcaggccgggggcaggtccgggcacccaccatgcgaggcgagctctggctcctggtgctggtgctcagggaggctgcccgggcgctgagcccccagcccggagcaggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaataccaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgttcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttatttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctcca

SEQ ID NO: 36531 - DNA, 7160 bp, Homo sapiens
cactgacaaaatgacccccattgtgtgacttcagtgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttgcacttcgtgggcagcgctgcccccgaagtgaaatatttcgagagacttctccttccacaccccaggaatatattttcttatactgccagtggggatcttcagctcagagcttcagggaacaacccctgcttccaaacagaccacgaggtaccccagatggaggaatgtgcaaagacgccggggctggagctggaatccgtcccgagacttctcaccttgacctcgaggaaggcaggaggtcggagacagggggtgggcaggctggggaaagaggaaacccgcaggacaagagggttgtggctcgtcacgtggccacttgagggcagcaagtagctgcagctggaggtagctgcctatctgattctgtttgagagtccgccaagttgggatttaaattagacatcaagaagaatttacagaccggccttgccttgttccacggtaaggggacattgggtttagggctggaggaggtagtctctgggactctgggcccggcggaaggaggaaccggcgttctaagagattagagagcctttagttgtttcctttcttaggtgtttttttttcttttcttttcttttttttttttttaacctcagtgccacggaatccgtctcttccagcccacagtgtaccttctcctgtccccgcccatatccctcctcctggaaaatttctccaatggcgctcagcgttcgcacccttcctctccgcggttttctagtccctaggccccagcccactagaagccaggatgccccctcaccccgtctcccactctccagcgccccagctccttgccgtcacaagaacgaagtaggtcaggggagggaagaggcatcttcgtgtcctgacctgattccttgccgtctattaaatatcctacattgcgggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaataccaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgttcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttatttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctccaactccttgtctctcaacgtattggctatgacgcagcaagcagaatgaatttggactcagttacaggctgtcaatggtctgctctgtagcagtctcagagcctccccgacccactacctggagatagccagatagccagatgccctgctcctggccacctttaaagcccctgcatatgacacaggttaactaaagtcaagattggggctgctgcattccaggttccctagactcacaagctggtccttggccaggtgcagtggctcacgcctgtaatcccagcactttgggaggctgaggcaggcggatcacctgaagtcagaagtttgagaccagcctggccaacataattaaaatgtctctactaaaaatacaaaaaattagctgggtgtggtgacgcttgcctgtatcccagctactcaggaagctgagacacgagaatcacttgaacctgggaggcagaggttgcagtgagctcagatagtgccactgcactccagcctgggtgacagagcgagactccgtctcaaaaaaaaaaaaagaaagcagaacctcatggctatagagttggcattttagccccagcttctgtagctctgaaagcctaaagaaggtattctctccatctgttaaacacagtatagtggctctcagcccttggggcatgttatcatgggagggaagtcaaataagaggagagaaaagaactcaagggggaaactgcatttttaggctttgctctcttaccttgccctttctactcagaaccaataacttctgcatcaaaacatgttacagcctgcatcaagggctttaccccaacctgcagcccagccttccctgggtgagcttgctatgcgcagccacatttaccatgtggggctccctattctgatggcctgttcggtgccgggtttactcactgccctgttctgatgtcagtgcctgtacatacctccaaaggcaggacttgcctgataaatatttttcctcctctgaactggattttataggcattaaagacaagtcgggtggctagagggctccttgagacatacctagcagggaactgcaggtggattctgttgagaggcaaagcacctgagtggttgggacacaggcagctggcatgggagggactttttttgagacagggtctcactgtgtcgcccagggcaaggatgcccaaagacaccaggttggagaggcacctgccaactacttgctttccctggagcctgcatgtgcctgtggggtggggaggcgtaggggtctacggctgcctgagatgggtgtgcacagtgtgtgaagtacctacctccttgccttgctggactgtcagccagtcgcagggccggccacaagacccatgtctccatctggtcatactccatagctaccaagttaacctgctctaaactttggagaactggatctgtccaataaacgcttatttggccaagcctgatggctcgtgcctgtactcccagcactttgggaggctgaggtgggagggttgcttgagcccaggggtttgagaccagcttgggcaacaacaacaaaaatgccaggtgtggtggggtgcacctgtagtcccagctactagggaggctgagccaggaggatcacttgagcccgggaggttgaggctgcagtggggggtcataatcatgccactgtactccagcctgggtgacagagtgagaccctgtctccgaaaaaaaaaaaaaaaaaagaacggaaaaagaaatgcttacattgtcagggatcctgtagacaatcattaactctatgagatgcttggttctatttttttgggagactttgtccaagtgttttggcttaagaaatccataggcctctcttggtgacacatctctagtactttttgtcataaacaaacaggccatctgccgccaaatacatccactccccatgccactgacatcctatgggtcagccaggcttgctttgactgaggccgaggcatctggaactttctctgcctgcaggggctagcagcagaggcttcaccgcatcaccaccccttcctccactcctgacattctttcccttcagggatccaaaatggttggccgagctcccagtgggaaaacgtgtgctagagttggggagtgagatgagtggtgctgtccatggaatcaggccacagcaggaactgccccactggccatttgagacacacacaggtggtaaatgctctgctggtgggctgtgcttccctcattcagagagctctgttacagcccactgtgtcctttagaagcttgaaaggaacccaactctttgctgcactgtcctttttcttcctcaaattcagaccctccttccaccggcacccccctactccaccctcagctcttccttgcctggtttatcaagcagagctgaggccccacgtttccaactctgattgtcacttgcatcttcacaaaggataaaccacggagcaactggaaaaccatcagccaagcgttcggatgagtctggttattggtccacccccgaccagattcccttacacttaactcacttctttctttggcaatgaccctcatgacatgtataaatgggtatgactaagaagaggctgtgatctaacatttatttgctgccattttttactctggggagaagcagccccaactcatcactgggaaagaactccccctgcaaaccagctaaatttgataatttaaaccccctgcccctaaaacttctcacagagctggggagttggtggcaactttccaagtcaaggtcttgcttagaaagtccttcactacatggccaggtgcagtggctcacgcctgtagtcccaggtacttgggagcctgaggcaggaggattgcttgagctcaggagttcaaggctgcagagagctatgatcatcccactgcatttgtttaaaaataaatttttaaaatttgtgtgttttatcaggggtctcctgtacagtgtatctgtgtatgtttgtgtgtgtgtttgtatacagccttgtttaatgttttgagcaataagatatgcacacacaggtattttgttgctaaagagattggacaaggttgtagctgtgctcaggcttcagcttggtttgttaaattgagagataaacaatgacaagagctgccagccaaccacactattcaaaaagcaaagtgttcaccactaaagctaaccattcatctggttgcaggcaaggctaaggctctctctcctctagttcctggaacagactcacagattggcatgaagcactgatcaggggctgcactcagactccctggccaagcaaacctacaccagaagagtcagtgtcacagatatgatgcggccaatctctgtctccaaaaacctacctgaacttaatggtagaattcaaagatctggggactgagggcacccagccttctaaaacacaatgtattcatgtgtttagtgtaaactctctgcatggattctcagtgttaataataaaaggaagcattcttttacaactcctgctgtgtgcaaaagaaagtgcaaaggatttggagtggcattccgaagatcaccacacataccttggttctgatggctgctgaactccgacttcttcgctgagacatgactgtgggaacagcctccagctatctgctcatcagaggtgctttcctcaacctcctgcaccacctccaagagaaacagcctaaaaagaaaccccagctgtttacttatattggtctgtaaatccctggaagtaaaccccatgcatttttatctactgtctgaggacatacaataaatctgagaaagtcatatgctgtcac

SEQ ID NO: 36532 - DNA, 6889 bp, Homo sapiens
aacaaacaaaatacacacacacacacacacacacacacacacacacacacacacacaccctgcaggtgattacgatctcaagttctagaggcttacgttaaaatttacacatttgcttctactatttacaagtttatgtttcagcctgagctcttcttgtaagacagaccacgaggtaccccagatggaggaatgtgcaaagacgccggggctggagctggaatccgtcccgagacttctcaccttgacctcgaggaaggcaggaggtcggagacagggggtgggcaggctggggaaagaggaaacccgcaggacaagagggttgtggctcgtcacgtggccacttgagggcagcaagtagctgcagctggaggtagctgcctatctgattctgtttgagagtccgccaagttgggatttaaattagacatcaagaagaatttacagaccggccttgccttgttccacggtaaggggacattgggtttagggctggaggaggtagtctctgggactctgggcccggcggaaggaggaaccggcgttctaagagattagagagcctttagttgtttcctttcttaggtgtttttttttcttttcttttcttttttttttttttaacctcagtgccacggaatccgtctcttccagcccacagtgtaccttctcctgtccccgcccatatccctcctcctggaaaatttctccaatggcgctcagcgttcgcacccttcctctccgcggttttctagtccctaggccccagcccactagaagccaggatgccccctcaccccgtctcccactctccagcgccccagctccttgccgtcacaagaacgaagtaggtcaggggagggaagaggcatcttcgtgtcctgacctgattccttgccgtctattaaatatcctacattgcgggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaataccaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgttcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttatttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctccaactccttgtctctcaacgtattggctatgacgcagcaagcagaatgaatttggactcagttacaggctgtcaatggtctgctctgtagcagtctcagagcctccccgacccactacctggagatagccagatagccagatgccctgctcctggccacctttaaagcccctgcatatgacacaggttaactaaagtcaagattggggctgctgcattccaggttccctagactcacaagctggtccttggccaggtgcagtggctcacgcctgtaatcccagcactttgggaggctgaggcaggcggatcacctgaagtcagaagtttgagaccagcctggccaacataattaaaatgtctctactaaaaatacaaaaaattagctgggtgtggtgacgcttgcctgtatcccagctactcaggaagctgagacacgagaatcacttgaacctgggaggcagaggttgcagtgagctcagatagtgccactgcactccagcctgggtgacagagcgagactccgtctcaaaaaaaaaaaaagaaagcagaacctcatggctatagagttggcattttagccccagcttctgtagctctgaaagcctaaagaaggtattctctccatctgttaaacacagtatagtggctctcagcccttggggcatgttatcatgggagggaagtcaaataagaggagagaaaagaactcaagggggaaactgcatttttaggctttgctctcttaccttgccctttctactcagaaccaataacttctgcatcaaaacatgttacagcctgcatcaagggctttaccccaacctgcagcccagccttccctgggtgagcttgctatgcgcagccacatttaccatgtggggctccctattctgatggcctgttcggtgccgggtttactcactgccctgttctgatgtcagtgcctgtacatacctccaaaggcaggacttgcctgataaatatttttcctcctctgaactggattttataggcattaaagacaagtcgggtggctagagggctccttgagacatacctagcagggaactgcaggtggattctgttgagaggcaaagcacctgagtggttgggacacaggcagctggcatgggagggactttttttgagacagggtctcactgtgtcgcccagggcaaggatgcccaaagacaccaggttggagaggcacctgccaactacttgctttccctggagcctgcatgtgcctgtggggtggggaggcgtaggggtctacggctgcctgagatgggtgtgcacagtgtgtgaagtacctacctccttgccttgctggactgtcagccagtcgcagggccggccacaagacccatgtctccatctggtcatactccatagctaccaagttaacctgctctaaactttggagaactggatctgtccaataaacgcttatttggccaagcctgatggctcgtgcctgtactcccagcactttgggaggctgaggtgggagggttgcttgagcccaggggtttgagaccagcttgggcaacaacaacaaaaatgccaggtgtggtggggtgcacctgtagtcccagctactagggaggctgagccaggaggatcacttgagcccgggaggttgaggctgcagtggggggtcataatcatgccactgtactccagcctgggtgacagagtgagaccctgtctccgaaaaaaaaaaaaaaaaaagaacggaaaaagaaatgcttacattgtcagggatcctgtagacaatcattaactctatgagatgcttggttctatttttttgggagactttgtccaagtgttttggcttaagaaatccataggcctctcttggtgacacatctctagtactttttgtcataaacaaacaggccatctgccgccaaatacatccactccccatgccactgacatcctatgggtcagccaggcttgctttgactgaggccgaggcatctggaactttctctgcctgcaggggctagcagcagaggcttcaccgcatcaccaccccttcctccactcctgacattctttcccttcagggatccaaaatggttggccgagctcccagtgggaaaacgtgtgctagagttggggagtgagatgagtggtgctgtccatggaatcaggccacagcaggaactgccccactggccatttgagacacacacaggtggtaaatgctctgctggtgggctgtgcttccctcattcagagagctctgttacagcccactgtgtcctttagaagcttgaaaggaacccaactctttgctgcactgtcctttttcttcctcaaattcagaccctccttccaccggcacccccctactccaccctcagctcttccttgcctggtttatcaagcagagctgaggccccacgtttccaactctgattgtcacttgcatcttcacaaaggataaaccacggagcaactggaaaaccatcagccaagcgttcggatgagtctggttattggtccacccccgaccagattcccttacacttaactcacttctttctttggcaatgaccctcatgacatgtataaatgggtatgactaagaagaggctgtgatctaacatttatttgctgccattttttactctggggagaagcagccccaactcatcactgggaaagaactccccctgcaaaccagctaaatttgataatttaaaccccctgcccctaaaacttctcacagagctggggagttggtggcaactttccaagtcaaggtcttgcttagaaagtccttcactacatggccaggtgcagtggctcacgcctgtagtcccaggtacttgggagcctgaggcaggaggattgcttgagctcaggagttcaaggctgcagagagctatgatcatcccactgcatttgtttaaaaataaatttttaaaatttgtgtgttttatcaggggtctcctgtacagtgtatctgtgtatgtttgtgtgtgtgtttgtatacagccttgtttaatgttttgagcaataagatatgcacacacaggtattttgttgctaaagagattggacaaggttgtagctgtgctcaggcttcagcttggtttgttaaattgagagataaacaatgacaagagctgccagccaaccacactattcaaaaagcaaagtgttcaccactaaagctaaccattcatctggttgcaggcaaggctaaggctctctctcctctagttcctggaacagactcacagattggcatgaagcactgatcaggggctgcactcagactccctggccaagcaaacctacaccagaagagtcagtgtcacagatatgatgcggccaatctctgtctccaaaaacctacctgaacttaatggtagaattcaaagatctggggactgagggcacccagccttctaaaacacaatgtattcatgtgtttagtgtaaactctctgcatggattctcagtgttaataataaaaggaagcattcttttacaactcctgctgtgtgcaaaagaaagtgcaaaggatttggagtggcattccgaagatcaccacacataccttggttctgatggctgctgaactccgacttcttcgctgagacatgactgtgggaacagcctccagctatctgctcatcagaggtgctttcctcaacctcctgcaccacctccaagagaaacagcctaaaaagaaaccccagctgtttacttatattggtctgtaaatccctggaagtaaaccccatgcatttttatctactgtctgaggacatacaataaatctgagaaagtcatatgctgtcac

SEQ ID NO: 36533 - DNA, 5122 bp, Homo sapiens
cttggctcctcttctcactatcagcagagagctgttactgaacagtgaaaggggaaggcttctttgtcaatcccatcataactctgtccttttggtcctcctgcagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaaggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgttcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttatttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctccaactccttgtctctcaacgtattggctatgacgcagcaagcagaatgaatttggactcagttacaggctgtcaatggtctgctctgtagcagtctcagagcctccccgacccactacctggagatagccagatagccagatgccctgctcctggccacctttaaagcccctgcatatgacacaggttaactaaagtcaagattggggctgctgcattccaggttccctagactcacaagctggtccttggccaggtgcagtggctcacgcctgtaatcccagcactttgggaggctgaggcaggcggatcacctgaagtcagaagtttgagaccagcctggccaacataattaaaatgtctctactaaaaatacaaaaaattagctgggtgtggtgacgcttgcctgtatcccagctactcaggaagctgagacacgagaatcacttgaacctgggaggcagaggttgcagtgagctcagatagtgccactgcactccagcctgggtgacagagcgagactccgtctcaaaaaaaaaaaaagaaagcagaacctcatggctatagagttggcattttagccccagcttctgtagctctgaaagcctaaagaaggtattctctccatctgttaaacacagtatagtggctctcagcccttggggcatgttatcatgggagggaagtcaaataagaggagagaaaagaactcaagggggaaactgcatttttaggctttgctctcttaccttgccctttctactcagaaccaataacttctgcatcaaaacatgttacagcctgcatcaagggctttaccccaacctgcagcccagccttccctgggtgagcttgctatgcgcagccacatttaccatgtggggctccctattctgatggcctgttcggtgccgggtttactcactgccctgttctgatgtcagtgcctgtacatacctccaaaggcaggacttgcctgataaatatttttcctcctctgaactggattttataggcattaaagacaagtcgggtggctagagggctccttgagacatacctagcagggaactgcaggtggattctgttgagaggcaaagcacctgagtggttgggacacaggcagctggcatgggagggactttttttgagacagggtctcactgtgtcgcccagggcaaggatgcccaaagacaccaggttggagaggcacctgccaactacttgctttccctggagcctgcatgtgcctgtggggtggggaggcgtaggggtctacggctgcctgagatgggtgtgcacagtgtgtgaagtacctacctccttgccttgctggactgtcagccagtcgcagggccggccacaagacccatgtctccatctggtcatactccatagctaccaagttaacctgctctaaactttggagaactggatctgtccaataaacgcttatttggccaagcctgatggctcgtgcctgtactcccagcactttgggaggctgaggtgggagggttgcttgagcccaggggtttgagaccagcttgggcaacaacaacaaaaatgccaggtgtggtggggtgcacctgtagtcccagctactagggaggctgagccaggaggatcacttgagcccgggaggttgaggctgcagtggggggtcataatcatgccactgtactccagcctgggtgacagagtgagaccctgtctccgaaaaaaaaaaaaaaaaaagaacggaaaaagaaatgcttacattgtcagggatcctgtagacaatcattaactctatgagatgcttggttctatttttttgggagactttgtccaagtgttttggcttaagaaatccataggcctctcttggtgacacatctctagtactttttgtcataaacaaacaggccatctgccgccaaatacatccactccccatgccactgacatcctatgggtcagccaggcttgctttgactgaggccgaggcatctggaactttctctgcctgcaggggctagcagcagaggcttcaccgcatcaccaccccttcctccactcctgacattctttcccttcagggatccaaaatggttggccgagctcccagtgggaaaacgtgtgctagagttggggagtgagatgagtggtgctgtccatggaatcaggccacagcaggaactgccccactggccatttgagacacacacaggtggtaaatgctctgctggtgggctgtgcttccctcattcagagagctctgttacagcccactgtgtcctttagaagcttgaaaggaacccaactctttgctgcactgtcctttttcttcctcaaattcagaccctccttccaccggcacccccctactccaccctcagctcttccttgcctggtttatcaagcagagctgaggccccacgtttccaactctgattgtcacttgcatcttcacaaaggataaaccacggagcaactggaaaaccatcagccaagcgttcggatgagtctggttattggtccacccccgaccagattcccttacacttaactcacttctttctttggcaatgaccctcatgacatgtataaatgggtatgactaagaagaggctgtgatctaacatttatttgctgccattttttactctggggagaagcagccccaactcatcactgggaaagaactccccctgcaaaccagctaaatttgataatttaaaccccctgcccctaaaacttctcacagagctggggagttggtggcaactttccaagtcaaggtcttgcttagaaagtccttcactacatggccaggtgcagtggctcacgcctgtagtcccaggtacttgggagcctgaggcaggaggattgcttgagctcaggagttcaaggctgcagagagctatgatcatcccactgcatttgtttaaaaataaatttttaaaatttgtgtgttttatcaggggtctcctgtacagtgtatctgtgtatgtttgtgtgtgtgtttgtatacagccttgtttaatgttttgagcaataagatatgcacacacaggtattttgttgctaaagagattggacaaggttgtagctgtgctcaggcttcagcttggtttgttaaattgagagataaacaatgacaagagctgccagccaaccacactattcaaaaagcaaagtgttcaccactaaagctaaccattcatctggttgcaggcaaggctaaggctctctctcctctagttcctggaacagactcacagattggcatgaagcactgatcaggggctgcactcagactccctggccaagcaaacctacaccagaagagtcagtgtcacagatatgatgcggccaatctctgtctccaaaaacctacctgaacttaatggtagaattcaaagatctggggactgagggcacccagccttctaaaacacaatgtattcatgtgtttagtgtaaactctctgcatggattctcagtgttaataataaaaggaagcattcttttacaactcctgctgtgtgcaaaagaaagtgcaaaggatttggagtggcattccgaagatcaccacacataccttggttctgatggctgctgaactccgacttcttcgctgagacatgactgtgggaacagcctccagctatctgctcatcagaggtgctttcctcaacctcctgcaccacctccaagagaaacagcctaaaaagaaaccccagctgtttacttatattggtctgtaaatccctggaagtaaaccccatgcatttttatctactgtctgaggacatacaataaatctgagaaagtcatatgctgtcac

SEQ ID NO: 36534 - DNA, 1101 bp, Homo sapiens
  misc_feature (1094)..(1094): n is a, c, g, or t
agcggagctccgctcgcgctctcgccgctcctgccggctcgcccggccccgcgctccgccgtctcctcgccgcccgcccctccgccagccccggggaccgcgcggccgcagcctgagccagggccccctccctcgtcaggaccggggcagcaagcaggccgggggcaggtccgggcacccaccatgcgaggcgagctctggctcctggtgctggtgctcagggaggctgcccgggcgctgagcccccagcccggagcaggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagcttttcagcagagtctgcaaagcatctttggtgaaaagaaaagtcatgtgcaattagcagcatctggtttgcagaggcactcaaaacacacaggacagtntgatccg

SEQ ID NO: 36535 - DNA, 1395 bp, Homo sapiens
cactgacaaaatgacccccattgtgtgacttcagtgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttgcacttcgtgggcagcgctgcccccgaagtgaaatatttcgagagacttctccttccacaccccaggaatatattttcttatactgccagtggggatcttcagctcagagcttcagggaacaacccctgcttccaaacagaccacgaggtaccccagatggaggaatgtgcaaagacgccggggctggagctggaatccgtcccgagacttctcaccttgacctcgaggaaggcaggaggtcggagacagggggtgggcaggctggggaaagaggaaacccgcaggacaagagggttgtggctcgtcacgtggccacttgagggcagcaagtagctgcagctggaggtagctgcctatctgattctgtttgagagtccgccaagttgggatttaaattagacatcaagaagaatttacagaccggccttgccttgttccacggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggtgtgggaagggaccggcagcactggcagtgcctgggagctcgtgggaaatgtggaatgtcggagtcctcagacctgcagaatcagaatccgattcccaggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtcttagtgggtcagtgggacacgtatatctcca

SEQ ID NO: 36536 - DNA, 1252 bp, Homo sapiens
cactgacaaaatgacccccattgtgtgacttcagtgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttgcacttcgtgggcagcgctgcccccgaagtgaaatatttcgagagacttctccttccacaccccaggaatatattttcttatactgccagtggggatcttcagctcagagcttcagggaacaacccctgcttccaaacagaccacgaggtaccccagatggaggaatgtgcaaagacgccggggctggagctggaatccgtcccgagacttctcaccttgacctcgaggaaggcaggaggtcggagacagggggtgggcaggctggggaaagaggaaacccgcaggacaagagggttgtggctcgtcacgtggccacttgagggcagcaagtagctgcagctggaggtagctgcctatctgattctgtttgagagtccgccaagttgggatttaaattagacatcaagaagaatttacagaccggccttgccttgttccacggtaaggggacattgggtttagggctggaggaggtagtctctgggactctgggcccggcggaaggaggaaccggcgttctaagagattagagagcctttagttgtttcctttcttaggtgtttttttttcttttcttttcttttttttttttttaacctcagtgccacggaatccgtctcttccagcccacagtgtaccttctcctgtccccgcccatatccctcctcctggaaaatttctccaatggcgctcagcgttcgcacccttcctctccgcggttttctagtccctaggccccagcccactagaagccaggatgccccctcaccccgtctcccactctccagcgccccagctccttgccgtcacaagaacgaagtaggtcaggggagggaagaggcatcttcgtgtcctgacctgattccttgccgtctattaaatatcctacattgcgggtatttttattctgtcctggaagaaaaaataaaaagattatctatccccagagcctg

SEQ ID NO: 36537 - DNA, 325 bp, Homo sapiens
tcaagaacatgaatgccttactcataatgattccaactcccacccaacctcttcctgtattggataagtggacccaaaggctctgtcggctttcatctctgagactttgttagaacccaagaccccatggttcgaccttccctgctcccctgcagcccctgtctgccctaatgatctctccacaggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaat

SEQ ID NO: 36538 - DNA, 641 bp, Homo sapiens
agcggagctccgctcgcgctctcgccgctcctgccggctcgcccggccccgcgctccgccgtctcctcgccgcccgcccctccgccagccccggggaccgcgcggccgcagcctgagccagggccccctccctcgtcaggaccggggcagcaagcaggccgggggcaggtccgggcacccaccatgcgaggcgagctctggctcctggtgctggtgctcagggaggctgcccgggcgctgagcccccagcccggagcaggtaggactggcgggagccggcccgggtgggccgggggcggggagggacgggcagtcaggtgtgggcatgggcaggtgtggacggcctggcgatgtccgcgaggggggcattgtccgcaggaggccaggagagctgtgggctgtgggcaggtggatagggaccccactttcccaaacacatagggtgtgtgagtgacggtggagacaccgatgcccggacctctccttctctcctggaaggatactggagggaccttaggagagggggctctatgtggccatgggctctgaaaggggacagcgggagagtcatcaggacccctgatcaccccaggcaaggctgaattctgatgagatgggagcctggggaggcccctgcccca

SEQ ID NO: 36539 - DNA, 7260 bp, Homo sapiens
cactgacaaaatgacccccattgtgtgacttcagtgagacacattacctgaatgagcaggtgaaagccatcaaagaattgggtgaccacgtgaccaacttgcgcaagatgggagcgcccgaatctggcttggcggaatatctctttgacaagcacaccctgggagacagtgataatgaaagctaagcctcgggctaatttccccatagccgtggggtgacttccctggtcaccaaggcagtgcatgcatgttggggtttcctttaccttttctataagttgtaccaaaacatccacttgcacttcgtgggcagcgctgcccccgaagtgaaatatttcgagagacttctccttccacaccccaggaatatattttcttatactgccagtggggatcttcagctcagagcttcagggaacaacccctgcttccaaacagaccacgaggtaccccagatggaggaatgtgcaaagacgccggggctggagctggaatccgtcccgagacttctcaccttgacctcgaggaaggcaggaggtcggagacagggggtgggcaggctggggaaagaggaaacccgcaggacaagagggttgtggctcgtcacgtggccacttgagggcagcaagtagctgcagctggaggtagctgcctatctgattctgtttgagagtccgccaagttgggatttaaattagacatcaagaagaatttacagaccggccttgccttgttccacggtaaggggacattgggtttagggctggaggaggtagtctctgggactctgggcccggcggaaggaggaaccggcgttctaagagattagagagcctttagttgtttcctttcttaggtgtttttttttcttttcttttcttttttttttttttaacctcagtgccacggaatccgtctcttccagcccacagtgtaccttctcctgtccccgcccatatccctcctcctggaaaatttctccaatggcgctcagcgttcgcacccttcctctccgcggttttctagtccctaggccccagcccactagaagccaggatgccccctcaccccgtctcccactctccagcgccccagctccttgccgtcacaagaacgaagtaggtcaggggagggaagaggcatcttcgtgtcctgacctgattccttgccgtctattaaatatcctacattgcgggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggtgtgggaagggaccggcagcactggcagtgcctgggagctcgtgggaaatgtggaatgtcggagtcctcagacctgcagaatcagaatccgattcccaggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaataccaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgttcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttatttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctccaactccttgtctctcaacgtattggctatgacgcagcaagcagaatgaatttggactcagttacaggctgtcaatggtctgctctgtagcagtctcagagcctccccgacccactacctggagatagccagatagccagatgccctgctcctggccacctttaaagcccctgcatatgacacaggttaactaaagtcaagattggggctgctgcattccaggttccctagactcacaagctggtccttggccaggtgcagtggctcacgcctgtaatcccagcactttgggaggctgaggcaggcggatcacctgaagtcagaagtttgagaccagcctggccaacataattaaaatgtctctactaaaaatacaaaaaattagctgggtgtggtgacgcttgcctgtatcccagctactcaggaagctgagacacgagaatcacttgaacctgggaggcagaggttgcagtgagctcagatagtgccactgcactccagcctgggtgacagagcgagactccgtctcaaaaaaaaaaaaagaaagcagaacctcatggctatagagttggcattttagccccagcttctgtagctctgaaagcctaaagaaggtattctctccatctgttaaacacagtatagtggctctcagcccttggggcatgttatcatgggagggaagtcaaataagaggagagaaaagaactcaagggggaaactgcatttttaggctttgctctcttaccttgccctttctactcagaaccaataacttctgcatcaaaacatgttacagcctgcatcaagggctttaccccaacctgcagcccagccttccctgggtgagcttgctatgcgcagccacatttaccatgtggggctccctattctgatggcctgttcggtgccgggtttactcactgccctgttctgatgtcagtgcctgtacatacctccaaaggcaggacttgcctgataaatatttttcctcctctgaactggattttataggcattaaagacaagtcgggtggctagagggctccttgagacatacctagcagggaactgcaggtggattctgttgagaggcaaagcacctgagtggttgggacacaggcagctggcatgggagggactttttttgagacagggtctcactgtgtcgcccagggcaaggatgcccaaagacaccaggttggagaggcacctgccaactacttgctttccctggagcctgcatgtgcctgtggggtggggaggcgtaggggtctacggctgcctgagatgggtgtgcacagtgtgtgaagtacctacctccttgccttgctggactgtcagccagtcgcagggccggccacaagacccatgtctccatctggtcatactccatagctaccaagttaacctgctctaaactttggagaactggatctgtccaataaacgcttatttggccaagcctgatggctcgtgcctgtactcccagcactttgggaggctgaggtgggagggttgcttgagcccaggggtttgagaccagcttgggcaacaacaacaaaaatgccaggtgtggtggggtgcacctgtagtcccagctactagggaggctgagccaggaggatcacttgagcccgggaggttgaggctgcagtggggggtcataatcatgccactgtactccagcctgggtgacagagtgagaccctgtctccgaaaaaaaaaaaaaaaaaagaacggaaaaagaaatgcttacattgtcagggatcctgtagacaatcattaactctatgagatgcttggttctatttttttgggagactttgtccaagtgttttggcttaagaaatccataggcctctcttggtgacacatctctagtactttttgtcataaacaaacaggccatctgccgccaaatacatccactccccatgccactgacatcctatgggtcagccaggcttgctttgactgaggccgaggcatctggaactttctctgcctgcaggggctagcagcagaggcttcaccgcatcaccaccccttcctccactcctgacattctttcccttcagggatccaaaatggttggccgagctcccagtgggaaaacgtgtgctagagttggggagtgagatgagtggtgctgtccatggaatcaggccacagcaggaactgccccactggccatttgagacacacacaggtggtaaatgctctgctggtgggctgtgcttccctcattcagagagctctgttacagcccactgtgtcctttagaagcttgaaaggaacccaactctttgctgcactgtcctttttcttcctcaaattcagaccctccttccaccggcacccccctactccaccctcagctcttccttgcctggtttatcaagcagagctgaggccccacgtttccaactctgattgtcacttgcatcttcacaaaggataaaccacggagcaactggaaaaccatcagccaagcgttcggatgagtctggttattggtccacccccgaccagattcccttacacttaactcacttctttctttggcaatgaccctcatgacatgtataaatgggtatgactaagaagaggctgtgatctaacatttatttgctgccattttttactctggggagaagcagccccaactcatcactgggaaagaactccccctgcaaaccagctaaatttgataatttaaaccccctgcccctaaaacttctcacagagctggggagttggtggcaactttccaagtcaaggtcttgcttagaaagtccttcactacatggccaggtgcagtggctcacgcctgtagtcccaggtacttgggagcctgaggcaggaggattgcttgagctcaggagttcaaggctgcagagagctatgatcatcccactgcatttgtttaaaaataaatttttaaaatttgtgtgttttatcaggggtctcctgtacagtgtatctgtgtatgtttgtgtgtgtgtttgtatacagccttgtttaatgttttgagcaataagatatgcacacacaggtattttgttgctaaagagattggacaaggttgtagctgtgctcaggcttcagcttggtttgttaaattgagagataaacaatgacaagagctgccagccaaccacactattcaaaaagcaaagtgttcaccactaaagctaaccattcatctggttgcaggcaaggctaaggctctctctcctctagttcctggaacagactcacagattggcatgaagcactgatcaggggctgcactcagactccctggccaagcaaacctacaccagaagagtcagtgtcacagatatgatgcggccaatctctgtctccaaaaacctacctgaacttaatggtagaattcaaagatctggggactgagggcacccagccttctaaaacacaatgtattcatgtgtttagtgtaaactctctgcatggattctcagtgttaataataaaaggaagcattcttttacaactcctgctgtgtgcaaaagaaagtgcaaaggatttggagtggcattccgaagatcaccacacataccttggttctgatggctgctgaactccgacttcttcgctgagacatgactgtgggaacagcctccagctatctgctcatcagaggtgctttcctcaacctcctgcaccacctccaagagaaacagcctaaaaagaaaccccagctgtttacttatattggtctgtaaatccctggaagtaaaccccatgcatttttatctactgtctgaggacatacaataaatctgagaaagtcatatgctgtcac

SEQ ID NO: 36540 - DNA, 1282 bp, Homo sapiens
agcggagctccgctcgcgctctcgccgctcctgccggctcgcccggccccgcgctccgccgtctcctcgccgcccgcccctccgccagccccggggaccgcgcggccgcagcctgagccagggccccctccctcgtcaggaccggggcagcaagcaggccgggggcaggtccgggcacccaccatgcgaggcgagctctggctcctggtgctggtgctcagggaggctgcccgggcgctgagcccccagcccggagcaggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaataccaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagaggtccctcaacaaccaggatgaaaacacgtatgtgaattgcctggattctcagcagtgtcacggcagctcagagtcaaggcgaccttgaggatcactggagctcatgcagt

SEQ ID NO: 36541 - DNA, 353 bp, Homo sapiens
ttatttatttatttgtttatttttgagacagagtcttgttttgttgccaggctggagtccaatggcgtgatctcagctcactgcaacctccgcctccttggttcaagcgattctcctgcctcagcctcctgagtagctgggattgcaggctcacaccaccatgcccagctaattttttgtatttttagtagagacaggatttcaccatgttggccaagatggtcttgatctcctgacctcatgatccgcctgcctcggcctcccaaaatgctaggattacaggagtgagccactgcgcctggcccacaatttaaggggcataatctcattgtgatcatgacggccaccatcgc

SEQ ID NO: 36542 - DNA, 468 bp, Homo sapiens
atgatttcttggaaagagagaatatggtgttgagagtcacggtaaatgtaagtctacagagtggccacgtgggtttcagggactcttaaaatgcatgaggttccactgagtccagacaactatctatcttaacggtctggaacaatgaccacccacataagatcaaaaacctgagatctgatccttctagttttgtcaaatggctcagattattttaagcttcctctttagataaaatgcagtttgactcaccggttttttttcttttcataaaggctactgtgagggagtagggcatcctcctgcaacaagcagcggagagagaaatcagtccccagccctgaccctcggatctctggtaaaacactcagtcatgagacacgagacctctggccacatgccctgatccatggactcagacagaaagtcctctcctgcatcttggggtccagaagaggccaggaagca

SEQ ID NO: 36543 - DNA, 320 bp, Homo sapiens
tctttagtcattcatcagatttactaaattcacactatgttcaaggaccttggcttgctgttgacacagggttcacagtggcactgtccctggtcttgaggtgctcacagtctgaaggagagatgtgtacaaataactgtgccctgtggtaaacaccatcagtgtccaacttattgagaaagtgtagaggagagaacaaaaatgtcagactctgcctagagagctcagggaagtcagcccaggctgaaatacagtgatgcagtcatggcttactacagccttggcctcctgggcccaagcaatcctcccacttcagcctt

SEQ ID NO: 36544 - DNA, 405 bp, Homo sapiens
atattatgtgtttttgataaagcagtggtaagggaaagcaaatctgatttattgagatcctttctaatatgtgttggatggatttcagtaagtttcctgataactctgaaagtgagaaaagccgggcgcggtggctcacccttgtaaccccagcactttgggaggctgaggcgggcagatcacgagatcaggagatcgagaccacggtgaaaccccgtctctactaaaagtacaaaaaattagccgggtatggtggcgggcacctgtagtcccagctagaggttgaggcaggagaatggtgtgaacccaggaggcggagcttgcagtgagctgagatcgcgccacttcactctagcctggccaacagagcgagactccgtctcaaaaaaaaaaaaaaatcttaca

SEQ ID NO: 36545 - DNA, 125 bp, Homo sapiens
tatcttatagacactgtgggctgttactgtgcaggcccaagagaaggaaacaagtgagccccgccatccccccctcagaaggctgctgtcacactactgtcaaatctcgctggactttggagagg

SEQ ID NO: 36546 - DNA, 295 bp, Homo sapiens
tgaaaatactgtgaggtttaacaatgaaggcaggtgactggtgaggagagttccagccactggattctccctcagtcccctgtgctgtggcccttggtgacccctagatttcagtgcccctgcctgacactggagtccctctataaagaagcccctttctagctagctagctgttccatcccgcacacccccacagaagccttttgctgccattagtaagcacgcctctattttctcacctgtgattgatcatgcatgattgagttttgtctattaaagcaattgttaagttact

SEQ ID NO: 36547 - DNA, 454 bp, Homo sapiens
gtctcactatgttgcccaggctggtctcaagggatcccctgcctttgcctcccaaagtactgggatcacaggcatgaaccactgcacctggctgagagttagtgtttaataggtgcaaagcttcagttggggaagattaaaaaaaagttctggagatggacggtggtgatgattgcacaacgtgaatctacttcatgccactgggctgcacacttacaaatggttacaatgttagttgcctcacagcctgaacaagtaaaatggaagctgtaattaaccttaaaaatatatatgtgtctgagatataattgtatataagtatatgtatacagacatgtaaactatttgttaaaaaagaaactagaacaaaaatattttacatttacctggaaaatggttaaaatggtaaatgttatagtatgtatattttactacaataaaaatgaataaattt

SEQ ID NO: 36548 - DNA, 382 bp, Homo sapiens
atcagtttcctgcgtcgactgtaagcagttttgataatccttgtcatatgtgattacatttcccccccttcccataacatctcagtgtaattggtttgataaactagacctcagtccggtagtttgcttgcaatatattttcaccttctatctgtgtgactaagatggttttgaatggctttgcatggagaaaatcaggctttgagcaccaggtccttagtttcggaaacaaatcacccagggcaggcagcacaggtctgggagagctgggaatcccagttaagcctcaggagaatcgcttgaacctgggaggcggaggttgcaataagctgagatcgcaccactgcactccagcctcggcaacagagtgagactccgtctc

SEQ ID NO: 36549 - DNA, 368 bp, Homo sapiens
tagctcttgtgtagcctaacatttccgcctgaatgtttgccattttgttctattctgtaacattgtttttgacctctaatttcattttgcaatgatctcagcactgggtttatctttacaaatgaaatggtgagaaacgctttgctgaatcttcacaactggttcaatcacatgggacagtggaatcagagacatgaggttgcgggaaccattatggggttagaatggataagggaaagagaaagaaaaaatagcagaagccatgacttgctcttgtaggtttgctttgtatgacactctttttcttctgtcactgcatcagacagatatgtttagatacaccatgtattaataaatggtttcctcgg

SEQ ID NO: 36550 - DNA, 419 bp, Homo sapiens
gatgagtcacggtaatgaagagacactttgagacactttggacttttttgtaattgtctttactcatttattttctatggaacaaagctcatttcccagccatcaactcaaggtatttggcttcccttagtatggcaaacctaaggcaaaccaaaggaaaaaggttttcgttttttgtttgtaacttccttatagtgtctaatggctcttaaacagttttctctgggtacattttacatgagtacataagtagatgtactatattttactaagtaatgtgcttcggaaaatttttgtgtaaattaatgttttgaaaatgaaaatattgtaaatataagaacatgatatttatagggattataaacacattttttttttttttttgagatagaatttcgctcttgttgcccaggctgagg

SEQ ID NO: 36551 - DNA, 5564 bp, Homo sapiens
tgtccttcctttgagcagccactgagagggagaaggagttgcagagatcaggaaggagaggatttatttccagttttctggcagtttttcctcactctttcggagacctaggatgggttaggagagggcatggcaaaggcagaggtggctctgctagaggaggccgcaggtccgcaggccgaacctggggagccagccatgtctggcctgaggccctgctttgaggagaagataaagccttgaggagccttttgggccgatctgggaacccagcaagactagattagcctgactgatgacagacctgggatgaggatgagggcagttaagtatttgtttaatcttgctttgtcttttcaaacagcgatttagtaatcctgtttgaggctgcagtgtggcaatgctttccagaggatggagtcctttttgtttgttttgaaaaaatagagatggggtttcactatgttgcctaggctggtctcatactcggcctcgagccatcctcctgcctgggcctcccaaagtgttgggattacaggcgtgagccatggtgccagactggagtccttttattaaaattaactgccctgctcagctttctgctgggccaccccagagccaatccttggttcttgggcccaaggctggacccaggggttgcaggaaacagtctgtagcatccaagtggggcctgtcgtacccactccagtgtgtaggtgcagaacgctctttgggggatttctctgctgggccaccttactccagggatccctcagttttcaaaacaaagcaagagggcaaggaagaatggagaaacagctcagtgttgactctcttccccctggtgagtgctgtgctggggcctctgtgcacatcataccacttcccccttgaatcagccccacaaggcagggtgagagatgaggactcagggtgcaaggaggtctcacagcttggaaatggatcaggacagctctgattctccaaggccaaggtcttctctatatcatgaggcagcccaaaaatgtgtttctacacatattctgtgtagaaactcaggccaggctcctatatgctctgggtgacagcgggaaggtgctttccagtgtgtatcagtgtggcccatctgggagtcataatgtcattgcctcttccaaaatatcagcaaagctgaccctagtgcttgtagtgctcaaatgcacctctctgcctttgtgccatagggaaatggatttggtcctgggggtggtgataccaacttctgtctcaattccatgaccctcactcagcacccccaccccaggcctgtgcagaggaggaataaccgtccttgagaaccatccagccctaggtggagaaattagatttatggacttaatcagttcttcttccctgtcagtggtggtgagaatgacatgggggaaattgataagcctcagtcatgttttcctgcgagacaaggcagctttggtagctggtgggactgacgccttcttcacctgtgtcctctgcctctgagtgactataaattgcgaaccccatgaggtggcacctgcagccacagatcgcttaggcaccttgcacagggggccacctaatgaactggctgcaggacggcaatcctgccgtgaagccaggcacctcgggaggggcaaggtggcagaaccgagagagcagatgctccttgctgtttctgtaaggccaccagtggctgggtggcctggccctggtagcaaggtggtaaccgtgtgagtggctgaatcctgcaccacttttcctgagcctccttcctcctggattcctgcaactatattctcactacatggctcaccaccaattcgttctctctgccccaaggaggctggacaagaggctcaggtcagtgcgggtacgcaggaacctatgtctgtaaaatgaaaatgcctgccttcaagggctgtcttgaggttgaaaggagatggtctacatcaagggttaggaagaccacaatgtggctgtgccggccacctccaggctggcttcagtctcccatccccatagtcatacccctgtgaagtcccttcccatactgaatcgggctacctgtgtatcttatagggtgttggaaatgacagattgtgaattccaaggccccataaaagacagcgtgggctgggcgtggtggctcacgcctgtaatcccagcactttgggaggccgagccaagtggatcacttgaggtcaggagttctagaccagcctggccagcatggtgaaaacctatctctactaaaaatacaaaaaaaaaaatttagccaggtgtgttggcacctgtgcctgtagtcccagatacttgggaggctgagccaggagaatcacttgaacctgagaggtggaggtttcagtgagccgagattgtgccactgcactccagctgggtggcagagactctgtctctaaacaaagaaaatgtggtttctgctgtcctttctcttggatcactttctctgggaaaccagccaccatcttgtgaggacactcaagctctctggaaaggttcagaaatgtggtgaggaagtgagacagacctcttgccaaaaaccatgtactaacttatcagtcacgtacatgagttgacttagaaatgactctatcagcctcagccaaaccttcagatgactgcagccctggtcaacatcttgactgtgaccccatggaagaccctgaaacactcagccaagccactctcagcttcctgatccacagaagcagcatgaaataataaatttttcttgttttaaactaagttttgggttaatttgttatacagctgtagataactccaagaataatactccataaatgttgatttcctttctgcggctccactgagtcatctttgttcatgggcaaagctcactgtctctctactggctgcaaaagatgtccatttgttggctctgactcatgcttgtggtcttgttggctcacagcaaggccttttcacagaggatggtggtttgtcacactcagaatccaggtcttacctgctttcctgctccatggaattttgacctgagtttgaaggctgataggggattgatggatgagggagaaagacacagtcagttcttagagcagtagctaatccaggggtttctctggctttgtttgcatgagtagtgatagttggggatgaagcatgggtattcgagatcttttttgtgtgagtatgggaggaaaaattctgttctcttcctcctccatctttattcatctttgtcttccctcggatcagctttaaagacccctgagactctaggactcggtttgcttttttctcaccactgggatccatctcccactagtaggaagaaggatctaagtagttgagctgcataaaggggaagtaaacagccagacaaatgttacattttagagccttgagtgacccagagctttctatcagcttcattgggtgcagggagggtagcgatttctggctgctgtcacctccttgctcatatcaggaagcgctaattttgaggcaaagttcagtgccctctggctcacctagggcccctgttgcctaatttcacgaggccaagagtttgagggtgggttcggggctgcgcagcctggatgccttggtttgcatgcctacagcagctgtgcccgaaagctttttttagagtaaatatgtagcttttgctaggctttttgtgtgccttgttcattcctctatcattttttgtatacctgctatggtgtcaggcactggggatacaaattagccggggactcggacatgtaagcaagtaagcccaacagcagctaacatttatgcagtgctcactgtgtgcttggatgtccagagtgatagagcaggtttagtaagggggacagagggctgagaccagaggcaaggtggagaagggcatttctggaggcagcaatatgagtgcaaaggagacatacacaaggttccctgggggattccaagttgttgctgtcgtggcttcaaatcttactttagggcctactcagatggcatcttgttcatgaagatgtgcctgttttttgttttatttgtccctctccccccaacaaagagtaaactttttttctgaacttctcgaaagtttgctaacatcagctataaaactctctgggcctgggatattttgcggggagcagggaagatctttgattatcattttaacttatttctgttcatttattcaagctttttcttctttcaccaattctcaaaagccccacaccaccctcctgccaaccccacacccctccacttccagtcgctaccttccacccatcattctcacttctaaagccatcaacagaggttttgaacaccactcatgtgccaggtgttgttctaagcacagattcatcagtgagccaaatgaaattccttcctaaaatatgctctttggtggtgctaaatgccaggaagaaaagtaagcaaggggagggaagagagaggtgtggggtggcggggggcgggagcttggataggatggtcagaaaggacctctttgtagaaacttaaataaatttagaaagcaagtcatgtaatatctgggaaagaggaaatagcaggtgcaaagaccctgaggttgaagtgtcctggcaagtttgaggcaagcaaggaaggcagggtggttggaacagaacaagagaagaaacgtggtaggaaatgatggagagtcagggacacgaccttggaggacttgcaggtcatggtaaagacgctggactcgacacgaagtgtgaacagagttcttggaggattctgaggtagagagtagcataatctcatttgtgtttttattctaacatgctcacttgggccaccttgtagaggctagagtgaaaaggagggagactagttagaaattctgtattgctggctgggcgtggtagctcccggcactgtgggaggccaaggccagaggattgcttgagtctagcagtttgagcccagcctaggcaacatagcgagaccctgtctctacaaaaaattttaaaattgcccagggatggtggtgcacacttgtagtcccaactacttgggaggctgaggtgggaggattgcctgagcccaggagtttgaggctccagtgagctgtgattgtgccattgcactccagcctgggtgacagagcgagaccctgtctctaaaaaaaaaagaaaaaaaaagaaattctgtattgcagcagcctaagagagtcattagttaagagatttgtagtaggcattttttagaaagttgcattgagggctaggtacggtggctcatgcctataatcccagcactttgggaggccaaggtgggtagatcatttgaggtcaggagcctggccaacatagcgaaaccccgtctctactaaaaaaattagccgggcggtagtggcatgcgcctgtaatcccagctactcgggaggctgaggcaggagaattgcttgagcctgggaggtggaggttgccagtgagtcgagatcgcgccactgcactccagcagtctgggcgacagagtgagacgctgtttcaaaaaaaaaaaag

SEQ ID NO: 36552 - DNA, 3238 bp, Homo sapiens
tgtccttcctttgagcagccactgagagggagaaggagttgcagagatcaggaaggagaggatttatttccagttttctggcagtttttcctcactctttcggagacctaggatgggttaggagagggcatggcaaaggcagaggtggctctgctagaggaggccgcaggtccgcaggccgaacctggggagccagccatgtctggcctgaggccctgctttgaggagaagataaagccttgaggagccttttgggccgatctgggaacccagcaagactagattagcctgactgatgacagacctgggatgaggatgagggcagttaagtatttgtttaatcttgctttgtcttttcaaacagcgatttagtaatcctgtttgaggctgcagtgtggcaatgctttccagaggatggagtcctttttgtttgttttgaaaaaatagagatggggtttcactatgttgcctaggctggtctcatactcggcctcgagccatcctcctgcctgggcctcccaaagtgttgggattacaggcgtgagccatggtgccagactggagtccttttattaaaattaactgccctgctcagctttctgctgggccaccccagagccaatccttggttcttgggcccaaggctggacccaggggttgcaggaaacagtctgtagcatccaagtggggcctgtcgtacccactccagtgtgtaggtgcagaacgctctttgggggatttctctgctgggccaccttactccagggatccctcagttttcaaaacaaagcaagagggcaaggaagaatggagaaacagctcagtgttgactctcttccccctggtgagtgctgtgctggggcctctgtgcacatcataccacttcccccttgaatcagccccacaaggcagggtgagagatgaggactcagggtgcaaggaggtctcacagcttggaaatggatcaggacagctctgattctccaaggccaaggtcttctctatatcatgaggcagcccaaaaatgtgtttctacacatattctgtgtagaaactcaggccaggctcctatatgctctgggtgacagcgggaaggtgctttccagtgtgtatcagtgtggcccatctgggagtcataatgtcattgcctcttccaaaatatcagcaaagctgaccctagtgcttgtagtgctcaaatgcacctctctgcctttgtgccatagggaaatggatttggtcctgggggtggtgataccaacttctgtctcaattccatgaccctcactcagcacccccaccccaggcctgtgcagaggaggaataaccgtccttgagaaccatccagccctaggtggagaaattagatttatggacttaatcagttcttcttccctgtcagtggtggtgagaatgacatgggggaaattgataagcctcagtcatgttttcctgcgagacaaggcagctttggtagctggtgggactgacgccttcttcacctgtgtcctctgcctctgagtgactataaattgcgaaccccatgaggtggcacctgcagccacagatcgcttaggcaccttgcacagggggccacctaatgaactggctgcaggacggcaatcctgccgtgaagccaggcacctcgggaggggcaaggtggcagaaccgagagagcagatgctccttgctgtttctgtaaggccaccagtggctgggtggcctggccctggtagcaaggtggtaaccgtgtgagtggctgaatcctgcaccacttttcctgagcctccttcctcctggattcctgcaactatattctcactacatggctcaccaccaattcgttctctctgccccaaggaggctggacaagaggctcaggtcagtgcgggtacgcaggaacctatgtctgtaaaatgaaaatgcctgccttcaagggctgtcttgaggttgaaaggagatggtctacatcaagggttaggaagaccacaatgtggctgtgccggccacctccaggctggcttcagtctcccatccccatagtcatacccctgtgaagtcccttcccatactgaatcgggctacctgtgtatcttatagggtgttggaaatgacagattgtgaattccaaggccccataaaagacagcgtgggctgggcgtggtggctcacgcctgtaatcccagcactttgggaggccgagccaagtggatcacttgaggtcaggagttctagaccagcctggccagcatggtgaaaacctatctctactaaaaatacaaaaaaaaaaatttagccaggtgtgttggcacctgtgcctgtagtcccagatacttgggaggctgagccaggagaatcacttgaacctgagaggtggaggtttcagtgagccgagattgtgccactgcactccagctgggtggcagagactctgtctctaaacaaagaaaatgtggtttctgctgtcctttctcttggatcactttctctgggaaaccagccaccatcttgtgaggacactcaagctctctggaaaggttcagaaatgtggtgaggaagtgagacagacctcttgccaaaaaccatgtactaacttatcagtcacgtacatgagttgacttagaaatgactctatcagcctcagccaaaccttcagatgactgcagccctggtcaacatcttgactgtgaccccatggaagaccctgaaacactcagccaagccactctcagcttcctgatccacagaagcagcatgaaataataaatttttcttgttttaaactaagttttgggttaatttgttatacagctgtagataactccaagaataatactccataaatgttgatttcctttctgcggctccactgagtcatctttgttcatgggcaaagctcactgtctctctactggctgcaaaagatgtccatttgttggctctgactcatgcttgtggtcttgttggctcacagcaaggccttttcacagaggatggtggtttgtcacactcagaatccaggtcttacctgctttcctgctccatggaattttgacctgagtttgaaggctgataggggattgatggatgagggagaaagacatgtctttccctgctgctctgttcacagtattagatgggaccagagcacgagcgggtctgtaggccatggcagagtcccccttactcatacacgtggaagttggggatgagtgagaagcacacgagtggcacactgatt

SEQ ID NO: 36553 - DNA, 341 bp, Homo sapiens
acctgtattctctttaaatatgagtatacttctcttccttgatttgttcagttttaaattgtatccaaagactcccacctatattatatggttaatgccataggtaagtctactctgtctccaaaatttattttacttcctggtcccctacccagttggattatatctacatggtcacagcaaataccttttatgttgtcttttattatcctgattccctcactgtttttggttttactgctgtggttgtattagtccattttcatactcctatgaagaaatacctgagactgggtaatttataaagaaaaagaggtttaatggactcacagttccacatg

SEQ ID NO: 36554 - DNA, 359 bp, Homo sapiens
ctttacatttgactctcaaaaatgaacattagagttagcataaaagaggctctctggtcatagaaaattgatctctaggggatgcggtggctgacacctgtaatcccagcacttttggaggccgaggttggaggatcactaggtcaggagttcgagaccaacctggactatatggtgaaaccccgtctctactagaaatacaaaaattagctgggcgtggtggcacacacctgtaatcccagctacttgggaggctgagatggaatctcactctgttaccccggcgggagtgcagtggcacgatcttggctcactgcaacctctgcctcccgggttcaagtgattctcctgcctcagcc

SEQ ID NO: 36555 - DNA, 192 bp, Homo sapiens
ttttttttttttgagacggaccgcatctgtcgcccaggtgggactgcggactgagtggcgcaatctcggctcactgaaaacataccctttcttataagtgtcgactcaccttcaaattttcaattttggcctgcttttggctgcttctcattgtctttaggtagttatttttcatacttgttcagggtttat

SEQ ID NO: 36556 - DNA, 707 bp, Homo sapiens
agagcagagacagcatgcgcacacggtcctgtcctccccacccagaggcacagtcagcttaaggaagcccaggggagagggcaaaaagtgtcggaaggtgtacgggatggagaaccgagacatgtggtgtaccgcctgccgctggaagaaggcctgccagaggttcctcgactgagagacccccaggcagaggggctcagggccctgagccgctcctgccctggcctgccactgcaggtgttggaaagagcttttcctactgaataaaacacagttgaagccaggaaaagccctttcaggaaccttggaggaataacagcaaaaacacagaaaaattgtttaagtcaccacctatgacaaaagaaagttgctcttactgagaacccagcttggagcagctataactagttttttttccttcaaaagaaaagtcaactttttttgctgtatgtctagacttaaaactgtggacttctgtagcaattgaaccaacaaagcccattttacctagaaaggaggcatattttgataagctttctgaattatgccattttcaagatttttttgacacttaaaaaacaagctacaggttattcagtagcatttgtacaaagatcaatacttacttttgttgtgaataatcttttccgtatcttccatttgacttcttggagcagtatatgtcaggatgtgttgcaagacagcgc

SEQ ID NO: 36557 - DNA, 825 bp, Homo sapiens
atcgcttgaacccaggaggcggaggttgcagtgagccaagattgttccattgcactccagcctgggtgacagagtgagactctcgcaaacaaacaaacaaagaaaacaaacagtcctagctaacatgtatcaagaaccactgccctgttactgttcacgaatctgtgcattatgaagacaagatattttaatgcacttttcctacaggtacgaatttctgtgctacataaaagagaatatggtttacaagctgattcttatctagatgaaattggtaaacatattttatataggaattctcttaaaaattttttatccacttctgtttattagcatatatatggctgatgaataggttttaggaatagccccagtaggtgcaaataatttaaattagatgcaacgtataatatttatactccaactgaataaattgactataactcttatggactctgtgccacaacttgtcaagtgtctgaatgaaaagaagaaaaaagaaacacgtattcaaacttactgtttaaagttctttgttcagagccattagcatatttaataggatttgcgagtcctctctcccatatggttgtcttttaataaagattgtaataggcagaggacataatttgcctcaaatagatagctaaacaaagcaaaattaatttatttttctgagtaagttagtgacctgctaacaagttcacagtcccttaactaaaacctttggggctagcaccccagaatcaacacattcaaatttctagtgcaaaataatgaatcttcactaattgaaaaccaaaattagcctcttgtcagttttgg

SEQ ID NO: 36558 - DNA, 1136 bp, Homo sapiens
ttcattgtgtcattgaaactatagctgactggtatgtatactaagtgttcgttgatctaaaccagatataagtcattgacttttctgaaacttagttgtgtcagagatgaaccacctgctcactgaaccgtcttagtaaccagtgatgaagcatataattctaatgttggcaataggacattgctaacagtgcgtttaactgcaatattttaactacagtaatttttctgtttatttctctatccactcagtagaatttgtggttgaattccaccttcgctgccatagttttttaccacattcctaatggttttcaacctctatactgtagtagaaaattcatctaactactgaatttaattttagcataatactggatcaaattgtttgaattttcattcctgtcatttttgatttttaaaaaatgaaacaaaactaaacaacaaaaccctaggaaaagaatggcttctttccaactagtcaattaaaacgtccagtatctccccaaataaagccttaggtttcttttaacctcttaatggttaattgaaaagagtacagaaactattcaaaatacttatccaatcaatgggggggaaaagctatgtctttcaggggacagtagagtgatgagaattttttagaaaacactattatccatcaaacttaaaagcatttggacctgatatttaaagataatgaagttttccacatattgaagtattcaagacatcttccatccacaaaaatttatctttaagttttgtaaatatcaagtaagtatagatgatatttattttatatattcctatggaaaaaatgctactttaatgttctgacatttgtgattatttgccagtctttactttttaacttattaaaaagttaaatacttattaaggtttctctatgtaaaacaatttaaattgtcttttgatttttagggaaatatctaaacgtgggaaatttccaacgcaaccttaatattaggttgtgttatttatagagctaaagttaatgcatttttgaatttctcaggagcactgcaaggcaaaaaaatactccaaataaaaatgatatatgtaagttggcaatgtcttcagtcacaataaaaaaaatttttagcaaacagctgc

SEQ ID NO: 36559 - DNA, 280 bp, Homo sapiens
aaggcagcaaggatgtgtgatgaggataaggaggtcatcaagctatcacagaaagcctcgtatgctggtgggaaggagtgtgggtcatgggaaaatgtgaagcaaggtgtcaactaaattggtacatgaagcttagttgagacaattagcaactcctccgtgaccctctgtctggggaggggagagggtgagtgctgtaatgccaaaacccctcttccagacagagccgcaagcatataagaccttgtaaattaatcatcatgggtccacattttagtta

SEQ ID NO: 36560 - DNA, 333 bp, Homo sapiens
gcccaagaatctacctgcctggatccattaacaccagtgccagcgtatctgccttggggccaaaggacacacaggctcagaccactgctgccaccactggggcctgaagactggcccacctggtatttcaatttctggcaaaacttaaccagtctgcactaaaaaccacactctaatctaccaacgaaaccagataccaatgactctatggccaaaagaaatgatagagactatgctactgcttgcatccagaaccaaagccaagtgtcctctccaaccatcaccatagatacatcttcaggaaaatgttcttccactacaaaccaaattcaa

SEQ ID NO: 36561 - DNA, 390 bp, Homo sapiens
catgatactcccttatggagaaacttaaggttggattaaactatcctagtcagcaattaaacactttctccaaagtcattgtgctacgagactctaattttacttccttagaagagcaaaaaggagtgaggaacattgaccttgagcccaggcgttctggcctagtggtctgccttcatcagagctggttgctcctgctgtaggttcaaggtcaatgaactctgactattgctttcagcttgccattggagagctgtatcctccctttgataaaatcttcttggctgacttattttcagcttgaacattctgctctatctgctccaggaagacagatctgcttttggtgccctgcccatgacttacatatcttccacttagttacaagac

SEQ ID NO: 36562 - DNA, 1036 bp, Homo sapiens
gttttcattaatgtttgtgttctcatttgatctttataactaccctgtgaaataggtacttaggacaaacattgatcacccctcattttaaagatggaaaacctgaggctcagaaaaatgaagctcacaaattatgtcttatgactccaaactcctgctggtttttttttatttgtctgaaaactgactgatgtgatcttatttggacaaaggagtgttgttggaaatatcagtcacgtgaattaattaacaatttcttccttcctagcgagagtaggaccatggagtagagcagatatattagtccattccatgtggaaatccggcctgtagttgtatattcgtatagctatatgttggtaggatggacctacatggtttaatgaaagtggaaggaaaatctattttcagtcagatcctatagatatttcataaggaattagaacttagttacttaaaaattatattctagaggtttataaagcaaacatttattatattcatttacctttttaaaaaattttaagcaaagcccatactcctgttttggggatatctgaaagagagagcatttacaactttagaattacagattcatgagggatctgattttattttctttttcaactttaatttttgattcagtgggtacacatacaggttttattacctgagtatattgtgtgatgctgaggtttggtgtacagataaagcgatctgattttatactcttatgcagtggatctaccactactacaatgactgctacagggctgctaatgtttctgaatattgtctaagtacttctagaaataggaaagaagatcacagaatcataaattcttctatcttaaaggagccttcaggataattattattttacaaaaaaatgcagctaggctattgtatacatcaaacaggctgttttttctcatggtgaactgaatctgcttcagtggaactttccccattctgtctgaggtctccctttggacacaatgtagaataaatctattgctctcctgcaaaaaaatag

SEQ ID NO: 36563 - DNA, 982 bp, Homo sapiens
gttttcattaatgtttgtgttctcatttgatctttataactaccctgtgaaataggtacttaggacaaacattgatcacccctcattttaaagatggaaaacctgaggctcagaaaaatgaagctcacaaattatgtcttatgactccaaactcctgctggtttttttttatttgtctgaaaactgactgatgtgatcttatttggacaaaggagtgttgttggaaatatcagtcacgtgaattaattaacaatttcttccttcctagcgagagtaggaccatggagtagagcagatatattagtccattccatgtggaaatccggcctgtagttgtatattcgtatagctatatgttggtaggatggacctacatggtttaatgaaagtggaaggaaaatctattttcagtcagatcctatagatatttcataaggaattagaacttagttacttaaaaattatattctagaggtttataaagcaaacatttattatattcatttacctttttaaaattacaactttagaattacagattcatgagggatctgattttattttctttttcaactttaatttttgattcagtgggtacacatacaggttttattacctgagtatattgtgtgatgctgaggtttggtgtacagataaagcgatctgattttatactcttatgcagtggatctaccactactacaatgactgctacagggctgctaatgtttctgaatattgtctaagtacttctagaaataggaaagaagatcacagaatcataaattcttctatcttaaaggagccttcaggataattattattttacaaaaaaatgcagctaggctattgtatacatcaaacaggctgttttttctcatggtgaactgaatctgcttcagtggaactttccccattctgtctgaggtctccctttggacacaatgtagaataaatctattgctctcctgcaaaaaaatag

SEQ ID NO: 36564 - DNA, 360 bp, Homo sapiens
acagacaaggaaactgaggctcagagaggttgagtaacagacagcaaggtgggaagctgagatgtgaatgggcttgagttggataccattcagttatgtcaggactttggaaccctgagtgatgggccctagtcccaaggcttggatctttgtcatggtcctaccgatgtcccttaacttttgcctcaagaccagttgtctaatgcatcatgctgcattgtggcttttcaaaagagatgaacatgttaataggcactgtcttaacaaaattccatcgactgggtggcttaaacaaccggaatttatttctcacaattctggagactggaagtccaagatcaaggttctggtagggtcaga

SEQ ID NO: 36565 - DNA, 2213 bp, Homo sapiens
ggaaacatgatccagctgaaggactgattgcaggaaaacttggcagctccccaaccttggtggcccagggagtgtgaggctgcagcctcagaaggtgtgagcagtggccacgagaggcaggctggctgggacatgaggttggcagagggcaggcaagctggcccttggtgggcctcgtcctgagcactcggaggcactcctatgcttggaaagctcgctatgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagccatgggaaaccactgcagccacatgggaggaccccaggacttcgagaagagcccgagggacagatgtagccctcccccaccacctcgggaggcctcgctggcggtgtgtgggctgctgcaggagctgtcctccatccggcaattcctggaaaagcgggatgagatccgagaggtggcccgagactggctgcgcgtgggctccgtgctggacaagctgctattccacatttacctgctagcggtgctggcctacagcatcaccctggttatgctctggtccatctggcagtacgcttgagtgggtacagcccagtggaggagggggtacagtcctggttaggtggggacagaggatttctgcttaggcccctcaggacccagggaatgccagggacattttcaagacacagacaaagtcccgtgccctgtttccaatgccaattcatctcagcaatcacaagccaaggtctgaacccttccaccaaaaactgggtgttcaaggcccttacacccttgtcccacccccagcagctcaccatggctttaaaacatgctctcttagatcaggagaaactcgggcactccctaagtccactctagttgtggacttttccccattgaccctcacctgaataagggactttggaattctgcttctctttcacaactttgcttttaggttgaaggcaaaaccaactctctactacacaggcctgataactctgtacgaggcttctctaacccctagtgtcttttttttcttcacctcacttgtggcagcttccctgaacactcatcccccatcagatgatgggagtgggaagaataaaatgcagtgaaaccctaaaaaaaaaa

SEQ ID NO: 36566 - DNA, 2309 bp, Homo sapiens
ggaaacatgatccagctgaaggactgattgcaggaaaacttggcagctccccaaccttggtggcccagggagtgtgaggctgcagcctcagaaggtgtgagcagtggccacgagaggcaggctggctgggacatgaggttggcagagggcaggcaagctggcccttggtgggcctcgtcctgagcactcggaggcactcctatgcttggaaagctcgctatgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtaaggcccctcctggcagcagagctcagtctggtgagaaacccgccccctcccacctcctgcatgtgtctcttgcctctgccctgggctgcacaggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagccatgggaaaccactgcagccacatgggaggaccccaggacttcgagaagagcccgagggacagatgtagccctcccccaccacctcgggaggcctcgctggcggtgtgtgggctgctgcaggagctgtcctccatccggcaattcctggaaaagcgggatgagatccgagaggtggcccgagactggctgcgcgtgggctccgtgctggacaagctgctattccacatttacctgctagcggtgctggcctacagcatcaccctggttatgctctggtccatctggcagtacgcttgagtgggtacagcccagtggaggagggggtacagtcctggttaggtggggacagaggatttctgcttaggcccctcaggacccagggaatgccagggacattttcaagacacagacaaagtcccgtgccctgtttccaatgccaattcatctcagcaatcacaagccaaggtctgaacccttccaccaaaaactgggtgttcaaggcccttacacccttgtcccacccccagcagctcaccatggctttaaaacatgctctcttagatcaggagaaactcgggcactccctaagtccactctagttgtggacttttccccattgaccctcacctgaataagggactttggaattctgcttctctttcacaactttgcttttaggttgaaggcaaaaccaactctctactacacaggcctgataactctgtacgaggcttctctaacccctagtgtcttttttttcttcacctcacttgtggcagcttccctgaacactcatcccccatcagatgatgggagtgggaagaataaaatgcagtgaaaccctaaaaaaaaaa

SEQ ID NO: 36567 - DNA, 2052 bp, Homo sapiens
ggaaacatgatccagctgaaggactgattgcaggaaaacttggcagctccccaaccttggtggcccagggagtgtgaggctgcagcctcagaaggtgtgagcagtggccacgagaggcaggctggctgggacatgaggttggcagagggcaggcaagctggcccttggtgggcctcgtcctgagcactcggaggcactcctatgcttggaaagctcgctatgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccagtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagccatgggaaaccactgcagccacatgggaggaccccaggacttcgagaagagcccgagggacagatgtagccctcccccaccacctcgggaggcctcgctggcggtgtgtgggctgctgcaggagctgtcctccatccggcaattcctggaaaagcgggatgagatccgagaggtggcccgagactggctgcgcgtgggctccgtgctggacaagctgctattccacatttacctgctagcggtgctggcctacagcatcaccctggttatgctctggtccatctggcagtacgcttgagtgggtacagcccagtggaggagggggtacagtcctggttaggtggggacagaggatttctgcttaggcccctcaggacccagggaatgccagggacattttcaagacacagacaaagtcccgtgccctgtttccaatgccaattcatctcagcaatcacaagccaaggtctgaacccttccaccaaaaactgggtgttcaaggcccttacacccttgtcccacccccagcagctcaccatggctttaaaacatgctctcttagatcaggagaaactcgggcactccctaagtccactctagttgtggacttttccccattgaccctcacctgaataagggactttggaattctgcttctctttcacaactttgcttttaggttgaaggcaaaaccaactctctactacacaggcctgataactctgtacgaggcttctctaacccctagtgtcttttttttcttcacctcacttgtggcagcttccctgaacactcatcccccatcagatgatgggagtgggaagaataaaatgcagtgaaaccctaaaaaaaaaa

SEQ ID NO: 36568 - DNA, 1945 bp, Homo sapiens
ggaaacatgatccagctgaaggactgattgcaggaaaacttggcagctccccaaccttggtggcccagggagtgtgaggctgcagcctcagaaggtgtgagcagtggccacgagaggcaggctggctgggacatgaggttggcagagggcaggcaagctggcccttggtgggcctcgtcctgagcactcggaggcactcctatgcttggaaagctcgctatgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtgtctactttgtggtgtgcatggctctgctggtgataagtttggccgagaccatcttcattgtgcggtgctgcaggagctgtcctccatccggcaattcctggaaaagcgggatgagatccgagaggtggcccgagactggctgcgcgtgggctccgtgctggacaagctgctattccacatttacctgctagcggtgctggcctacagcatcaccctggttatgctctggtccatctggcagtacgcttgagtgggtacagcccagtggaggagggggtacagtcctggttaggtggggacagaggatttctgcttaggcccctcaggacccagggaatgccagggacattttcaagacacagacaaagtcccgtgccctgtttccaatgccaattcatctcagcaatcacaagccaaggtctgaacccttccaccaaaaactgggtgttcaaggcccttacacccttgtcccacccccagcagctcaccatggctttaaaacatgctctcttagatcaggagaaactcgggcactccctaagtccactctagttgtggacttttccccattgaccctcacctgaataagggactttggaattctgcttctctttcacaactttgcttttaggttgaaggcaaaaccaactctctactacacaggcctgataactctgtacgaggcttctctaacccctagtgtcttttttttcttcacctcacttgtggcagcttccctgaacactcatcccccatcagatgatgggagtgggaagaataaaatgcagtgaaaccctaaaaaaaaaa

SEQ ID NO: 36569 - DNA, 1897 bp, Homo sapiens
gggactctcagttactgctgagggaattgggcgccactgacaccagcttctcccaggaagatgcccacctgttgcctgggcactgagggtgaagtctgcctgagttgcaggcgaccctcactggagatggagggggctgcctgtgaccatccctgctcctcccctagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagccatgggaaaccactgcagccacatgggaggaccccaggacttcgagaagagcccgagggacagatgtagccctcccccaccacctcgggaggcctcgctggcggtgtgtgggctgctgcaggagctgtcctccatccggcaattcctggaaaagcgggatgagatccgagaggtggcccgagactggctgcgcgtgggctccgtgctggacaagctgctattccacatttacctgctagcggtgctggcctacagcatcaccctggttatgctctggtccatctggcagtacgcttgagtgggtacagcccagtggaggagggggtacagtcctggttaggtggggacagaggatttctgcttaggcccctcaggacccagggaatgccagggacattttcaagacacagacaaagtcccgtgccctgtttccaatgccaattcatctcagcaatcacaagccaaggtctgaacccttccaccaaaaactgggtgttcaaggcccttacacccttgtcccacccccagcagctcaccatggctttaaaacatgctctcttagatcaggagaaactcgggcactccctaagtccactctagttgtggacttttccccattgaccctcacctgaataagggactttggaattctgcttctctttcacaactttgcttttaggttgaaggcaaaaccaactctctactacacaggcctgataactctgtacgaggcttctctaacccctagtgtcttttttttcttcacctcacttgtggcagcttccctgaacactcatcccccatcagatgatgggagtgggaagaataaaatgcagtgaaaccctaaaaaaaaaa

SEQ ID NO: 36570 - DNA, 1990 bp, Homo sapiens
acttgctcttccaagccagatctctgctttcctgtcaatgaatgcataggtcctttctacaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagccatgggaaaccactgcagccacatgggaggaccccaggacttcgagaagagcccgagggacagatgtagccctcccccaccacctcgggaggcctcgctggcggtgtgtgggctgctgcaggagctgtcctccatccggcaattcctggaaaagcgggatgagatccgagaggtggcccgagactggctgcgcgtgggctccgtgctggacaagctgctattccacatttacctgctagcggtgctggcctacagcatcaccctggttatgctctggtccatctggcagtacgcttgagtgggtacagcccagtggaggagggggtacagtcctggttaggtggggacagaggatttctgcttaggcccctcaggacccagggaatgccagggacattttcaagacacagacaaagtcccgtgccctgtttccaatgccaattcatctcagcaatcacaagccaaggtctgaacccttccaccaaaaactgggtgttcaaggcccttacacccttgtcccacccccagcagctcaccatggctttaaaacatgctctcttagatcaggagaaactcgggcactccctaagtccactctagttgtggacttttccccattgaccctcacctgaataagggactttggaattctgcttctctttcacaactttgcttttaggttgaaggcaaaaccaactctctactacacaggcctgataactctgtacgaggcttctctaacccctagtgtcttttttttcttcacctcacttgtggcagcttccctgaacactcatcccccatcagatgatgggagtgggaagaataaaatgcagtgaaaccctaaaaaaaaaa

SEQ ID NO: 36571 - DNA, 1718 bp, Homo sapiens
ggaaacatgatccagctgaaggactgattgcaggaaaacttggcagctccccaaccttggtggcccagggagtgtgaggctgcagcctcagaaggtgtgagcagtggccacgagaggcaggctggctgggacatgaggttggcagagggcaggcaagctggcccttggtgggcctcgtcctgagcactcggaggcactcctatgcttggaaagctcgctatgctgctgtgggtccagcaggcgctgctcgccttgctcctccccacactcctggcacagggagaagccaggaggagccgaaacaccaccaggcccgctctgctgaggctgtcggattaccttttgaccaactacaggaagggtgtgcgccccgtgagggactggaggaagccaaccaccgtatccattgacgtcattgtctatgccatcctcaacgtggatgagaagaatcaggtgctgaccacctacatctggtaccggcagtactggactgatgagtttctccagtggaaccctgaggactttgacaacatcaccaagttgtccatccccacggacagcatctgggtcccggacattctcatcaatgagttcgtggatgtggggaagtctccaaatatcccgtacgtgtatattcggcatcaaggcgaagttcagaactacaagccccttcaggtggtgactgcctgtagcctcgacatctacaacttccccttcgatgtccagaactgctcgctgaccttcaccagttggctgcacaccatccaggacatcaacatctctttgtggcgcttgccagaaaaggtgaaatccgacaggagtgtcttcatgaaccagggagagtgggagttgctgggggtgctgccctactttcgggagttcagcatggaaagcagtaactactatgcagaaatgaagttctatgtggtcatccgccggcggcccctcttctatgtggtcagcctgctactgcccagcatcttcctcatggtcatggacatcgtgggcttctacctgccccccaacagtggcgagagggtctctttcaagattacactcctcctgggctactcggtcttcctgatcatcgtttctgacacgctgccggccactgccatcggcactcctctcattggtaaggcccctcctggcagcagagctcagtctggtgagaaacccgccccctcccacctcctgcatgtgtctcttgcctctgccctgggctgcacaggtgtctactttgtggtgtgcatggctctgctggtgataagtttggccgagaccatcttcattgtgcggctggtgcacaagcaagacctgcagcagcccgtgcctgcttggctgcgtcacctggttctggagagaatcgcctggctactttgcctgagggagcagtcaacttcccagaggcccccagccacctcccaagccaccaagactgatgactgctcagtccactctagttgtggacttttccccattgaccctcacctgaataagggactttggaattctgcttctctttcacaactttgcttttaggttgaaggcaaaaccaactctctactacacaggcctgataactctgtacgaggcttctctaacccctagtgtcttttttttcttcacctcacttgtggcagcttccctgaacactcatcccccatcagatgatgggagtgggaagaataaaatgcagtgaaaccctaaaaaaaaaa

SEQ ID NO: 36572 - DNA, 446 bp, Homo sapiens
gaagaggtggggggactctcagttactgctgagggaattgggcgccactgacaccagcttctcccaggaagatgcccacctgttgcctgggcactgagggtgaagtctgcctgagttgcaggcgaccctcactggagatggagggggctgcctgtgaccatccctgctcctcccctagtactggactgatgagtttctccagtggaaccctgaggactttgacaacatcaccaagttgtccatccccacggacagcatctgggtcccggacattctcatcaatgagttgtgagtaccgttatccattgtgaggtggctgggtggcttaggagctggagaagcccggggacagagagacaagattgtcactgttgcatttgagatgtcccaccaggaattgcagactgtagataaagctggtgtgagtccaaattccctttgtcttc

SEQ ID NO: 36573 - DNA, 699 bp, Homo sapiens
gaaaaggcaattgtaagcattgagattacacagatgttgaaactatccagcaagaatcataaagcagctattatacaaatgccctgattttaaagcaagtatgaatgctcgaaacaaatgacaaagtggaaagtcacagcagagaaatagaaaatgtaaggaagaaccaaatggaaattttaaaactgaaaaatacaataaccagtttttaaaaattactagattcagagggaaagaccaacaactcagaaaaaatgggcaaaggatatgaagagtttacggaaaaggaaatgtagataactcttacccatataaaaatatgttcagcctcactcatattaagaaaaatcaaaattgaaattacactgagacactggcttttcacctgtcagaatggcaaaatctcaaagtgtgaatatacgctatgagaatgtggaaaattctcatagattgcttgtgggcatctagaacaatttggttgaatcactaaaatccacatgccatttggccctgcaattctacttttagaaatttatcatataggaaacctgcatatgagtgaaatgacatacgtggagtgttactcctggctgcattgttggtaatcacaaagaacactagaaaaaacttaatgtccatcaataagatgctgattaaattaattattatacgtcatacaatggaaagttagaaaaccgt

SEQ ID NO: 36574 - DNA, 376 bp, Homo sapiens
catgtggtatagtttcactatctgcccaggtggctttggctcaagtggcatggctggtgcttgtccccatcagagcctcaagtgcctatggcatgctacccgtgcccttgcctgctcatctgtaatgtccccatagtgcctatgacactttcttcttcttgggatatgcatcacctgcttgcctggtagccaattacatagatgtcatggaagccctggatgtcagccgtctaatgtccactaatactcagcaaatcctaccatggggctgtgtgtgtgtctgttctcaaagaaatggcttctttgtacatggtggctaccattatctaggctttgagctgataaaaattgttgaacctgatcatatgacaaagtt

SEQ ID NO: 36575 - DNA, 272 bp, Homo sapiens
actctgccaacataaagtgatttagaaatgttaatatattttaccaagccagagtttctagcatatgtattttaagccgtcataaaacatatacctgtcatgttaaggaatgtgcccacggcaagtatcaaagacctgctgtgggaggctgaggagtgtgttttgctatgttgcagggttataacctgacaacctccatgaggcatgagtactggcagggagtggtttataaatattgaagctattttatttattactttaagaattcctac

SEQ ID NO: 36576 - DNA, 1654 bp, Homo sapiens
agatggtactacgtgtgcatgtgccaccatgcctggctaatttatttttaagatggagtcttgctatgttgcccaggctggttttgagctcctggcctcaagcaatcttcctgagacaggaatcccaaagtgctgggattacaggtgtgagccactgtgcccagccaaatattagaacttttaaattcatttagtatgtaagcttactgccaagcatgaaagaatcactttgaaggccagtaatgttttaaaggtctggaagattctcttgagggctaggaagcattatgtgctaggttcttgaaccaggagaaaaggggtatcactaagaagaagggaaggaatcctggtatgcaaaatagcttgggcgctatccttgcacatttgacaagtttagtgaagtactattgaactgttcagtaaagtatctgttgcctatagataaaatgtcttttgtagatacttatatatctacctacctatagatatctatatatctgtatctatatatcccttaaagctaagctaatttccttaaccttttctctgttgatatttgtttggtagcctttatctgattctagttaataactcgtaccctgtcatttttttaaaaataccctttgtttttgtaatgtgttctttcattcttcttcccaattcagttttggtacgttcctgttacgtaaatctaatctggtgagcagagactttcttaggattatgccacttggtgaggcaatcacagggtcttagccctgaaggcgcccatactgactttatcagtttattctagggagatcaggtttggggcactaacttaatactaacaaactcctaagattaatttaattttatttatttgtttgagacggagtcacccagggtggagtgcagtggcgtgatcttggctcactgcaacctctgcctccctggttcaaacgattcttgtgcctcagcctcctgaggctgggactacaggcgcatgtcaccacgtctggcttatttttgtagttttagtagagacaaggtttcaccatgttggccgggctggtcttgaactacctcaggtcccaccttggcctcctaaaatgctagaattacacagacgggagctaccatgcctagccaaaactcctaagatttacttacttacttactttatttatttatttgagacggagtctcgctctgtcccctaggctggaatgcagtggtgtaatctcagctcactgcaacatctgcctcctgggttcacctgtctctgcctctcagatagctgggattgcaggtgcatgccaccatgcccgactaatttttgtatttttagtagagatggggtttcaccatgttggccaggctggtctcgcactcctgacctcaagtgatccacccgcctcggccccccagaatgctgggattacaggtgtgagccactgtgcccggccctaagattaattttcaaacaatgtgcatcagtatgttagaaatacctagtgttagccgggtgtggttgtgtgtgcctatagtcccaactactctggaggctgacttgggaggattgcttgaggccaggagttcaggggcgcagtgaactatgattacaccactgccccaacctgggtgacagtgggagaccctgtcttaaaaaaaa

SEQ ID NO: 36577 - DNA, 609 bp, Homo sapiens
aaacaccatgtattgtatgattccattgatataaaataaccacagtaggcaagtctgcagagacagaaagtagattagtggttgcctagggctggtaggaaggcaggaaagtgttgcagggtgacaggtgtgagggcaggacagtaacagggggaggaatggaaatgaccactaatgggcttacagtttctttttggtgtgatgaaaatgttctaaaatttattttgctgaaggttgcacaactctgtgaatatactaaaagctattcaattgtacactttaaataggtgacttgtctggtatgtgaagtatatctcaacaaagatgttattttaagaattaacaaggatgggcatgatggcccatacctataatcccagcagtttgggaggccgaggtgggagaatcacttgatcccaggagtttgagaccagcctgggcaacatagcaagattttgtctccacataaaagaaaaatttagccagttgtagtggtacacacctgcagtcccagctactcaggaggcttatatggaaggatcacatgaacccaggaggttgaggctccagtgagccatgattgtgccaccgcacttcagcttgggtgac

SEQ ID NO: 36578 - DNA, 2628 bp, Homo sapiens
gcagtcagttggtctgggcactgcagcaggctcggctctgtcccagcacttgtctgggagaaaagtggtgttactcacccagggagagtctctctttctaccttccttctttctcgatctccttgtgtgcttttgtgtttctttatttcttttccttttttttcttttttttttttttgttacttaattatattcctaatcctggatgaagttgctggattctgcagcacaagtcttcatgaacaagcagcaccgctcagagatttcacggcattcaaaggtcacagaactgccactatggttaaatgtcttgtttaatggttgagaggtgtggcgaaatcttgtttgagaaccccgatcagaatgccaaatgtgtttgcatgctgggagatatacgactaaggggtcagacgggggttcgtgctgaacgccgtggctcctacccattcattgacttccgcctacttaacagtacaacatactcaggggagattggcaccaagaaaaaggtgaaaagactattaagctttcaaagatacttccatgcatcaaggctgcttcgtggaattataccacaagcccctctgcacctgctggatgaagactaccttggacaagcaaggcatatgctctccaaagtgggaatgtgggattttgacattttcttgtttgatcgcttgacaaatggaaacagcctggtaacactgttgtgccacctcttcaatacccatggactcattcaccatttcaagttagatatggtgaccttacaccgatttttagtcatggttcaagaagattaccacagccaaaacccgtatcacaatgctgttcacgcagccgacgtcacccaggccatgcactgctacctgaaagagccaaagcttgccagcttcctcacgcctctggacatcatgcttggactgctggctgcagcagcacacgatgtggaccacccaggggtgaaccagccatttttgataaaaactaaccaccatcttgcaaacctatatcagaatatgtctgtgctggagaatcatcactggcgatctacaattggcatgcttcgagaatcaaggcttcttgctcatttgccaaaggaaatgacacaggatattgaacagcagctgggctccttgatcttggcaacagacatcaacaggcagaatgaatttttgaccagattgaaagctcacctccacaataaagacttaagactggaggatgcacaggacaggcactttatgcttcagatcgccttgaagtgtgctgacatttgcaatccttgtagaatctgggagatgagcaagcagtggagtgaaagggtctgtgaagaattctacaggcaaggtgaacttgaacagaaatttgaactggaaatcagtcctctttgtaatcaacagaaagattccatccctagtatacaaattggtttcatgagctacatcgtggagccgctcttccgggaatgggcccatttcacgggtaacagcaccctgtcggagaacatgctgggccacctcgcacacaacaaggcccagtggaagagcctgttgcccaggcagcacagaagcaggggcagcagtggcagcgggcctgaccacgaccacgcaggccaagggactgagagcgaggagcaggaaggcgacagcccctaggggccggcccaacttagacgcggctctcctccggcagggcccccagagggcagaagcagcgtggaggggccctcacgcagcagcccagccactttctgagtgttgtcctggggctctttggaacgccatcttcctcccacttacctgcctcccctccttttcgcaaatgtacagaagccatttgtcacctcagcattcgctgccgaaatgagcaactccattcagtaacgtgggagctgatcccacgggcaggctctccctgctccaggagaagactaggaggaagaatgaggtgctcctgccgtgtccgccttgttccgggtcgcactggaacaggcagcaattcctaagtccggagcgtttgagcgtttgctatctgactgctgatctgcgtgacagaaacaccagcatatttgcaacgccaaggatattggtcttaagtgcaagagcacaaatgagagtgtgagagaaagtaccttctattttaataataatattattataaaaataataaatctttttaacttttatattttatgcactagacaatggatctgcaactttggactaaggtcattcaatgtacccaaacttgaacagggggttcattgttttgctattgactttattatgccactttggggcagagacttggcatcttcgcagtttaagaaaccacgtttcctatccaatccgaagggaaggtgctgtacagttcattcctttgcaccattagccaatctgtcttttatggattctgtgacatgtttatattcacccatgtacattttctgtaaataccaaacgctactgattcccatgccaaaatacatgagtattatgggattgctacctgtataaacaatggcactgtgaaaatactgttagttttaatacaagagaatgcatttgtaaatatggtatagagtttattaatatactattgtttgcagataaaggccttaacttt

SEQ ID NO: 36579 - DNA, 1431 bp, Homo sapiens
cagttctcagcttggtgaggctccaaaagagaatatgtcagatgtattcctacttccaaacctgtcttactttggtttgatggtacacatagggcttttgaacagtctatttttaatgtatatgaggtcaaatcaaggaaggcaattgctggggacaagaaaagtagaggtaggaaagaagacactattttagctaatggggtttcttgggactaaaaaatggctttgtttaaattataattatataataatttaaataaatgagattggaggtattcttagtagttctgagttgatagtttacattacaattaggtcttgaagaagagctcacagagaaaaaactaccaaatatccaatgggtaagcccatgatgtagccactagtacaataaaaatctgaagtaaaatgaggcataaacttgatgcagctgcctccctcattcaactggggagttcttgagttcctcatttgttggtaaaaagaaaaagaatgtgaaaatgtctctttttttcttggctattagtggctgtcttgcaatatttcaataggagtccaattactagttaaaacactggcggggtgcggtggctcacgcctgtaatcctagcactttgggaggccaagttgggcagatcacaagttcaagagatcgagaccattctggccaacatggtgaaaccccgtctctactaaaaatacaaaaattagctgggcatggcagtgcgtgcctgcaatcccagctactcaggaagctgaggcaggagaatcgcttgaacctgggaggtggaagttgtagtgaactgagatcgcaccactgcactccagcctggcaacagagctagaatccgtctcaaacaaacaaacaaaaaatcccacagctattggatcatccacagattttttctttacaatcttgttctccttgtccatggaccatcaatagttgacttgccaggtttaattctttcattgcttgagaagaaaggaatcaaaggactgtgtgtagtaagctgacggtaaagttaagattaaattaagacagagagagaatacatatcactgccaggcctgataggaaaaatctgctcttccttttaataacagtgatgaattgtcaggaccttatttaggaaaccctgacctacccataactccctgctaggctaagtagaaaccaggttatttctccctgcttatggctccccgcaaagggacttgcagcgtgtcctgcaactttgtcttcagatagtgcttcctacaaaactaggtcttgttttgtaatcttttctcgtgttgaatcagatctgcttacttatttaggtttggttatgagcttgtatctcactgtatttctcatgctttgttcttttaaacaaatcctttaaactgtgtcattttgtatacacatgtgaggtttgaaaaaaaaaa

SEQ ID NO: 36580 - DNA, 898 bp, Homo sapiens
  misc_feature (1)..(1): n is a, c, g, or t
nttttaacgcctcaaaagttttcgtagcccagggtaaaatcacaggtgtaaactcagatattttttgtccaaatggcccttcccagttatatgtttatgagacaggggttcgacacacaagtcttgtacttaagcgcaaggggctttctaaattaccaccggttcaggcatatgctctccaaagtgggaatgtgggattttgacattttcttgtttgatcgcttgacaaatggaaacagcctggtaacactgttgtgccacctcttcaatacccatggactcattcaccatttcaagttagatatggtgaccttacaccgatttttagtcatggttcaagaagattaccacagccaaaacccgtatcacaatgctgttcacgcagccgacgtcacccaggccatgcactgctacctgaaagagccaaagcttgccagcttcctcacgcctctggacatcatgcttggactgctggctgcagcagcacacgatgtggaccacccaggggtgaaccagccatttttgataaaaactaaccaccatcttgcaaacctatatcaggtaagggagcccaacctggagccagccacagtatggtcaatcgccttaggcccggtgctcaagcctgaatcttgcccatggagaaagccttgttttagggtcctagaagttcaaagacgaatgaaacacaatctctgccctcaaaaatttgttcaaactcagatgctcaaaatgagcaaaatccaagcaaacttaatcccagtttgaaagaggtttgaggaattagctcatgtcgatacaattgttttttaaaatctctaaagagtaaatacttgtgctgttctttgtatccaaagaccttactagaataaagtgagccgctgtttttcttttccca

SEQ ID NO: 36581 - DNA, 2773 bp, Homo sapiens
gcagtcagttggtctgggcactgcagcaggctcggctctgtcccagcacttgtctgggagaaaagtggtgttactcacccagggagagtctctctttctaccttccttctttctcgatctccttgtgtgcttttgtgtttctttatttcttttccttttttttcttttttttttttttgttacttaattatattcctaatcctggatgaagttgctggattctgcagcacaagtcttcatgaacaagcagcaccgctcagagatttcacggcattcaaaggtcacagaactgccactatggttaaatgtcttgtttaatggttgagaggtgtggcgaaatcttgtttgagaaccccgatcagaatgccaaatgtgtttgcatgctgggagatatacgactaaggggtcagacgggggttcgtgctgaacgccgtggctcctacccattcattgacttccgcctacttaacagtacaacatactcaggggagattggcaccaagaaaaaggtgaaaagactattaagctttcaaagatacttccatgcatcaaggctgcttcgtggaattataccacaagcccctctgcacctgctggatgaagactaccttggacaagcaaggcatatgctctccaaagtgggaatgtgggattttgacattttcttgtttgatcgcttgacaaatggaaacagcctggtaacactgttgtgccacctcttcaatacccatggactcattcaccatttcaagttagatatggtgaccttacaccgatttttagtcatggttcaagaagattaccacagccaaaacccgtatcacaatgctgttcacgcagccgacgtcacccaggccatgcactgctacctgaaagagccaaagcttgccagcttcctcacgcctctggacatcatgcttggactgctggctgcagcagcacacgatgtggaccacccaggggtgaaccagccatttttgataaaaactaaccaccatcttgcaaacctatatcagaatatgtctgtgctggagaatcatcactggcgatctacaattggcatgcttcgagaatcaaggcttcttgctcatttgccaaaggaaatgacacaggatattgaacagcagctgggctccttgatcttggcaacagacatcaacaggcagaatgaatttttgaccagattgaaagctcacctccacaataaagacttaagactggaggatgcacaggacaggcactttatgcttcagatcgccttgaagtgtgctgacatttgcaatccttgtagaatctgggagatgagcaagcagtggagtgaaagggtctgtgaagaattctacaggcaaggtgaacttgaacagaaatttgaactggaaatcagtcctctttgtaatcaacagaaagattccatccctagtatacaaattggtttcatgagctacatcgtggagccgctcttccgggaatgggcccatttcacgggtaacagcaccctgtcggagaacatgctgggccacctcgcacacaacaaggcccagtggaagagcctgttgcccaggcagcacagaagcaggggcagcagtggcagcgggcctgaccacgaccacgcaggccaagggactgagagcgaggagcaggaaggcgacagcccctaggggccggcccaacttagacgcggctctcctccggcagggcccccagagggcagaagcagcgtggaggggccctcacgcagcagcccagccactttctgagtgttgtcctggggctctttggaacgccatcttcctcccacttacctgcctcccctccttttcgcaaatgtacagaagccatttgtcacctcagcattcgctgccgaaatgagcaactccattcagtaacgtgggagctgatcccacgggcaggctctccctgctccaggagaagactaggaggaagaatgaggtgctcctgccgtgtccgccttgttccgggtcgcactggaacaggcagcaattcctaagtccggagcgtttgagcgtttgctatctgactgctgatctgcgtgacagaaacaccagcatatttgcaacgccaaggatattggtcttaagtgcaagagcacaaatgagagtgtgagagaaagtaccttctattttaataataatattattataaaaataataaatctttttaacttttatattttatgcactagacaatggatctgcaactttggactaaggtcattcaatgtacccaaacttgaacagggggttcattgttttgctattgactttattatgccactttggggcagagacttggcatcttcgcagtttaagaaaccacgtttcctatccaatccgaagggaaggtgctgtacagttcattcctttgcaccattagccaatctgtcttttatggattctgtgacatgtttatattcacccatgtacattttctgtaaataccaaacgctactgattcccatgccaaaatacatgagtattatgggattgctacctgtataaacaatggcactgtgaaaatactgttagttttaatacaagagaatgcatttgtaaatatggtatagagtttattaatatactattgtttgcagataaaggccttaactttaaacatctttcatcttctgaaagctgcccaacttaaatcctcatagatgtctttctcaactgccttcccatgttcatctgtatgttttccagctaaggtcacaaaccaaaactgaataaagtctttgaggaaacattttggaaac

SEQ ID NO: 36582 - DNA, 1290 bp, Homo sapiens
  misc_feature (1)..(1): n is a, c, g, or t
nttttaacgcctcaaaagttttcgtagcccagggtaaaatcacaggtgtaaactcagatattttttgtccaaatggcccttcccagttatatgtttatgagacaggggttcgacacacaagtcttgtacttaagcgcaaggggctttctaaattaccaccggttcaggcatatgctctccaaagtgggaatgtgggattttgacattttcttgtttgatcgcttgacaaatggaaacagcctggtaacactgttgtgccacctcttcaatacccatggactcattcaccatttcaagttagatatggtgaccttacaccgatttttagtcatggttcaagaagattaccacagccaaaacccgtatcacaatgctgttcacgcagccgacgtcacccaggccatgcactgctacctgaaagagccaaagcttgccagcttcctcacgcctctggacatcatgcttggactgctggctgcagcagcacacgatgtggaccacccaggggtgaaccagccatttttgataaaaactaaccaccatcttgcaaacctatatcagaatatgtctgtgctggagaatcatcactggcgatctacaattggcatgcttcgagaatcaaggagaatcgcttgaacctgggaggtggaagttgtagtgaactgagatcgcaccactgcactccagcctggcaacagagctagaatccgtctcaaacaaacaaacaaaaaatcccacagctattggatcatccacagattttttctttacaatcttgttctccttgtccatggaccatcaatagttgacttgccaggtttaattctttcattgcttgagaagaaaggaatcaaaggactgtgtgtagtaagctgacggtaaagttaagattaaattaagacagagagagaatacatatcactgccaggcctgataggaaaaatctgctcttccttttaataacagtgatgaattgtcaggaccttatttaggaaaccctgacctacccataactccctgctaggctaagtagaaaccaggttatttctccctgcttatggctccccgcaaagggacttgcagcgtgtcctgcaactttgtcttcagatagtgcttcctacaaaactaggtcttgttttgtaatcttttctcgtgttgaatcagatctgcttacttatttaggtttggttatgagcttgtatctcactgtatttctcatgctttgttcttttaaacaaatcctttaaactgtgtcattttgtatacacatgtgaggtttgaaaaaaaaaa

SEQ ID NO: 36583 - DNA, 430 bp, Homo sapiens
gtactttacaaacaaatacctccaaacactttgggattgaggctttttacagatggagagcagggcccagggaagaagcgatttgcccaaggtcacggctgaatcagaggcacagctggaaacactactcatgaatactggctcctggagtcggagctcatcaacaccagcctgccacctcccacacacaccaaaacaaaaccccaaagccggaaaacagcagcaggaagaaaagtcacctgccctccacagcccagggtgtccacactgacaatttgctgtacacattggaagctgggtgtgcaggtcagatatctctacagattgccattgctggacccaggagaatcagtcattaatgaaagctgaaagtgcactctgcatatttgggcagatcagctttccatcctgaacccccaggtgtatatgt

SEQ ID NO: 36584 - DNA, 355 bp, Homo sapiens
agctaaacaattttatgattctttgaccctaattcttagtctcaatgtcaataaagtggttcagatgagagggaagagttcaaacataagcaaacaagaagcctacgcatgccattttgcagaagcagatatttcagaaggaaaaggtttagccatttggttatttcttctggtccccccggggtggaggaaaaggatagggtagtttaatgacatggaccaatgaatggctgagaccatcccatctgtatttgttgactaagtgatgtggtgagcaagtggatgctacagatgaggatacatagcattatcctgccctcagagcgctttcaggcaagttagagatgcattcatg

SEQ ID NO: 36585 - DNA, 365 bp, Homo sapiens
ccaatttctgagctcagtgatacaacctgaagccttactttgtggcagaagcaacaagaccaacatctctgattttcagctctttggagcagcccccacctccttctaagggtggacttagccaggattccctaccagtccctcctccctactcttttttcccctattggccaatggtcccctactcagctaactggcagttcttccctctgtggagttgggttggtccctgatactggtctttgcaccaggaatttcagattgtcttggatgtcaatagttttcagtgccataaagaaaacaagctaaaagaatggagtttgtgttttcagtaagcaagaatcctcttaaagctgggcatggta

SEQ ID NO: 36586 - DNA, 457 bp, Homo sapiens
gcccagacgaggaggggcttaggcgtccacatccctggcttcgaaggagccagacgtttggatataatggaagagcgtgtcaggagtggcttccgttcctgtctccttcagcatcctgatggcgtacactgtggctctggctaactcctacggacgcctcatctctgagctcaaacgtcagagagagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctga

SEQ ID NO: 36587 - DNA, 1422 bp, Homo sapiens
gtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaagagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctgtgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagagagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctga

SEQ ID NO: 36588 - DNA, 1487 bp, Homo sapiens
gtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaagagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctgtgtggtccattccgggggcagtcgtccatctgggcccagatccctgagtctatttccagcctccctgagaccacccagaatttcctcttcttcctggggacccaggcttttgctgtgccccttctgctgatctccaggagccagacgtttggatataatggaagagcgtgtcaggagtggcttccgttcctgtctccttcagcatcctgatggcgtacactgtggctctggctaactcctacggacgcctcatctctgagctcaaacgtcagagagagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctga

SEQ ID NO: 36589 - DNA, 456 bp, Homo sapiens
gaaggaaagatggagctgggtgggtccagactcttggtttgggcggagaggggagcttggggtgctggaacactctcccaagggtatgaaagtttgaaaaacgaggacccccagagaaagtattgacagggtctcataggcttgcgatgtggagactcggacgcgtgggcctccaggtgcccgggtcccgagttctttctgatatatttcttccttcttcagtgctgggagactgtcctgggccaggaaatgtacaaacttctgctctttgatctgctgactgtcttggcagtcgcgctgctcatccagtttcctagaaagtgagagccccgccccttgctgtggccccgcccctctaggacgaggccgtgccccatcgcgctgttcttttcaccgcgcacctttttaccattcccgcctctgcctgctccctttgcttgccctaggtccgcagat

SEQ ID NO: 36590 - DNA, 1948 bp, Homo sapiens
gtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaagagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctgtgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagagagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctgaaaaaaaaaaaaaaaaaaaaaaaaaaaaaaaaaaaagaaaaaaaaacaaaaaaacaacgaaaaaaagaaacaaccgaagcagaacaagagacgcagaaccaacagaaaaagacgaacagggggtcagaggaaacaaaacaggcgcgagaagacaacagcgacacagcgctgaccgcaccgacgagacacaccacggggggggaaaacaggcagcaggcgaaggcaaaaaaccagaggggagcataagaaaaagacgaacaaaagatgcaacagcggcacggcagagtacccagccgcccccgtgcgtccgcccacagggagggtaatagacaaggcctcgtgcgaacaacacggacacagcggagggagatgcatcacgagccaagcagcggagacagaaacacacagccgagacgggggagcaataaagggggggggaccatattcgagaaacaacgcaccggacaatccggggcacccccatgggtggggcgagcccacaaggagtgagcgacccggaagccctg

SEQ ID NO: 36591 - DNA, 1442 bp, Homo sapiens
gtccacgtgcggctgcgccagcgcatcatcttgtacgaattaaaggtggagctggaggagacagtggtgcggcgccaggctgcggtgcggacgctgggccagcaagccagggtttggttggtgcgggtgctgctcaacctgctggtggtcgcgctcctgggggcagccttctatggcgtctactgggctacggggtgcaccgtggagctgcaggagatgccccttgtccaggagttgccactgctgaagcttcttggggtgaattaccttccgtccatcttcatcgctggggtcaattttgtgctgccgcccgtgttcaagctcattgctccactggagggctacactcggagtcgccagatcgtttttatcctgctcaggaccgtgtttcttcgcctcgcctccctggtggtcctgctcttctctctctggaatcagatcacttgtgggggcgactccgaggctgaggactgcaaaacctgtggctacaattacaaacaacttccgtgctgggagactgtcctgggccaggaaatgtacaaacttctgctctttgatctgctgactgtcttggcagtcgcgctgctcatccagtttcctagaaagctcctctgtggcctctgtcctggggcgctgggtcgtctggcggggacccaagagttccaggtgcccgacgaggtgctggggctcatctacgcgcagacggtggtctgggtggggagttttttctgccctttactgcccctgcttaacacggtcaagttcctgctgcttttctacctgaagaagcttaccctcttctccacctgctccccggctgcccgcaccttccgggcctccgcggcgaatttctttttccccttggtccttctcctgggtctggccatctccagcgttcccctgctttacagcatcttcctgatcccgccttctaagctgtgtggtccattccgggggcagtcgtccatctgggcccagatccctgagtctatttccagcctccctgagaccacccagaatttcctcttcttcctggggacccaggcttttgctgtgccccttctgctgatctccagcatcctgatggcgtacactgtggctctggctaactcctacggacgcctcatctctgagctcaaacgtcagagagagacggaggcgcagaataaagtcttcctggcacggcgcgctgtggcgctgacctccaccaaaccggctctttgacccccgcagcccacgtcccgctttcagaccccaggcccattgtaagcctaggtcacaacatctgtaaactaggagaactggagaagactccacgcccttccagctttggtatctggagatttccagggcccctcgccgccacgtccctgactctcgggtgatcttccttgtatcaataaatacagccgaggttgctgagcgcgctttgaaaaaaacgt

SEQ ID NO: 36592 - DNA, 343 bp, Homo sapiens
gctcaacctgctggtggtcgcgctcctgggggcagccttctatggcgtctactgggctacggggtgcaccgtggagctgcaggtgcggacggtcttggaagaggaagccagggggtcctggaacctacatttccaacggtggagggaggggacggaagtttgggatgccagagatcttagagaggaagtatgggagagggtatgttcggaccctggacttagggattttaaaggaaaaagagaggctgggcgcggtggcttacacctgtaatcccagcactttgggaggctgaggcgggcggatcacgatgtcaggagttccagaccagcctgaccaacatgg

SEQ ID NO: 36593 - DNA, 812 bp, Homo sapiens
tcttagaccttgcttcactcaacccaggagatttatgatcctgagttgttcagtgacaaaaaataccatttatcttgaacaaaatggggcactgactgttgaatttgacctgagctttgtaatcctggaaaaaggttaaggttaataaatccccttccctggctgggtggggtggctcacatctgtaatcccagcactttgggaggctgaggctagtggatcacctgatatcaggagttggagaccagcctgaccaacatggtgaaaccctgcctctactaaaaatacaaaaactagcagggtgtggtggcacatgcctgtggccccaggtacccaggaggctgaagcacgaggatcggttgaacctgggaggcggaggttgtggtgagccaagatcgcgccactgtactccagcctgggcaacagagtgagactctgtctcaaaaaaaagaaaaaaaagaaattcccctaccctttgtgttccggaaatgggcttattgcaaagaaccacacttccccctaggatttagataagattcacagatgtccctcttgttcacctatgccaaggccagaccctccaggttcccattgtctgcctcataaagactagttgaattgcttatgtccatggaatcaaaactgtaacagagtgctagttaatccaactttgattaagtttctccccttcccccaggctcctaaattttggctgcccctcagtctaaaagtccttccctaaatgcctctcccaaaaataggctcacctcaggataaaacattgtctgatctgctaaccagtcatgctaccc

SEQ ID NO: 36594 - DNA, 297 bp, Homo sapiens
tcttcttataaatcctccccatagggccattgcatgtgctgatctcactgcccagtacattcttgaccctgtcctctcccccttcttctagttaaattagctcatgtccctttctcagaaaagcccccttgacctttatgattcatcagagcttatgatttttttactgaaccctgaaaatctcctccccacaactctcaatgcaactatacattcattgacatgattacctgactgatgtttctcctccattagactgaatgcttcaataaacctatcaaaggaccaagagctttg

SEQ ID NO: 36595 - DNA, 532 bp, Homo sapiens
ctcccaaagtgctgggattacaggcatgagccaccgcactcggccaaagcacacctcttaaaaatgtttcaaacgtgttccttcctctcttggaccacatctgtagttcaggcttcagcatccctcccctagacaacttcacttccttcataagtggtcttccaacttgtccctcttaactccatcctccacagggtagccagcacgatctttccaaaaagcaaatctaaaactttcaatagctcctactgcccagagacacctagggtctgtgtggacactagttcattcgtcatctggtttcactttcatggctgagctaaatgtttcactaggtggtgatttgttcttggcaacaagatgatcttttgcaaatgagagtctcactgaccttgcagaagtgaaagtttactatacctttataaacagccttggctaatgtactagcatgactgctaaaagagcagtgactggaattttcatagtaaacaatgcagcatctcctaccctaatttccccagcaccaggggcc

SEQ ID NO: 36596 - DNA, 329 bp, Homo sapiens
ctgacattttatctggccaattctgtgttgttgggggctgtcctgtgcattgttggatgtttagcagcgtcactggcttctacctactagatgctgggagctcaagttgtgacaatcaaaaatgtctccagacattgctgagttgacccagttgagaacatgcaagtcattctctgagcgtgtaattgccttgtttttcagtgaaggccttggatagagtgaaaggcctcctgaccctgctgatagggagacaaactgccggcaaatgggagcctgggggatgggcagaggggtctggctacaggcacaggcattccctgagccttgtt

SEQ ID NO: 36597 - DNA, 373 bp, Homo sapiens
aaaaattttctacatacttttcttaccttgagttaaatgccctgcatatttaatcaggaaagtcctaaaagaatgtatgcatcctagaaattgctttcctaagtctcatttaaaattgacattgagttaatatattctctgttgagttgtagtaaatttgggcatttaggatgagcctattaaataggcctgggtagagggtaagctatggaatagaagtggggatataggatttatctaataaattttaactgaaagaatatttaagagttagataaaagggtgggcatggtggctcatgcctataatgccagcgctttgggaggccaagcccggtggatcacctgagatcaggagttcaaaaccagcctgg

SEQ ID NO: 36598 - DNA, 90 bp, Homo sapiens
ctttgacacaagtcaatacaagtctattccagcaccagacagtgaaatgcagacatcagcacatagttccatagtcaaggagactaagcg

SEQ ID NO: 36599 - DNA, 352 bp, Homo sapiens
gcaggcacccccacctagatgctgctgtggggcccacacagagtttgctcctgccggtggccaaaagcactcactttggctcctgcactgattcacctgcatgcttcctcccacaagcaggggactgcagcaggtcccagtgagtgaagtttgatcctaccgtgctgcagtgccgattccagcacagtgcactccagttcctgcctcatttgcttgcatgctcgctcctgcaaggagttgagagtggcaggctgaataaacgaggcacccgtcacaagtcccacaaaggggtcagggaaacatcctgcttcagttccatcaaaggcaatttaaaagcttatgcaaaaaaaaa

SEQ ID NO: 36600 - DNA, 413 bp, Homo sapiens
gtttgaggaaattattgctctattatagcagcaaaacaagacttcagggattttagtcatcttgcatttaatccagtgaaatttcatgtgtttcctataatgaatagagaatgaagagacatagaagctgtaaacaaagaaggttgccaagtaatttagttactaagaaggaacagcttgtcagataaaagtgtatttagctgttttagatgtgtgcacatacatatttttatcagtagtttcatacttcaaaaaatcacatcttaaaatagtattgctatttatttccatgcttagtgtttgaccctcatataataaaatttttaattacactttttttcactcataattctataatgcactttctaatgtttaccacactaccgtcaccaccactcccctccctcaagaag

SEQ ID NO: 36601 - DNA, 522 bp, Homo sapiens
ccctccccatgtggcctcatttaaccttaattacctttctccaaatacactcacattctgagatactgggcgttaggacttccacatacgaatttggtggtggagggagagcgatacaattcagtccataacaccctcctttcaggtgccaaagatataatagtccttagtctcaaggaggcctcaaagatttttgtatgagttgatgatgcttcacagagaaaagattctatcaagcagaggctgcactgaggctcatgcctgtaatcccagtactttgggaggtcaaggagggtggatcactggaggtcaggagtttgagaccagcctggccaacacaaagaaaccctgtctctactaaaaatagaaaaaattagccaggcgtggtggtgggggactgtaatcccagctactcaggaggctgaggcaggataattgcttgaacccgggaggcagaggttagaatgagctgagctcgtgcagttgcactcaagcctgggcgacagaataagattccatctc

SEQ ID NO: 36602 - DNA, 468 bp, Homo sapiens
tactccccaactacttgaggggctgaggtgggaggatcgctggagcccaagaggctgcagtgagccaagatcacaccactgcactccagcctgggtgacaaagtaagacctgtctcaaggaaaaaaaaaagaaaaaatttttaaagaaaaactccctgagcctcagtttcctcctgtgtacaccgagggtggtataagtacttatctcaggggttgtcatgaggattaaccgagttgacctgtgtggattgctcagcccagtgcctggcacataatgtttcataaacacaagtagtgagtaagtatttctcatgattgttcttgttaaacagatactgaacatttgctccaaatcatgccctgaactgaaggctagagacagggagggatgaatgacaaacactgaacacacaagttataatcaagacaggtgatcttactcacattgcttcacctgactagcctaaa

SEQ ID NO: 36603 - DNA, 950 bp, Homo sapiens
gtacctgggactatgggtgcatcccaccgcaccccgctgttagctgataatcctgcaggtcagaagtctagacaggcttgcctgggccctctgcttagtgtctcctgaggtcaaagtgaaggcattggccaaactgggctcctcccggaagcactggagaagaatctgcctccaggcccattcatgttgtcgtattgtcagcaaaatccagttcctgtggttgtgggcctgaggtctccatttccttgctagctgtctgctaggagttgctctctgttcctcaaggccattggtatttcttctcacatggcccctccacctttaaaccagtaatggcatggtgagtccttactcttcaattctctctgacttcctcttcagccaccagccagagaaaactgctattaaagggttcacctgtttgggtcagcccacctggataatctctgaattgtaaggtcagctgacttggggctttaattatacctgcaaaatcactttataacagttcctaaatttgtgtttaaatgaataatcagtggatggaaatccagggggaggagtatgaatgtctttagaattctgcctaccatttcttgtattagcatggaaatgactccaaatctgtagggactttaggcatacactactgcacctggcttgctggatggagtgtcttcaagcaaatatcagacatattgttgtacttgtatctcttattctatttatttatttattttgtagagatgaggtctcgctatgttgcctaggctggtgtcatgaactgacctcaagcaatcctcctgccacggcctctcaaagtgttgggattacaggcatgagccattgtgcctgaccaacagtaattctttaatgtcatttaattctcagtctatgttcagttatcttgagttatctcaaaagtgttttttacagttagttggcttaaa

SEQ ID NO: 36604 - DNA, 304 bp, Homo sapiens
tatgtctcaaaatggcagaaattacacctcggtgccaagcagtagttcctgatcttttaaaattcaaatctattttacagtaataaataatgttatgatcccctctaaggaactaaagtcattatgttatttctgcaaagtagttaggaaataaagaaattattttaggtttttaaaaatcaacttaatgccaggtgcagtggctcatgcctataactgtagcactttgggaggccaaggtgagagattgcttgaggtcaggagttcaagaccagcctgggcaacatagcgagacctcatctct

SEQ ID NO: 36605 - DNA, 533 bp, Homo sapiens
gcctactactactaaattcgcggccgcgtcgacattaattagtttttgcctgtctttagagaagcagatcattgatcattgtgaatttgtactgcaaatactgtatagattattagctcacctgacaattatagttggaccccttctaataagatgatgcaaaaggcctgtccaagtattagcagttgctattattgctgagcacagaaactctgcatgagtgccccttattttaaaaacagcccaatggctgggcacagtggcttacacctataatcccagcactttgggaggccaagacaggcagattaattgaggccaggagtttgagaccagcttggccaacatggtaaaaccctgtctctaccaaaaatacaaaaatcagccaggcatagtggcacatgcctgtaatcccagctatatgggaagctgaggtgtgagaatcgtgtgaacccagcaagtggaggctgcagtgagccaagaacacgccactgccctccagcctgggcaacagagcaagactctgtctcaga

SEQ ID NO: 36606 - DNA, 385 bp, Homo sapiens
actctttgtatctgcgcttctgtttctcttgccacctactctctcctccctttctcagcctccctgtctgctgtctgggtgctcttctctgcagcttcctcacccttcatatatagtcccttgtcacattggttcctggctctggctacccactacttcctcccctttgccacttctccccagtgttcatgtacacctttcagccacatcattctcctggctgcttcctgctcatgcctgtcaaggtcacctgcatgccactgcttttgctttgtcctggccttttcccttcaccctttacttagccctttcccactgcctttaggtatagaggaagcattaattagtttttgcctgtctttagagaagcagatcattgatcatt

SEQ ID NO: 36607 - DNA, 259 bp, Homo sapiens
taaatgctcctggacttagtacaaccccctacgcgcagggcctaaaagagctaaatcaaggcatcatttccttactgctgccatcatctgacatgggaggaggggaccagagtcaaacagcggaggtgggaatgacacaggaagatccagagacacgtggaagactccgagagctgcaagaaatgacatctgggaggccaggcatggtggctcatgactgtgatctcagaacttacggaaggcaaggcggacggatcac

SEQ ID NO: 36608 - DNA, 283 bp, Homo sapiens
tgtagaaatgaggggggtttgcctgtttcccaggctggtctccaactcttaggctcatgcagtcttcctgccttggcctcccaaaatgctgggattacaggcgatagtcactgtgcctggcccagtctgagtttttgtcatgatgtgtgttgacttttgtgagatgtattttctgcatctattgagatataagctttttgtccgttatttcttaatatattgaattatactggctgatttttgagtattaaactattgttattctcttggaataaactctgtc

SEQ ID NO: 36609 - DNA, 308 bp, Homo sapiens
gctattctctgagatactctctgatccttgtctgtgttgaattttctttctctctgatgtctactccatagactgccagaaaaacctgttgatcaaacaaagctgtttattagcttattacagtaagagaaaacccactttgactgtgtcttagtaatatctcacaagggagaagtcaggagaggatattcataaagttttaggacctgggctaggtgattttgaggttggtcttgcgtggtagaaaactggttgttattgaacaaagttcattacttaagagttttggattggcagccttaagacag

SEQ ID NO: 36610 - DNA, 411 bp, Homo sapiens
cacacagctgggattcaaacccaggtctgtctggctgtctccctcacagggtggcatgcagcctggctgcaggcagcttgcccatctacctgaggctttggctgtgcgtctgtgatgtggtttcaggcccgagcaccatgtctgctgtgtgtctagctgggctctccctctgtcttggaccctgtctcttctgcagggcgacagggctcgggcctccctcagaagcacccccacctctgttgcaggtgctttctgcacgtcttttctccctcactatagagtacgttcttggaagtcaaaacctgtgtctactccacctctctcccctgcagctaggcccacccagcacagggcctgggacagatggggccccaatcaatattttctgagtaaacacatgaatgggcaaga

SEQ ID NO: 36611 - DNA, 355 bp, Homo sapiens
ggctcatggtgtgaactagcaagaaaaagaaaacacactgaaaactgacatttccaacaagtataaaatgtttaaagaaatgcaggggagagaccatttagaaaagcctcagatggcagccatcatctcataaccagctgttttaaaaattcttatgacacactgagaacctgaaaaattccactgtacttcattttttcccttttactatatcaaagtatgggtacataagctgcctagcaaaacaatccaaggagctctatcttgtggaaaaagtagctagtatagatcagctattgtagttactagatactggatgtcttccagaagagatgaaaaaaataacaattctatt

SEQ ID NO: 36612 - DNA, 372 bp, Homo sapiens
gaaattaaactttactaatactgaaaatatggattgaggctgccatatcgtgtctgttttatgtcagacagccccacatcatgtacactcaagccaggtcaggtgaggatggagggactttgcacttttcagaggatccaagtgccctcagcttgcttcttcacttcctgcatattgtctcatgttgcccttcactcagcatgtgacatgaatttattgattttattctcttccttactctgacagaatggacaagcaacttaaaagtattcctctccaagaattgcgtgaaccgggaggcggagcttgcagtgagccgagatcgcaccactgcactccagcctgggagacagagccagactccgtctaaaa

SEQ ID NO: 36613 - DNA, 147 bp, Homo sapiens
aatattgattttaaggtaatcacagctgagatgtagttcatatttctaataattttctcagcaatactgttttatttctcacctagaagtaaaagcatgtgtaaatgtattaaaattgtatattttggtggtatggtttctatattt

SEQ ID NO: 36614 - DNA, 444 bp, Homo sapiens
ccaagaactgggaaaaaatttgtatgcaacagcagttgtggttacccacgcctaaaaataatgcctaaatgccttaaagtcattttaaataatgtgattataggcattctttctggtagataatatggatgtttgactcatttcttattcttatttctttgattcttgaagagatatgaatgaacacaagaggcacattttctgaagcagagccctagaattcctctcacatactactctcatcatgataaaaaagaaatcactactgatggatgactcctgtactctgtgagacatcaagccctattagtcactcatttatgccatttaaatgctggattttgttttcagtgctgcaggcccattaccaaagagggcccagctgttacttttttgctttggggacattctctgcaaattcaatgggttttgcttcaattcaga

SEQ ID NO: 36615 - DNA, 376 bp, Homo sapiens
tgtgccaccagctgccccctcctctagcatcctcatgcccgacattgagcaactgtgtgcttcaggcatggtgctgggtgctggggaggcaaagatggtcaagatagagttcctcttctggattatgtcacaggggagaaagacaagtccatttattcatgcacgcatttaaaagtgaagcaccaatcatattcaggcctcggatgcagagcaaataaacgacccgctccagcaacttgggacaagtgcttggtcagcacacaggacctccatggtagcacaagggagagagtgagggcatgatcctgccccagctgcctggaggctgcacccccagagaagcatgttcaaagcacagagctccttcccactcccc

SEQ ID NO: 36616 - DNA, 4191 bp, Homo sapiens
ttgattctgggcactgaaagcagtacttggctgcagacactcgtttcaaacaggccccatttttccatctctgctgctgttattaggggagcccttagactctcttgcagcgccggaataggcgctcaagacgtgtgttaatattgcaacagcaaatataatgaatctgcagttggggacgctgaggccggagtggtggatgaaaggtggccggagccttttccacgggtccaaaccacctgttacaggagaaggcgagcggcctcgctaagcaactggacgttccgcgggcggggcgggggcggggccggggcccgagtccgctcggaaactttcgctgtgggcgagccggacccgccttctggcccctcgggcccaaccacgcagggggagtgccgggccgcagctaggcgaggcgcaccgtgattggcggagatgtggagtgattggcggctacaccggccactcagcaggccgagctggcgccgcatccggggggccgcgtctggagtggagggaggccgaaggccccgcccctgccccgccccctcgtgcagaaggccgcgctagccggctcttcagcagcgagtgcagattgctcccccgcggccgcagatctcccgtttgcgccgcgttcagctgctcccgaacaacttttctgccggcccagaggccccagggcgtcgcagcgccgcgtgcggcccactcacgggccggcaggatggactccaacactgctccgctgggcccctcctgcccacagcccccgccagcaccgcagccccaggcgcgttcccgactcaatgccacagcctcgttggagcaggagaggagcgaaaggccccgagcacccggaccccaggctggccctggccctggtgttagagacgcagcggcccccgctgaaccccaggcccagcataccaggagccgggaaagagcagacggcaccgggcctacaaagggagacatggaaatcccctttgaagaagtcctggagagggccaaggccggggaccccaaggcacagactgaggtggggaagcactacctgcagttggccggcgacacggatgaagaactcaacagctgcaccgctgtggactggctggtcctcgccgcgaagcagggccgtcgcgaggctgtgaagctgcttcgccggtgcttggcggacagaagaggcatcacgtccgagaacgaacgggaggtgaggcagctctcctccgagaccgacctggagagggccgtgcgcaaggcagccctggtcatgtactggaagctcaaccccaagaagaagaagcaggtggccgtggcggagctgctggagaatgtcggccaggtcaacgagcacgatggaggggcgcagccaggccccgtgcccaagtccctgcagaagcagaggcggatgctggagcgcctggtcagcagcgagtccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcatcagcaacctcaccatcgacttcttcgccttcttcatcccgctggtcatcttctacctgtccttcatctccatggtgatctgcaccctcaaggtgttccaggacagcaaggcctgggagaacttccgcaccctcaccgacctgctgctgcgcttcgagcccaacctggatgtggagcaggccgaggttaacttcggctggaaccacctggagccctatgcccatttcctgctctctgtcttcttcgtcatcttctccttccccatcgccagcaaggactgcatcccctgctcggagctggctgtcatcaccggcttctttaccgtgaccagctacctgagcctgagcacccatgcagagccctacacgcgcagggccctggccaccgaggtcaccgccggcctgctatcgctgctgccctccatgcccttgaattggccctacctgaaggtccttggccagaccttcatcaccgtgcctgtcggccacctggtcgtcctcaatgtcagcgtcccgtgcctgctctatgtctacctgctctatctcttcttccgcatggcacagctgaggaatttcaagggcacctactgctaccttgtgccctacctggtgtgcttcatgtggtgtgagctctccgtggtcatcctgctggagtccaccggcctggggctgctccgcgcctccatcggctacttcctcttcctctttgccctccccatcctggtggccggcctggccctggtgggcgtgctgcagttcgcccggtggttcacgtctctggagctcaccaagatcgcagtcaccgtggcggtctgtagtgtgcccctgctgttgcgctggtggaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaaaagcgtgctgctcagcctgcgccagggcagcctcatcgagttcagcaccatcctggagggccgcctgggcagcaagtggcctgtcttcgagctcaaggccatcagctgcctcaactgcatggcccagctctcgcccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcccttccccagtgtggccccagcccgacaggcatgcaccagtgccgtctgtgcccacgtgtgcagactgtggctgcagagaccttgcgaccatgtgtagattgcatggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctccacagtagcatttcttatttgtttggtcactgctacaccttagcagctcttcccctttcctgggggatgtgcacggcagcttgagcctgtcacgtggtcaaggcccggccccatcagaggctgggggaggcggcacattggcagtgtgtcacactgagctgggcaccacaggctgcctcatgaccctcctctccagcaggtagtgggtgaatgtgtgaaggtcttgcctgaatccatcaggacttgggaaacagagaaccctgtgggggtggctgtgggggaggtccctgccagtgtttagaagagcctgactgtgttcagtgccttggagcagaaagccagggtcctgagtggctgaaataaaagcctctggtggaacctgca

SEQ ID NO: 36617 - DNA, 630 bp, Homo sapiens
gcagagagggacacttggggtgggggacagcacacccaggggccgggggccagggtggaggctggcacttggcaaacctgcccccttcctcctcacccagcctggtcctcaaccctcaggccgcccagggaagggtttcctccacctgaacccactcagctcctttcttagcttggccccacgccaccgtccccagcccattgctctgtgtgagggtggcagtggggctgcagtgtggggcgcccatgctgttttctctcatgcttcagccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcatcagcaaccgcatcacccgttcacgggtgatgcggttgcgcttatagaagtaggagcaggtggtggatcttaggaa

SEQ ID NO: 36618 - DNA, 273 bp, Homo sapiens
gcggccgcttactactactactactactaaattcgcggccgcgtcgactgggcaccacaggctgcctcatgaccctcctctccagcaggtagtgggtgaatgtgtgaaggtcttgcctgaatccatcaggacttgggaaacagagaaccctgtgggggtggctgtgggggaggtccctgccagtgtttagaagagcctgactgtgttcagtgccttggagcagaaagccagggtcctgagtggctgaaataaaagcctctggtggaacctgca

SEQ ID NO: 36619 - DNA, 4336 bp, Homo sapiens
ttgattctgggcactgaaagcagtacttggctgcagacactcgtttcaaacaggccccatttttccatctctgctgctgttattaggggagcccttagactctcttgcagcgccggaataggcgctcaagacgtgtgttaatattgcaacagcaaatataatgaatctgcagttggggacgctgaggccggagtggtggatgaaaggtggccggagccttttccacgggtccaaaccacctgttacaggagaaggcgagcggcctcgctaagcaactggacgttccgcgggcggggcgggggcggggccggggcccgagtccgctcggaaactttcgctgtgggcgagccggacccgccttctggcccctcgggcccaaccacgcagggggagtgccgggccgcagctaggcgaggcgcaccgtgattggcggagatgtggagtgattggcggctacaccggccactcagcaggccgagctggcgccgcatccggggggccgcgtctggagtggagggaggccgaaggccccgcccctgccccgccccctcgtgcagaaggccgcgctagccggctcttcagcagcgagtgcagattgctcccccgcggccgcagatctcccgtttgcgccgcgttcagctgctcccgaacaacttttctgccggcccagaggccccagggcgtcgcagcgccgcgtgcggcccactcacgggccggcaggatggactccaacactgctccgctgggcccctcctgcccacagcccccgccagcaccgcagccccaggcgcgttcccgactcaatgccacagcctcgttggagcaggagaggagcgaaaggccccgagcacccggaccccaggctggccctggccctggtgttagagacgcagcggcccccgctgaaccccaggcccagcataccaggagccgggaaagagcagacggcaccgggcctacaaagggagacatggaaatcccctttgaagaagtcctggagagggccaaggccggggaccccaaggcacagactgaggtggggaagcactacctgcagttggccggcgacacggatgaagaactcaacagctgcaccgctgtggactggctggtcctcgccgcgaagcagggccgtcgcgaggctgtgaagctgcttcgccggtgcttggcggacagaagaggcatcacgtccgagaacgaacgggaggtgaggcagctctcctccgagaccgacctggagagggccgtgcgcaaggcagccctggtcatgtactggaagctcaaccccaagaagaagaagcaggtggccgtggcggagctgctggagaatgtcggccaggtcaacgagcacgatggaggggcgcagccaggccccgtgcccaagtccctgcagaagcagaggcggatgctggagcgcctggtcagcagcgagtccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcatcagcaacctcaccatcgacttcttcgccttcttcatcccgctggtcatcttctacctgtccttcatctccatggtgatctgcaccctcaaggtgttccaggacagcaaggcctgggagaacttccgcaccctcaccgacctgctgctgcgcttcgagcccaacctggatgtggagcaggccgaggttaacttcggctggaaccacctggagccctatgcccatttcctgctctctgtcttcttcgtcatcttctccttccccatcgccagcaaggactgcatcccctgctcggagctggctgtcatcaccggcttctttaccgtgaccagctacctgagcctgagcacccatgcagagccctacacgcgcagggccctggccaccgaggtcaccgccggcctgctatcgctgctgccctccatgcccttgaattggccctacctgaaggtccttggccagaccttcatcaccgtgcctgtcggccacctggtcgtcctcaatgtcagcgtcccgtgcctgctctatgtctacctgctctatctcttcttccgcatggcacagctgaggaatttcaagggcacctactgctaccttgtgccctacctggtgtgcttcatgtggtgtgagctctccgtggtcatcctgctggagtccaccggcctggggctgctccgcgcctccatcggctacttcctcttcctctttgccctccccatcctggtggccggcctggccctggtgggcgtgctgcagttcgcccggtggttcacgtctctggagctcaccaagatcgcagtcaccgtggcggtctgtagtgtgcccctgctgttgcgctggtggaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaaaagcgtgctgctcagcctgcgccagggcagcctcatcgagttcagcaccatcctggagggccgcctgggcagcaagtggcctgtcttcgagctcaaggccatcagctgcctcaactgcatggcccagctctcgcccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcccttccccagtgtggccccagcccgacaggcatgcaccagtgccgtctgtgcccacgtgtgcagactgtggctgcagagaccttgcgaccatgtgtagattgcatggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctccacagtagcatttcttatttgtttggtcactgctacaccttagcagctcttcccctttcctgggggatgtgcacggcagcttgagcctgtcacgtggtcaaggcccggccccatcagaggctgggggaggcggcacattggcagtgtgtcacactgagctgggcaccacaggctgcctcatgaccctcctctccagcaggtagtgggtgaatgtgtgaaggtcttgcctgaatccatcaggacttgggaaacagagaaccctgtgggggtggctgtgggggaggtccctgccagtgtttagaagagcctgactgtgttcagtgccttggagcagaaagccagggtcctgagtggctgaaataaaagcctctggtggaacctgcaaagaaccagcagcacaaaagcaagcagcagcaagacacaccaaacgcacaacagcaagccacacacagacacacagacacacagaaacacacacgaccccacgcgaccgcccccagccgccgcagaggagagacaacgacaacag

SEQ ID NO: 36620 - DNA, 3027 bp, Homo sapiens
gcagagagggacacttggggtgggggacagcacacccaggggccgggggccagggtggaggctggcacttggcaaacctgcccccttcctcctcacccagcctggtcctcaaccctcaggccgcccagggaagggtttcctccacctgaacccactcagctcctttcttagcttggccccacgccaccgtccccagcccattgctctgtgtgagggtggcagtggggctgcagtgtggggcgcccatgctgttttctctcatgcttcagccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcatcagcaacctcaccatcgacttcttcgccttcttcatcccgctggtcatcttctacctgtccttcatctccatggtgatctgcaccctcaaggtgttccaggacagcaaggcctgggagaacttccgcaccctcaccgacctgctgctgcgcttcgagcccaacctggatgtggagcaggccgaggttaacttcggctggaaccacctggagccctatgcccatttcctgctctctgtcttcttcgtcatcttctccttccccatcgccagcaaggactgcatcccctgctcggagctggctgtcatcaccggcttctttaccgtgaccagctacctgagcctgagcacccatgcagagccctacacgcgcagggccctggccaccgaggtcaccgccggcctgctatcgctgctgccctccatgcccttgaattggccctacctgaaggtccttggccagaccttcatcaccgtgcctgtcggccacctggtcgtcctcaatgtcagcgtcccgtgcctgctctatgtctacctgctctatctcttcttccgcatggcacagctgaggaatttcaagggcacctactgctaccttgtgccctacctggtgtgcttcatgtggtgtgagctctccgtggtcatcctgctggagtccaccggcctggggctgctccgcgcctccatcggctacttcctcttcctctttgccctccccatcctggtggccggcctggccctggtgggcgtgctgcagttcgcccggtggttcacgtctctggagctcaccaagatcgcagtcaccgtggcggtctgtagtgtgcccctgctgttgcgctggtggaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaaaagcgtgctgctcagcctgcgccagggcagcctcatcgagttcagcaccatcctggagggccgcctgggcagcaagtggcctgtcttcgagctcaaggccatcagctgcctcaactgcatggcccagctctcgcccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcccttccccagtgtggccccagcccgacaggcatgcaccagtgccgtctgtgcccacgtgtgcagactgtggctgcagagaccttgcgaccatgtgtagattgcatggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctccacagtagcatttcttatttgtttggtcactgctacaccttagcagctcttcccctttcctgggggatgtgcacggcagcttgagcctgtcacgtggtcaaggcccggccccatcagaggctgggggaggcggcacattggcagtgtgtcacactgagctgggcaccacaggctgcctcatgaccctcctctccagcaggtagtgggtgaatgtgtgaaggtcttgcctgaatccatcaggacttgggaaacagagaaccctgtgggggtggctgtgggggaggtccctgccagtgtttagaagagcctgactgtgttcagtgccttggagcagaaagccagggtcctgagtggctgaaataaaagcctctggtggaacctgca

SEQ ID NO: 36621 - DNA, 1819 bp, Homo sapiens
aacggtacaatagagcaaatgacaggccggtggtgaatcggacgaggctctttgccctccccatcctggtggccggcctggccctggtgggcgtgctgcagttcgcccggtggttcacgtctctggagctcaccaagatcgcagtcaccgtggcggtctgtagtgtgcccctgctgttgcgctggtggaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaaaagcgtgctgctcagcctgcgccagggcagcctcatcgagttcagcaccatcctggagggccgcctgggcagcaagtggcctgtcttcgagctcaaggccatcagctgcctcaactgcatggcccagctctcgcccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcccttccccagtgtggccccagcccgacaggcatgcaccagtgccgtctgtgcccacgtgtgcagactgtggctgcagagaccttgcgaccatgtgtagattgcatggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctccacagtagcatttcttatttgtttggtcactgctacaccttagcagctcttcccctttcctgggggatgtgcacggcagcttgagcctgtcacgtggtcaaggcccggccccatcagaggctgggggaggcggcacattggcagtgtgtcacactgagctgggcaccacaggctgcctcatgaccctcctctccagcaggtagtgggtgaatgtgtgaaggtcttgcctgaatccatcaggacttgggaaacagagaaccctgtgggggtggctgtgggggaggtccctgccagtgtttagaagagcctgactgtgttcagtgccttggagcagaaagccagggtcctgagtggctgaaataaaagcctctggtggaacctgca

SEQ ID NO: 36622 - DNA, 1661 bp, Homo sapiens
caacatgtgcaatagcagggcacactacagaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaaaagcgtgctgctcagcctgcgccagggcagcctcatcgagttcagcaccatcctggagggccgcctgggcagcaagtggcctgtcttcgagctcaaggccatcagctgcctcaactgcatggcccagctctcgcccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcccttccccagtgtggccccagcccgacaggcatgcaccagtgccgtctgtgcccacgtgtgcagactgtggctgcagagaccttgcgaccatgtgtagattgcatggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcaccctgttccctctttctttcttttgtgttggatttgtttaaaaaccaaataagcatctgtgtaacctccacagtagcatttcttatttgtttggtcactgctacaccttagcagctcttcccctttcctgggggatgtgcacggcagcttgagcctgtcacgtggtcaaggcccggccccatcagaggctgggggaggcggcacattggcagtgtgtcacactgagctgggcaccacaggctgcctcatgaccctcctctccagcaggtagtgggtgaatgtgtgaaggtcttgcctgaatccatcaggacttgggaaacagagaaccctgtgggggtggctgtgggggaggtccctgccagtgtttagaagagcctgactgtgttcagtgccttggagcagaaagccagggtcctgagtggctgaaataaaagcctctggtggaacctgca

SEQ ID NO: 36623 - DNA, 3941 bp, Homo sapiens
ttgattctgggcactgaaagcagtacttggctgcagacactcgtttcaaacaggccccatttttccatctctgctgctgttattaggggagcccttagactctcttgcagcgccggaataggcgctcaagacgtgtgttaatattgcaacagcaaatataatgaatctgcagttggggacgctgaggccggagtggtggatgaaaggtggccggagccttttccacgggtccaaaccacctgttacaggagaaggcgagcggcctcgctaagcaactggacgttccgcgggcggggcgggggcggggccggggcccgagtccgctcggaaactttcgctgtgggcgagccggacccgccttctggcccctcgggcccaaccacgcagggggagtgccgggccgcagctaggcgaggcgcaccgtgattggcggagatgtggagtgattggcggctacaccggccactcagcaggccgagctggcgccgcatccggggggccgcgtctggagtggagggaggccgaaggccccgcccctgccccgccccctcgtgcagaaggccgcgctagccggctcttcagcagcgagtgcagattgctcccccgcggccgcagatctcccgtttgcgccgcgttcagctgctcccgaacaacttttctgccggcccagaggccccagggcgtcgcagcgccgcgtgcggcccactcacgggccggcaggatggactccaacactgctccgctgggcccctcctgcccacagcccccgccagcaccgcagccccaggcgcgttcccgactcaatgccacagcctcgttggagcaggagaggagcgaaaggccccgagcacccggaccccaggctggccctggccctggtgttagagacgcagcggcccccgctgaaccccaggcccagcataccaggagccgggaaagagcagacggcaccgggcctacaaagggagacatggaaatcccctttgaagaagtcctggagagggccaaggccggggaccccaaggcacagactgaggtggggaagcactacctgcagttggccggcgacacggatgaagaactcaacagctgcaccgctgtggactggctggtcctcgccgcgaagcagggccgtcgcgaggctgtgaagctgcttcgccggtgcttggcggacagaagaggcatcacgtccgagaacgaacgggaggtgaggcagctctcctccgagaccgacctggagagggccgtgcgcaaggcagccctggtcatgtactggaagctcaaccccaagaagaagaagcaggtggccgtggcggagctgctggagaatgtcggccaggtcaacgagcacgatggaggggcgcagccaggccccgtgcccaagtccctgcagaagcagaggcggatgctggagcgcctggtcagcagcgagtccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcatcagcaacctcaccatcgacttcttcgccttcttcatcccgctggtcatcttctacctgtccttcatctccatggtgatctgcaccctcaaggtgttccaggacagcaaggcctgggagaacttccgcaccctcaccgacctgctgctgcgcttcgagcccaacctggatgtggagcaggccgaggttaacttcggctggaaccacctggagccctatgcccatttcctgctctctgtcttcttcgtcatcttctccttccccatcgccagcaaggactgcatcccctgctcggagctggctgtcatcaccggcttctttaccgtgaccagctacctgagcctgagcacccatgcagagccctacacgcgcagggccctggccaccgaggtcaccgccggcctgctatcgctgctgccctccatgcccttgaattggccctacctgaaggtccttggccagaccttcatcaccgtgcctgtcggccacctggtcgtcctcaatgtcagcgtcccgtgcctgctctatgtctacctgctctatctcttcttccgcatggcacagctgaggaatttcaagggcacctactgctaccttgtgccctacctggtgtgcttcatgtggtgtgagctctccgtggtcatcctgctggagtccaccggcctggggctgctccgcgcctccatcggctacttcctcttcctctttgccctccccatcctggtggccggcctggccctggtgggcgtgctgcagttcgcccggtggttcacgtctctggagctcaccaagatcgcagtcaccgtggcggtctgtagtgtgcccctgctgttgcgctggtggaccaaggccagcttctctgtggtggggatggtgaagtccctgacgcggagctccatggtcaagctcatcctggtgtggctcacggccatcgtgctgttctgctggttctatgtgtaccgctcagagggcatgaaggtctacaactccacactgacctggcagcagtatggtgcgctgtgcgggccacgcgcctggaaggagaccaacatggcgcgcacccagatcctctgcagccacctggagggccacagggtcacgtggaccggccgcttcaagtacgtccgcgtgactgacatcgacaacagcgccgagtctgccatcaacatgctcccgttcttcatcggcgactggatgcgctgcctctacggcgaggcctaccctgcctgcagccctggcaacacctccacggccgaggaggagctctgtcgccttaagctgctggccaagcacccctgccacatcaagaagttcgaccgctacaagtttgagattaccgtgggcatgccattcagcagcggcgctgacggctcgcgcagccgcgaggaggacgacgtcaccaaggacatcgtgctgcgggccagcagcgagttcaaaagcgtgctgctcagcctgcgccagggcagcctcatcgagttcagcaccatcctggagggccgcctgggcagcaagtggcctgtcttcgagctcaaggccatcagctgcctcaactgcatggcccagctctcgcccaccaggcggcacgtgaagatcgagcacgactggcgcagcaccgtgcatggcgccgtgaagttcgccttcgacttctttttcttcccattcctgtcggcggcctgaggatggtccgccacgaggagcttccagtgcatgttgccatgaggcccttccccagtgtggccccagcccgacaggcatgcaccagtgccgtctgtgcccacgtgtgcagactgtggctgcagagaccttgcgaccatgtgtagattgcatggaccccgacaaagggaaggctgctgtgtagctctgtccactctgaataccaagtgtgttgggaattgcatgccatctccaccctgagcctgacctttctgagtgacatgggtgtgccaggctagactaggaggttccggtgtctggaaaagcactttacagatgagattccctctcctcccccaccttcaagcacccctcctctccagcaggtagtgggtgaatgtgtgaaggtcttgcctgaatccatcaggacttgggaaacagagaaccctgtgggggtggctgtgggggaggtccctgccagtgtttagaagagcctgactgtgttcagtgccttggagcagaaagccagggtcctgagtggctgaaataaaagcctctggtggaacctgca

SEQ ID NO: 36624 - DNA, 1794 bp, Homo sapiens
ttgattctgggcactgaaagcagtacttggctgcagacactcgtttcaaacaggccccatttttccatctctgctgctgttattaggggagcccttagactctcttgcagcgccggaataggcgctcaagacgtgtgttaatattgcaacagcaaatataatgaatctgcagttggggacgctgaggccggagtggtggatgaaaggtggccggagccttttccacgggtccaaaccacctgttacaggagaaggcgagcggcctcgctaagcaactggacgttccgcgggcggggcgggggcggggccggggcccgagtccgctcggaaactttcgctgtgggcgagccggacccgccttctggcccctcgggcccaaccacgcagggggagtgccgggccgcagctaggcgaggcgcaccgtgattggcggagatgtggagtgattggcggctacaccggccactcagcaggccgagctggcgccgcatccggggggccgcgtctggagtggagggaggccgaaggccccgcccctgccccgccccctcgtgcagaaggccgcgctagccggctcttcagcagcgagtgcagattgctcccccgcggccgcagatctcccgtttgcgccgcgttcagctgctcccgaacaacttttctgccggcccagaggccccagggcgtcgcagcgccgcgtgcggcccactcacgggccggcaggatggactccaacactgctccgctgggcccctcctgcccacagcccccgccagcaccgcagccccaggcgcgttcccgactcaatgccacagcctcgttggagcaggagaggagcgaaaggccccgagcacccggaccccaggctggccctggccctggtgttagagacgcagcggcccccgctgaaccccaggcccagcataccaggagccgggaaagagcagacggcaccgggcctacaaagggagacatggaaatcccctttgaagaagtcctggagagggccaaggccggggaccccaaggcacagactgaggtggggaagcactacctgcagttggccggcgacacggatgaagaactcaacagctgcaccgctgtggactggctggtcctcgccgcgaagcagggccgtcgcgaggctgtgaagctgcttcgccggtgcttggcggacagaagaggcatcacgtccgagaacgaacgggaggtgaggcagctctcctccgagaccgacctggagagggccgtgcgcaaggcagccctggtcatgtactggaagctcaaccccaagaagaagaagcaggtggccgtggcggagctgctggagaatgtcggccaggtcaacgagcacgatggaggggcgcagccaggccccgtgcccaagtccctgcagaagcagaggcggatgctggagcgcctggtcagcagcgagtccaagaactacatcgcgctggatgactttgtggagatcactaagaagtacgccaagggcgtcatccccagcagcctgttcctgcaggacgacgaagatgatgacgagctggcggggaagagccctgaggacctgccactgcgtctgaaggtggtcaagtaccccctgcacgccatcatggagatcaaggagtacctgattgacatggcctccagggcaggcatgcactggctgtccaccatcatccccacgcaccacatcaacgcgctcatcttcttcttcatcatcagcaaccgcatcacccgttcacgggtgatgcggttgcgcttatagaagtaggagcaggtggtggatcttaggaa

SEQ ID NO: 36625 - DNA, 1255 bp, Homo sapiens
atcaatattattgcagaccaggactctgcttatatgccttgctaacaaagatttctttcacagaggcttttctcctctcaagacttaaagtaagaattacattttattaagtcagttaaatgcaccatggcttcatatagtaatataaaaaaactctttgaagtgagaaatattatatcctaaaacctctaaaccacaaacattcaattgaaagagttctgttgaaggataatgacatactgactgcttacagaccaagttgcttgcattttgtatgtttagccctcctttgccactgcttttagagccttggaaggctaagtgtgatagtaatgctagctctaatgcatatttaaaggagactgcctcgcttttagaagacatctggtctgctctctgcatgaggcacagcagtaaagctctttgattcccagaatcaagaactctccccttcagactattaccgaatgcaaggtggttaattgaaggccactaattgatgctcaaatagaaggatattgactatattggaacagatggagtctctactacaaaagtctttgggtatttgtttcttacatagaaaatgctaacatgaatagaaagatactggtgcaagaccattcccgggaaagtagacatacttacatttttttccttttctgctcatttgaatgaactcaattttatgttaaattgttatatcagagtgacaaataagtgctatggcttgatagaagtgaagctcttcacatatattcaaaatacatatcacaaactttggtaaataggatagtaatctgaagaacttttgccctttttaccccatttactgtaactcttgtttctaggtaatcgttctctctcaacaaacttctcaagcgtctgtgtaacaagccacatgttctaacaaattgtctccatcgcacttcaacagccaggtccctattttttataacgtattaaccttattattttcttattattttaaaagaatctatgcacattagcaaaatttaaaagatagagaaaaatataaacagaaaaaattatgtttacttctaccaccctaaatcaactattatcaattttatacatattttactccatcttttttcaaagtttcttacattttccaatgtcattaaaattctctgtgaatgtaaattttaaaaactgtacctactgttttttggaaatctgtaacaagctatgtgtaatcattcttctaatattaaacatattgtgtccagaa

SEQ ID NO: 36626 - DNA, 1201 bp, Homo sapiens
atcaatattattgcagaccaggactctgcttatatgccttgctaacaaagatttctttcacagaggcttttctcctctcaagacttaaagtaagaattacattttattaagtcagttaaatgcaccatggcttcatatagtaatataaaaaaactctttgaagtgagaaatattatatcctaaaacctctaaaccacaaacattcaattgaaagagttctgttgaaggataatgacatactgactgcttacagaccaagttgcttgcattttgtatgtttagccctcctttgccactgcttttagagccttggaaggctaagtgtgatagtaatgctagctctaatgcatatttaaaggagactgcctcgcttttagaagacatctggtctgctctctgcatgaggcacagcagtaaagctctttgattcccagaatcaagaactctccccttcagactattaccgaatgcaaggtggttaattgaaggccactaattgatgctcaaatagaaggatattgactatattggaacagatggagtctctactacaaaagtctttgggtatttgtttcttacatagaaaatgctaacatgaatagaaagatactggtgcaagaccattcccgggaaagtagacatacttacatttttttccttttctgctcatttgaatgaactcaattttatgttaaattgttatatcagagtgacaaataagtgctatggcttgatagaagtgaagctcttcacatatattccctttttaccccatttactgtaactcttgtttctaggtaatcgttctctctcaacaaacttctcaagcgtctgtgtaacaagccacatgttctaacaaattgtctccatcgcacttcaacagccaggtccctattttttataacgtattaaccttattattttcttattattttaaaagaatctatgcacattagcaaaatttaaaagatagagaaaaatataaacagaaaaaattatgtttacttctaccaccctaaatcaactattatcaattttatacatattttactccatcttttttcaaagtttcttacattttccaatgtcattaaaattctctgtgaatgtaaattttaaaaactgtacctactgttttttggaaatctgtaacaagctatgtgtaatcattcttctaatattaaacatattgtgtccagaa

SEQ ID NO: 36627 - DNA, 811 bp, Homo sapiens
atcaatattattgcagaccaggactctgcttatatgccttgctaacaaagatttctttcacagaggcttttctcctctcaagacttaaagtaagaattacattttattaagtcagttaaatgcaccatggcttcatatagtaatataaaaaaactctttgaagtgagaaatattatatcctaaaacctctaaaccacaaacattcaattgaaagagttctgttgaaggataatgacatactgactgcttacagaccaagttgcttgcattttgtatgtttagccctcctttgccactgcttttagagccttggaaggctaagtgtgatagtaatgctagctctaatgcatatttaaaggagactgcctcgcttttagaagacatctggtctgctctctgcatgaggcacagcagtaaagctctttgattcccagaatcaagaactctccccttcagactattaccgaatgcaaggtggttaattgaaggccactaattgatgctcaaatagaaggatattgactatattggaacagatggagtctctactacaaaagtctttgggtatttgtttcttacatagaaaatgctaacatgaatagaaagatactggtgcaagaccattcccgggaaagtagacatacttacatttttttccttttctgctcatttgaatgaactcaattttatgttaaattgttatatcagattactatcctatttaccaaagtttgtgatatgtattttgaatatatgtgaagagcttcacttctatcaagccatagcacttatttgtcactctgagtcgccc

SEQ ID NO: 36628 - DNA, 397 bp, Homo sapiens
gagctacttcatccaagcctttcctcactcttttattattgcaagaaaataattattaacattctgtacctactacgtgcctacactgcactaatacatttgagggatgaaagatgaatcagataaagatgctaaatccacagagcttgagataaattaatacaaatgaacccacagaaatgagaagaacaaaatattcaccagtcacaggaaattctttctagaaaaagttcaaattgtatgcaactaaagtaggccctgaccaagcctgtatttcctgattccgattcaattttcttctagcttctatttctattttcttaacatgatttggaaaactcttgaaatacctctgttagaaatgatcgttgtggaaatgattattgtttctgaaaat

SEQ ID NO: 36629 - DNA, 410 bp, Homo sapiens
caagggagcatggtttgtcaagacttggcactctgtgattgccgttagaaagcctgccccggaggccgggcacggtggctcacacctgtaatcccagcactttgggaggccgaggcaggtggatcacgaggtcaggagtttaagaccagcctggacaagatggtgaaaccccatctctactaaaaatacaaaaattagccgggaatggtggctagtgcctgtgatcctttcatatttattcaactgttctcttacaaatgaacagctacttgggaggctgaggcagagaattgcttgaacccgggaagcagaggttgcagtgagccaagattgcaccactgcactctagcctgggcagcagagcaagactccgtctcaaaaaaaaaaaaaaaaaaaaaagcctgccccag

SEQ ID NO: 36630 - DNA, 326 bp, Homo sapiens
tggcttagataacccaggaataatttataaaggagagagagacaaatgtggaacatctaggaggggccagaatgaggctagaagggggtcagatagggagaagaaacagtaaagtatgatggcagaaccctctgcaagagaaagcatttgttggctgtgtcaattattatgtggataaaattaaattggaaaaaagtatctacatttgttaattagcaagcttttcgtaacctttaagagtacagtttcatcagtggtggaggcggaagccagatttgcagtgggcgaccaggaaatttagctatgaaagggaggaggaaggcaca

SEQ ID NO: 36631 - DNA, 147 bp, Homo sapiens
actgacaaaatacgttcctctcattgagattacatagttattgcagttaataatggtggttattcgttctgatttctcttagagatatgagatttttataaagaaaaactcgctgacataacaccccaagaatatcagaattcagta

SEQ ID NO: 36632 - DNA, 239 bp, Homo sapiens
gagaccgagtttcaccatgttgcccagggtgatctcaaactcctaagctcaggcaatccatcctccttggcctcccaaagtgctgggattacaggcatgagccaccgcgcctggccccactttacttttacaaaaaaaaagccacaaatctaaaatactacatatttatgcctcttaaaaattttaggcattcagtataagttgcctatttcttctactcctgagttcagaagcagttg

SEQ ID NO: 36633 - DNA, 394 bp, Homo sapiens
  misc_feature (24)..(24): n is a, c, g, or t
atttttctgtgtgcatcagccatntacaaaaatttgtcctagtgcagttgatgttaatgattcaattggttaaagagctcttggacagatttctttactataattatttttctcttcattattaagtatctttatgctgctgatgtgcatgtaaaccatcacatttaatctggcagctgcctttctttcttaggttttctgtgcgtatatctgccttaggaaaatgaaagctgtcatccctttttacaggccagaaaaactgggaaaaacacaggctcacccacctactagatgtttgacaaaatactcttcttggggcccaaaaacattggacattattggtgagctttttagaaatttagaatatcagactgttccagatcttctgaaaaaa

SEQ ID NO: 36634 - DNA, 851 bp, Homo sapiens
tttttttttttgggagacggagtctcgctctgtagcccaggctgtagtgcagtggtatgatcttgctcactgcaacctccacctcctgggttcaagggattatcctgcctcagcctcccaagaagctaagactacaggcgtacactaccacgcccggctaatttttatatttttagtagaaacagggtttcaccatgttggccgggctggtcttgaactcctgacttcaagtgatgcacccgcctcagcctcccagagtgctgggattacaggcatgagcaaccattcctggtccaactcaagtcttttacctctattttacacagcacagttattgaactttcgtgagcttaagagaatcataaaatttcatttggttcatccaagatcaagtttcaggttcacaaaattgagttacttcctttaaatcgggggtgtccaatctcttggcttccctgggccacactggaagaagaagaattgtcttggccacataagatacactaacactaatgatagctgatgagctttaaaaaacaaatgcgaaaggatctcataatgttttaagaaagtttacgaatttgtgttggggcgcattcagagctgtcctgggctgcctacagcctgcagtctgtgggttggacaggcttgctttagatggtcttgggactctcaaactcatactcagcattgcaactcagttcagaagacaaacatgtgaagggaacgtcattttcaaactgatcatggtgaggatttttatgaaactgtcccaacaaacttttaggattccatttatgcaagtaatactatgattccccaactccacccccaagtgttaatgctggagg

SEQ ID NO: 36635 - DNA, 780 bp, Homo sapiens
gaactcccaggaatatcagtaatagggaaaaggcaaagttcatgatgaaatcctttgctaacattcagtataaaagtattaataaattaatcaacaggtctacatagatatggcagttactgtattttcaaattatttaccacgcctaaaagtatctgtgtttcaactgtcattggttatatacttcctctatgaaattcactagtatgaggaagaaactagcaaagggacaaagaggaatgtcactgtgccaagagccagagtacttcccctccatcccggggctggtcacctcctgttctgtcaccagttgccctgggtatgtccctggttatcagtctttgcacccagttaagatgtatccccattctctttctctcttgacgatgtcagagtcttggatacataccctgccccaacagctctgttttttttcctgtatctccccaccagtgtgtgcttaccaacctttcttatccccatccagaggacaaacttggctagcacaccatctacttggtatataagtcctgttacatgccagagttagcaaataaaaataagggacacccccttaaattcaaatttcagataaattgtttttttttttttttagaatgtgccatgcaatatgtgggacatatttatactaaaaatccattcattgcagagcacagttggttctcgcctgtaatcccagcattttgagaggtcagggtgggcggatctgttgaacccaggagtttgagaccaccttgggcaacatggcaaaatcctatc

SEQ ID NO: 36636 - DNA, 410 bp, Homo sapiens
ggtaagtggtaaatcagttcctgtgacctttcttttccatactgccccagaacgtctgtatgaatttttcttcctcaactaccatactgttattgcctttacttttgtggtctctagagtcataggggatgttgatagaagggtactggcaggaaagggagacacactgggagcgccttattttgcattttcttagtgtcgtctttgactaaggaggaagggtcagcaatgaatggtgcctttaacctttcccatgcactgcaccaatgcactgaaggtgagggagctccttgtgctccagggggatgcctgagattcatgcataccataaagttggccttcgtgtcccctttctttagttggagccatattggaagcccactgtcaggaaaacggtctcatggcctgag

SEQ ID NO: 36637 - DNA, 315 bp, Homo sapiens
gcggtgttgttcatgtggatggtgacaagacctactgctggacagacacaggtgctgcctttggactttccagtgcctcagcatcagcctggggatcacgttctcatcaaagaggggaaagaagggaaactcgagccagcccgggaaggaccctaccttgtgctgctaaccactgagactgctgttcgtaaggttggaaagagatggacacatcacacatgagtcaagcaagcaccattatcctcagaatcatgggccattgttcctggatcaagccctaccaaattaaagctaaggaaagcttagtctatctat

SEQ ID NO: 36638 - DNA, 385 bp, Homo sapiens
aaaaacacacacacacatacacgcgtgattacatagatgatgatgactttccattgcatcacatcaggagacacataatgtcatttttgtcccattattagtgttgctaaccacttgtttaagatgtcaagtctctccatcataaagttacctttaaatggtatagtacttgaagacagtgtaaatatcctattcctcaaaagccttttgccatggatgatccttgcctaaatcagttatattggtgtttgctaattagtgattttctaacaatgtatttattagtttatgtttttcgagcaacaagaactctagcgcccccccctgcccgtgctgcgtcatgcttctgtgtatataaaggcctttatttatctctcaaaaaaaa

SEQ ID NO: 36639 - DNA, 537 bp, Homo sapiens
gctagtttatgatggtctcagttatcacagtagatacagagctgagtttacccacaagatcttaatttaggaacactttgaaaccctgtaaccctgctgggtgctctctcctctcactccaccaaggcagcgcacagaaacatacatggggctgtggtaggatgaataatggtcccccaagatgtccacctcctttagcaaaaggggctttgcaaatgagattgaggatcttcagatagggagattaatctggatgatcagaatataccctaagtgcaatcatcagtgttcttataatagggaggcagagggagagctgaccacagtaggagatgtaatgacaaaagcaagaggttggagtgatatgaagaagggctgcaagtcaaggaatgcaggtggcttctagaagttagaaaaagcaagaaaatgtattctcccctgaagcctccagaaggaacagccctgccaacaccttgatttcagatttaatctccagagctgtaagagaataaatcagtattttaaaccaataaggtt

SEQ ID NO: 36640 - DNA, 422 bp, Homo sapiens
  misc_feature (278)..(278): n is a, c, g, or t
aggtagggctggaagaagcagccatacacaggtgtttgctcattcaccagtgcctggctttgtcctggcactagatccctcagagtcggccctgcgcctaataaattaacagatacaatagcatgtgatgaggaccacacgggaagccatggcagcggctaccgcccagccagcgcttccatttctcatttctaaatcctaccctaatctgtcaggggagagtcgctgacggtgaagaaccggtctaaggagttgaaccaggtccccacagacctacngctaccactgccatcgccatccaccgcatctcaccaacaagactgtggctcctagttgatgttggactcaccttcggaggtatccgagcttggacacagcccctggacaagttgatccagacaagctggccgtcccccaaggag

SEQ ID NO: 36641 - DNA, 441 bp, Homo sapiens
aataattttttaaaaattagagagctcttctttcttccacaatgacatttgttaacagattccctctttgataatacacaatgttggatcatgaaacagagtaaacaaacaggtcattgtttaaaataatgtacactgtgttcaaaggactgtgagtttttgttttgagttatataattttcgttctagaatacagtacataatgtattttaacttgatatgacacaaagatgtttattttagatatattacgtttgtgatactctttagattacttttacagatttgtgtattttgacctatgtgtggtagagcaagtttttttaatttgacaaaaattttttaataagttttgaatttatgtatttagaacaaatttattatcctatagttatgtgcacatagacacaaacacaggaaatcagtgtttaagtaattgtg

SEQ ID NO: 36642 - DNA, 312 bp, Homo sapiens
tgtccatggggtggagtccatgcagtgactggagaaggtgctagtttgcgtctttttaattgtcttagagagctgagagatatatgttaactctgagaagaaagactgatcagcttctaagagagctaatttgaagctgctggccttctgtagacagcaccttgggtttaattgcattgtggttactagtgattatgataaatagtacatagtcactggattttaaaattggccatatagttgtagttttatatttatttttatttttgaaatgggagtctcactgttgctccagccaggggcaacagaggc

SEQ ID NO: 36643 - DNA, 465 bp, Homo sapiens
tgcagtcattcatttgtcctccctgaaggcagcttacattgctggatttttagatgtcctagtagatttttatacttcatttgatcaagcttgttgtgatttccaagtcttttttagcatcctgatttttggtgctaagctacattaaaatttaccaacatgtagatctttcagttttgccttctaaaatgcatcatttgggcctggtgcagtggctcatgcctgtaatcccagcactttgggaggccgaggtgggtggatcacttgaggccaggagttcaaaatcagcctggccaacatggggaaaccccacttctacttaaaaatacaaacattagccaggcatggtggtacaagcctgtaatactagctacttgggaggttgaggtgggaggttgaggctgtagtgagccatgatcatgccactgcactccagcctgggagacagagccagaccctgtctta

SEQ ID NO: 36644 - DNA, 501 bp, Homo sapiens
ggatgtctctctgtaaaggtcaaattttcaggacagacctcaaattgatgagtggtgtgtatgctgagagaagacgcagacttgagacattcaaagcagacaggacatcaagagcaaaggccctgaggcttcagcaaatttagtatattggatgtaacagcaggagggcccatgtgggtaagctgaggacatcaaggtgagaatatcaaggtgggtagggaccagatcaggtaagatcttgtgagcccttgtaaggacttttaatttatgcaaagagcaatagaacatgatataatatctaagagtgatgaggatataaaagaaacaagactagccacatacaagttgataattgttggagacagtggtgggctcatgataaaaatctccacttttaggctgggcacagtggctcacgcctgtaatcccaacactttgggaggccaaggcgagtggatcacctgaggtcgggagttcgagaccagcctggccaacatggcg

SEQ ID NO: 36645 - DNA, 447 bp, Homo sapiens
gaaaaaggctgggcatacacaggggcagaaaaacagccccaggctaggaggacctggaaaatgtaactgaaaaactattcttcaaagccagttgtgaacagcagcaaccccatccaggaagactacatggttacacttggcaggctgtgcggaacagatgaggcagtgtgacacagtcaagtcacccacaagaacgtggcatttttgtggtgtttgaaacatttcagctagataagcctaaattggcttcctttatagcaaaactacctgccactcattatattcatgccaatatcaggttcctcatggggcatgctatgacatatttacccccagaccaactcaggatttaaaaggaagatgagatatttataggctaggaattctctaatggacacgctaatgaacaaataaatgtgaaaccatctcctaaagatcaaggatacc

SEQ ID NO: 36646 - DNA, 942 bp, Homo sapiens
ataatattgattggttacaaaagtggctgccggaaacctctccaacctctcctgaggactcacaacttctttatagatgagaattacgaaagagtctctaaagctgtctcaaaaacaggctggtgttgaaacatacatatcgaaaggtctcgagaaattcaattatattttgctgccctgaggattttcactccacttgtggaaacaaatgataatgttgcttcagacccacctctccacctcttgttccaaacagtactccatttccaaatgagctgccatcaagccaaagtaacaactttctcccaaaatgtttaaagtggtggaaaatcccctcaaagctggatcaaactgtgtgtttaagaacagctccaaaagggactcttctgttgacaggggatatttttctttagatgtaagaaatattctgagcctcgagcctaggaaggaggccaacagcagctctccagccgggatcccgcccctttcgaaagccatcaccactacaggaaccctgggtaaagtagtagccttctttttttctctctctagtttttgaaactgtaatgacagaagacatttcagggttgttgtggggattttttccccccagttctaaaatggtcattgatagtgtcgatcttacctaactctcctcctatttaaaatttctgtggatctaccagataacctaaagtgggcatggattatttattatggctcctttaatgcccaaatagcaatcagtctaaaaccttaaaacaaaaacaaaaacaaaaacaaaaatcaaggagagaccagccacctcctgaaaaataggaataatagtatcagccactgacccatggataatgttgttgaaagcctgattaaagtatttttttctaaaaagaaaactcttcctgaattaagaaaataaaaatgggactttaaaaaaaaacg

SEQ ID NO: 36647 - DNA, 294 bp, Homo sapiens
actgtagtagaacaccagcaaaaaatctagaagaaatgaagtgatagtcaccactcgacaaacctcatcgtcatggttgacttggacaagaattatcaacggatgttaaaaactactgggtgagagttttggtgaggaatggaatataatctatactacataatctcaaagtatctccccacaaagtacttatcagttacaaggggtgaggggaaatgcagaggggaataatacccttactgcagggaaactgggtagacagcatcttaacttagtgatcaaagttaacatcac

SEQ ID NO: 36648 - DNA, 758 bp, Homo sapiens
cctataccgcgggaaagatcactgagctggaacggaagctaaccttcgaacagcagcgtcggattagtgggaaagatgtatgttgaggcaaaagatcaaaatggaaaacaaggaacagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggtatacaatggactgcaaggatattgagagtgaataaaattggactttgtttaaaataagtgaataagcgatatttattatctgcaaggtttttttgtgtgtgtttttgtttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgtttttaaatacattttgttgttattttt

SEQ ID NO: 36649 - DNA, 1154 bp, Homo sapiens
gtgctgactaaggatccccagcttacccttactggagaaggtgagcctcacgtggatggggagcctggagatttacggttccgaatcaaagttgtcaagcacccaatatttgaaaggagaggagatgatttgtacacaaatgtgacaatctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggtatacaatggactgcaaggatattgagagtgaataaaattggactttgtttaaaataagtgaataagcgatatttattatctgcaaggtttttttgtgtgtgtttttgtttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgtttttaaatacattttgttgttatttttttcatgactcctgtttcttctgtgagctatttgggttgtcctcccatcaagcaagatggatgcacacgcatgcaaaagagtgatatagatccagtccccatgcccaattacacatacggcatctgctagaaaggagcttggaagaaactgaatggttgattggggtccatgaatgaaggttacacaaagatctaattgtccttgaagtatattttctctcatttaatttgggaataataatctgatatggacactttactgtttagaaagcacctttcatgtatataatttcagttgacctcatggttagaaagcctttggtttgtttaggaac

SEQ ID NO: 36650 - DNA, 461 bp, Homo sapiens
gtgctgactaaggatccccagcttacccttactggagaaggtgagcctcacgtggatggggagcctggagatttacggttccgaatcaaagttgtcaagcacccaatatttgaaaggagaggagatgatttgtacacaaatgtgacaatctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggtatacaatggactgcaaggatattgagagtgaataaaattggactttgttta

SEQ ID NO: 36651 - DNA, 757 bp, Homo sapiens
accgagacctggcggaccccgttgctagagcggcagattgcggctcaagcgtctgagaaaatctaggctggggtcgagagtccgcaacagtggcacctggagccagacccaccgctttctggtgtcgcgcctttcaacccgggggggtaggaagctttctgttgctccgcataactgtggtcagctaatagctgctggtaagatcagcacgctttcatcagaaatgctactaatactaatggcagtttgcatttatagagcacttactatggtctcagcactgtgtaaagcaactttatgtgtatttcctaagtcttgtcaagagccctttaagtacattcgttttactgatgaagaaactagggcctagaaaggtgaaaataacacaaccctaaggtcacacaagagatggagccaagattcaagcccagggcgtctgaagcaagactggcactccctgccgcccctcggtgtcagctccttaactctgttagcttcctgccgtgtttccaccttcatgaagctttttcagattaccgggcagaagccatcactccttcctttaaacttccatttcagatttctggacatttcctgctttttttagttcctttatggcctctctaggtgtgatagatacaaaggtaaattagaccgtaaaatgcaatttagttcctcttttgtgtggccattgtccctactgggtatcttcctgaaagcaggggcttcaaatttacacatacctgggttaggatcc

SEQ ID NO: 36652 - DNA, 2412 bp, Homo sapiens
  misc_feature (418)..(418): n is a, c, g, or t
accgagacctggcggaccccgttgctagagcggcagattgcggctcaagcgtctgagaaaatctaggctggggtcgagagtccgcaacagtggcacctggagccagacccaccgctttctggtgtcgcgcctttcaacccgggggggtaggaagctttctgttgctccgcataactgtggtcagctaatagctgctgcctttccgagacagttgtcttatggagttgcttggagaacgtaaaataagaggcctaagcaatgcgtctgatgtacacctgtcgtggaataactgttcccgctctagtagttctcacgctcattcttccgctgtacctctgctccctcattcggagcgtagctgggtatgaatgaaattccgggcttgtagcacagagaaaacttctctcccacaattggnttggtgctggggaggaagctcctgattggtggaaagtccgaggaagtgggcaagccggagggatttcgtgtacctcaggtgccctcactctgaccggccccctatcattacgtaattttctacgactcgcggtagctcaggcagagcgggttcctgcagcggcgcgaccctctgacgtctccgcttctaattggtcaagagctgcgactgcagttctgaagcctaactggttgcccgtgccgcctcggaggtgaagtgtactgcgctgattggcttccaggcgccggccgcgtgtgatgtcccgggcaacgattggctctcgcctaccgggggcttctctcaccgggactcgggactcccgggaagtggaccggcagaagagggggctagctagctgtctctgcggaccagggagacccccgcgcccccccggtgtgaggcggcctcacagggccgggtgggctggcgagccgacgcggcggcggaggaggctgtgaggagtgtgtggaacaggacccgggacagaggaaccatggctccgcagaacctgagcaccttttgcctgttgctgctatacctcatcggggcggtgattgccggacgagatttctataagatcttgggggtgcctcgaagtgcctctataaaggatattaaaaaggcctataggaaactagccctgcagcttcatcccgaccggaaccctgatgatccacaagcccaggagaaattccaggatctgggtgctgcttatgaggttctgtcagatagtgagaaacggaaacagtacgatacttatggtgaagaaggattaaaagatggtcatcagagctcccatggagacattttttcacacttctttggggattttggtttcatgtttggaggaacccctcgtcagcaagacagaaatattccaagaggaagtgatattattgtagatctagaagtcactttggaagaagtatatgcaggaaattttgtggaagtagttagaaacaaacctgtggcaaggcaggctcctggcaaacggaagtgcaattgtcggcaagagatgcggaccacccagctgggccctgggcgcttccaaatgacccaggaggtggtctgcgacgaatgccctaatgtcaaactagtgaatgaagaacgaacgctggaagtagaaatagagcctggggtgagagacggcatggagtacccctttattggagaaggtgagcctcacgtggatggggagcctggagatttacggttccgaatcaaagttgtcaagcacccaatatttgaaaggagaggagatgatttgtacacaaatgtgacaatctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggtatacaatggactgcaaggatattgagagtgaataaaattggactttgtttaaaataagtgaataagcgatatttattatctgcaaggtttttttgtgtgtgtttttgtttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgtttttaaatacattttgttgttattttt

SEQ ID NO: 36653 - DNA, 2746 bp, Homo sapiens
  misc_feature (418)..(418): n is a, c, g, or t
accgagacctggcggaccccgttgctagagcggcagattgcggctcaagcgtctgagaaaatctaggctggggtcgagagtccgcaacagtggcacctggagccagacccaccgctttctggtgtcgcgcctttcaacccgggggggtaggaagctttctgttgctccgcataactgtggtcagctaatagctgctgcctttccgagacagttgtcttatggagttgcttggagaacgtaaaataagaggcctaagcaatgcgtctgatgtacacctgtcgtggaataactgttcccgctctagtagttctcacgctcattcttccgctgtacctctgctccctcattcggagcgtagctgggtatgaatgaaattccgggcttgtagcacagagaaaacttctctcccacaattggnttggtgctggggaggaagctcctgattggtggaaagtccgaggaagtgggcaagccggagggatttcgtgtacctcaggtgccctcactctgaccggccccctatcattacgtaattttctacgactcgcggtagctcaggcagagcgggttcctgcagcggcgcgaccctctgacgtctccgcttctaattggtcaagagctgcgactgcagttctgaagcctaactggttgcccgtgccgcctcggaggtgaagtgtactgcgctgattggcttccaggcgccggccgcgtgtgatgtcccgggcaacgattggctctcgcctaccgggggcttctctcaccgggactcgggactcccgggaagtggaccggcagaagagggggctagctagctgtctctgcggaccagggagacccccgcgcccccccggtgtgaggcggcctcacagggccgggtgggctggcgagccgacgcggcggcggaggaggctgtgaggagtgtgtggaacaggacccgggacagaggaaccatggctccgcagaacctgagcaccttttgcctgttgctgctatacctcatcggggcggtgattgccggacgagatttctataagatcttgggggtgcctcgaagtgcctctataaaggatattaaaaaggcctataggaaactagccctgcagcttcatcccgaccggaaccctgatgatccacaagcccaggagaaattccaggatctgggtgctgcttatgaggttctgtcagatagtgagaaacggaaacagtacgatacttatggtgaagaaggattaaaagatggtcatcagagctcccatggagacattttttcacacttctttggggattttggtttcatgtttggaggaacccctcgtcagcaagacagaaatattccaagaggaagtgatattattgtagatctagaagtcactttggaagaagtatatgcaggaaattttgtggaagtagttagaaacaaacctgtggcaaggcaggctcctggcaaacggaagtgcaattgtcggcaagagatgcggaccacccagctgggccctgggcgcttccaaatgacccaggaggtggtctgcgacgaatgccctaatgtcaaactagtgaatgaagaacgaacgctggaagtagaaatagagcctggggtgagagacggcatggagtacccctttattggagaaggtgagcctcacgtggatggggagcctggagatttacggttccgaatcaaagttgtcaagcacccaatatttgaaaggagaggagatgatttgtacacaaatgtgacaatctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggtatacaatggactgcaaggatattgagagtgaataaaattggactttgtttaaaataagtgaataagcgatatttattatctgcaaggtttttttgtgtgtgtttttgtttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgtttttaaatacattttgttgttatttttttcatgactcctgtttcttctgtgagctatttgggttgtcctcccatcaagcaagatggatgcacacgcatgcaaaagagtgatatagatccagtccccatgcccaattacacatacggcatctgctagaaaggagcttggaagaaactgaatggttgattggggtccatgaatgaaggttacacaaagatctaattgtccttgaagtatattttctctcatttaatttgggaataataatctgatatggacactttactgtttagaaagcacctttcatgtatataatttcagttgacctcatggttagaaagcctttggtttgtttaggaac

SEQ ID NO: 36654 - DNA, 2053 bp, Homo sapiens
  misc_feature (418)..(418): n is a, c, g, or t
accgagacctggcggaccccgttgctagagcggcagattgcggctcaagcgtctgagaaaatctaggctggggtcgagagtccgcaacagtggcacctggagccagacccaccgctttctggtgtcgcgcctttcaacccgggggggtaggaagctttctgttgctccgcataactgtggtcagctaatagctgctgcctttccgagacagttgtcttatggagttgcttggagaacgtaaaataagaggcctaagcaatgcgtctgatgtacacctgtcgtggaataactgttcccgctctagtagttctcacgctcattcttccgctgtacctctgctccctcattcggagcgtagctgggtatgaatgaaattccgggcttgtagcacagagaaaacttctctcccacaattggnttggtgctggggaggaagctcctgattggtggaaagtccgaggaagtgggcaagccggagggatttcgtgtacctcaggtgccctcactctgaccggccccctatcattacgtaattttctacgactcgcggtagctcaggcagagcgggttcctgcagcggcgcgaccctctgacgtctccgcttctaattggtcaagagctgcgactgcagttctgaagcctaactggttgcccgtgccgcctcggaggtgaagtgtactgcgctgattggcttccaggcgccggccgcgtgtgatgtcccgggcaacgattggctctcgcctaccgggggcttctctcaccgggactcgggactcccgggaagtggaccggcagaagagggggctagctagctgtctctgcggaccagggagacccccgcgcccccccggtgtgaggcggcctcacagggccgggtgggctggcgagccgacgcggcggcggaggaggctgtgaggagtgtgtggaacaggacccgggacagaggaaccatggctccgcagaacctgagcaccttttgcctgttgctgctatacctcatcggggcggtgattgccggacgagatttctataagatcttgggggtgcctcgaagtgcctctataaaggatattaaaaaggcctataggaaactagccctgcagcttcatcccgaccggaaccctgatgatccacaagcccaggagaaattccaggatctgggtgctgcttatgaggttctgtcagatagtgagaaacggaaacagtacgatacttatggtgaagaaggattaaaagatggtcatcagagctcccatggagacattttttcacacttctttggggattttggtttcatgtttggaggaacccctcgtcagcaagacagaaatattccaagaggaagtgatattattgtagatctagaagtcactttggaagaagtatatgcaggaaattttgtggaagtagttagaaacaaacctgtggcaaggcaggctcctggcaaacggaagtgcaattgtcggcaagagatgcggaccacccagctgggccctgggcgcttccaaatgacccaggaggtggtctgcgacgaatgccctaatgtcaaactagtgaatgaagaacgaacgctggaagtagaaatagagcctggggtgagagacggcatggagtacccctttattggagaaggtgagcctcacgtggatggggagcctggagatttacggttccgaatcaaagttgtcaagcacccaatatttgaaaggagaggagatgatttgtacacaaatgtgacaatctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggtatacaatggactgcaaggatattgagagtgaataaaattggactttgttta

SEQ ID NO: 36655 - DNA, 2481 bp, Homo sapiens
  misc_feature (418)..(418): n is a, c, g, or t
  misc_feature (2183)..(2184): n is a, c, g, or t
  misc_feature (2203)..(2203): n is a, c, g, or t
accgagacctggcggaccccgttgctagagcggcagattgcggctcaagcgtctgagaaaatctaggctggggtcgagagtccgcaacagtggcacctggagccagacccaccgctttctggtgtcgcgcctttcaacccgggggggtaggaagctttctgttgctccgcataactgtggtcagctaatagctgctgcctttccgagacagttgtcttatggagttgcttggagaacgtaaaataagaggcctaagcaatgcgtctgatgtacacctgtcgtggaataactgttcccgctctagtagttctcacgctcattcttccgctgtacctctgctccctcattcggagcgtagctgggtatgaatgaaattccgggcttgtagcacagagaaaacttctctcccacaattggnttggtgctggggaggaagctcctgattggtggaaagtccgaggaagtgggcaagccggagggatttcgtgtacctcaggtgccctcactctgaccggccccctatcattacgtaattttctacgactcgcggtagctcaggcagagcgggttcctgcagcggcgcgaccctctgacgtctccgcttctaattggtcaagagctgcgactgcagttctgaagcctaactggttgcccgtgccgcctcggaggtgaagtgtactgcgctgattggcttccaggcgccggccgcgtgtgatgtcccgggcaacgattggctctcgcctaccgggggcttctctcaccgggactcgggactcccgggaagtggaccggcagaagagggggctagctagctgtctctgcggaccagggagacccccgcgcccccccggtgtgaggcggcctcacagggccgggtgggctggcgagccgacgcggcggcggaggaggctgtgaggagtgtgtggaacaggacccgggacagaggaaccatggctccgcagaacctgagcaccttttgcctgttgctgctatacctcatcggggcggtgattgccggacgagatttctataagatcttgggggtgcctcgaagtgcctctataaaggatattaaaaaggcctataggaaactagccctgcagcttcatcccgaccggaaccctgatgatccacaagcccaggagaaattccaggatctgggtgctgcttatgaggttctgtcagatagtgagaaacggaaacagtacgatacttatggtgaagaaggattaaaagatggtcatcagagctcccatggagacattttttcacacttctttggggattttggtttcatgtttggaggaacccctcgtcagcaagacagaaatattccaagaggaagtgatattattgtagatctagaagtcactttggaagaagtatatgcaggaaattttgtggaagtagttagaaacaaacctgtggcaaggcaggctcctggcaaacggaagtgcaattgtcggcaagagatgcggaccacccagctgggccctgggcgcttccaaatgacccaggaggtggtctgcgacgaatgccctaatgtcaaactagtgaatgaagaacgaacgctggaagtagaaatagagcctggggtgagagacggcatggagtacccctttattggagaaggtgagcctcacgtggatggggagcctggagatttacggttccgaatcaaagttgtcaagcacccaatatttgaaaggagaggagatgatttgtacacaaatgtgacaatctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggtatacaatggactgcaaggatattgagagtgaataaaattggactttgtttaaaataagtgaataagcgatatttattatctgcaaggtttttttgtgtgtgtttttgtttttattttcaatatgcaagttaggcttaataaatgacccaggaggtggtctgcgacgaatgccctaatgtcnnactagtgaatgaagaacgnacgctggaagtagaaatagagcctggggtgagagacggcatggagtacccctttattggagaaggtgagcctcacgtggatggggagcctggagatttacggttccgaatcacagttgtcaagcaccctatatttgaaaggagaggagatgatttgtacacaaatgtgagcgattctcattagctgagtcaccgggctctggctattgagatgtgataggtcatcactgtgtatcctgaacttgtacatacggcctgggccaggctatacaatctgct

SEQ ID NO: 36656 - DNA, 2354 bp, Homo sapiens
  misc_feature (418)..(418): n is a, c, g, or t
accgagacctggcggaccccgttgctagagcggcagattgcggctcaagcgtctgagaaaatctaggctggggtcgagagtccgcaacagtggcacctggagccagacccaccgctttctggtgtcgcgcctttcaacccgggggggtaggaagctttctgttgctccgcataactgtggtcagctaatagctgctgcctttccgagacagttgtcttatggagttgcttggagaacgtaaaataagaggcctaagcaatgcgtctgatgtacacctgtcgtggaataactgttcccgctctagtagttctcacgctcattcttccgctgtacctctgctccctcattcggagcgtagctgggtatgaatgaaattccgggcttgtagcacagagaaaacttctctcccacaattggnttggtgctggggaggaagctcctgattggtggaaagtccgaggaagtgggcaagccggagggatttcgtgtacctcaggtgccctcactctgaccggccccctatcattacgtaattttctacgactcgcggtagctcaggcagagcgggttcctgcagcggcgcgaccctctgacgtctccgcttctaattggtcaagagctgcgactgcagttctgaagcctaactggttgcccgtgccgcctcggaggtgaagtgtactgcgctgattggcttccaggcgccggccgcgtgtgatgtcccgggcaacgattggctctcgcctaccgggggcttctctcaccgggactcgggactcccgggaagtggaccggcagaagagggggctagctagctgtctctgcggaccagggagacccccgcgcccccccggtgtgaggcggcctcacagggccgggtgggctggcgagccgacgcggcggcggaggaggctgtgaggagtgtgtggaacaggacccgggacagaggaaccatggctccgcagaacctgagcaccttttgcctgttgctgctatacctcatcggggcggtgattgccggacgagatttctataagatcttgggggtgcctcgaagtgcctctataaaggatattaaaaaggcctataggaaactagccctgcagcttcatcccgaccggaaccctgatgatccacaagcccaggagaaattccaggatctgggtgctgcttatgaggttctgtcagatagtgagaaacggaaacagtacgatacttatggtgaagaaggattaaaagatggtcatcagagctcccatggagacattttttcacacttctttggggattttggtttcatgtttggaggaacccctcgtcagcaagacagaaatattccaagaggaagtgatattattgtagatctagaagtcactttggaagaagtatatgcaggaaattttgtggaagtagttagaaacaaacctgtggcaaggcaggctcctggcaaacggaagtgcaattgtcggcaagagatgcggaccacccagctgggccctgggcgcttccaaatgacccaggaggtggtctgcgacgaatgccctaatgtcaaactagtgaatgaagaacgaacgctggaagtagaaatagagcctggggtgagagacggcatggagtacccctttattggagaaggcacccaatatttgaaaggagaggagatgatttgtacacaaatgtgacaatctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggtatacaatggactgcaaggatattgagagtgaataaaattggactttgtttaaaataagtgaataagcgatatttattatctgcaaggtttttttgtgtgtgtttttgtttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgtttttaaatacattttgttgttattttt

SEQ ID NO: 36657 - DNA, 2428 bp, Homo sapiens
  misc_feature (418)..(418): n is a, c, g, or t
  misc_feature (1691)..(1691): n is a, c, g, or t
  misc_feature (1726)..(1727): n is a, c, g, or t
  misc_feature (1731)..(1731): n is a, c, g, or t
  misc_feature (1744)..(1744): n is a, c, g, or t
  misc_feature (1751)..(1751): n is a, c, g, or t
  misc_feature (1763)..(1763): n is a, c, g, or t
  misc_feature (1767)..(1767): n is a, c, g, or t
  misc_feature (1769)..(1769): n is a, c, g, or t
  misc_feature (1786)..(1786): n is a, c, g, or t
  misc_feature (1788)..(1789): n is a, c, g, or t
  misc_feature (1791)..(1792): n is a, c, g, or t
  misc_feature (1794)..(1794): n is a, c, g, or t
  misc_feature (1801)..(1801): n is a, c, g, or t
  misc_feature (1805)..(1805): n is a, c, g, or t
  misc_feature (1807)..(1807): n is a, c, g, or t
  misc_feature (1809)..(1809): n is a, c, g, or t
  misc_feature (1816)..(1819): n is a, c, g, or t
  misc_feature (1821)..(1821): n is a, c, g, or t
  misc_feature (1823)..(1823): n is a, c, g, or t
  misc_feature (1832)..(1833): n is a, c, g, or t
  misc_feature (1835)..(1835): n is a, c, g, or t
  misc_feature (1837)..(1838): n is a, c, g, or t
  misc_feature (1840)..(1840): n is a, c, g, or t
  misc_feature (1853)..(1853): n is a, c, g, or t
  misc_feature (1858)..(1858): n is a, c, g, or t
  misc_feature (1860)..(1860): n is a, c, g, or t
  misc_feature (1868)..(1868): n is a, c, g, or t
  misc_feature (1870)..(1870): n is a, c, g, or t
  misc_feature (1872)..(1874): n is a, c, g, or t
  misc_feature (1888)..(1889): n is a, c, g, or t
  misc_feature (1897)..(1897): n is a, c, g, or t
  misc_feature (1900)..(1901): n is a, c, g, or t
  misc_feature (1903)..(1903): n is a, c, g, or t
  misc_feature (1906)..(1906): n is a, c, g, or t
  misc_feature (1920)..(1921): n is a, c, g, or t
  misc_feature (1924)..(1924): n is a, c, g, or t
  misc_feature (1933)..(1933): n is a, c, g, or t
  misc_feature (1937)..(1938): n is a, c, g, or t
  misc_feature (1940)..(1940): n is a, c, g, or t
  misc_feature (1947)..(1947): n is a, c, g, or t
  misc_feature (1952)..(1952): n is a, c, g, or t
  misc_feature (1955)..(1955): n is a, c, g, or t
  misc_feature (1959)..(1959): n is a, c, g, or t
  misc_feature (1962)..(1964): n is a, c, g, or t
  misc_feature (1968)..(1968): n is a, c, g, or t
  misc_feature (1972)..(1972): n is a, c, g, or t
  misc_feature (1974)..(1974): n is a, c, g, or t
  misc_feature (1977)..(1978): n is a, c, g, or t
  misc_feature (1980)..(1980): n is a, c, g, or t
  misc_feature (1985)..(1985): n is a, c, g, or t
  misc_feature (1988)..(1988): n is a, c, g, or t
  misc_feature (1997)..(1997): n is a, c, g, or t
  misc_feature (2000)..(2000): n is a, c, g, or t
  misc_feature (2003)..(2003): n is a, c, g, or t
  misc_feature (2010)..(2010): n is a, c, g, or t
  misc_feature (2013)..(2013): n is a, c, g, or t
accgagacctggcggaccccgttgctagagcggcagattgcggctcaagcgtctgagaaaatctaggctggggtcgagagtccgcaacagtggcacctggagccagacccaccgctttctggtgtcgcgcctttcaacccgggggggtaggaagctttctgttgctccgcataactgtggtcagctaatagctgctgcctttccgagacagttgtcttatggagttgcttggagaacgtaaaataagaggcctaagcaatgcgtctgatgtacacctgtcgtggaataactgttcccgctctagtagttctcacgctcattcttccgctgtacctctgctccctcattcggagcgtagctgggtatgaatgaaattccgggcttgtagcacagagaaaacttctctcccacaattggnttggtgctggggaggaagctcctgattggtggaaagtccgaggaagtgggcaagccggagggatttcgtgtacctcaggtgccctcactctgaccggccccctatcattacgtaattttctacgactcgcggtagctcaggcagagcgggttcctgcagcggcgcgaccctctgacgtctccgcttctaattggtcaagagctgcgactgcagttctgaagcctaactggttgcccgtgccgcctcggaggtgaagtgtactgcgctgattggcttccaggcgccggccgcgtgtgatgtcccgggcaacgattggctctcgcctaccgggggcttctctcaccgggactcgggactcccgggaagtggaccggcagaagagggggctagctagctgtctctgcggaccagggagacccccgcgcccccccggtgtgaggcggcctcacagggccgggtgggctggcgagccgacgcggcggcggaggaggctgtgaggagtgtgtggaacaggacccgggacagaggaaccatggctccgcagaacctgagcaccttttgcctgttgctgctatacctcatcggggcggtgattgccggacgagatttctataagatcttgggggtgcctcgaagtgcctctataaaggatattaaaaaggcctataggaaactagccctgcagcttcatcccgaccggaaccctgatgatccacaagcccaggagaaattccaggatctgggtgctgcttatgaggttctgtcagatagtgagaaacggaaacagtacgatacttatggtgaagaaggattaaaagatggtcatcagagctcccatggagacattttttcacacttctttggggattttggtttcatgtttggaggaacccctcgtcagcaagacagaaatattccaagaggaagtgatattattgtagatctagaagtcactttggaagaagtatatgcaggaaattttgtggaagtagttagaaacaaacctgtggcaaggcaggctcctggcaaacggaagtgcaattgtcggcaagagatgcggaccacccagctgggccctgggcgcttccaaatgacccaggaggtggtctgcgacgaatgccctaatgtcaaactagtgaatgaagaacgaacgctggaagtagaaatagagcctggggtgagagacggcatggagtacccctttattggagaaggccctcactgtggatgggggagccctggagattttacggttcccgaatgcaaaaggttntcaaagcaccccaaatattttgaaaaggagaggcnnaccncccgccacacacnaccgccncacaccccattncccnanccaccccccccccctcncnngnncnccacccncccncncngctcccnnnncncnccccccccnncncnncnccccccccccccnccccncnccatggancnannnccaagccccccccnnccttcacnacnncnatnccaagggccccccnncanccacccccnatgnncnccccccnaaagnacncctnacnnnccancccncncanncncccanacncccactganacnagncccaccnccnaaggtatacaatggactgcaaggatattgagagtgaataaaattggactttgtttaaaataagtgaataagcgatatttattatctgcaaggtttttttgtgtgtgtttttgtttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgtttttaaatacattttgttgttattttt

SEQ ID NO: 36658 - DNA, 1968 bp, Homo sapiens
  misc_feature (418)..(418): n is a, c, g, or t
  misc_feature (1837)..(1838): n is a, c, g, or t
accgagacctggcggaccccgttgctagagcggcagattgcggctcaagcgtctgagaaaatctaggctggggtcgagagtccgcaacagtggcacctggagccagacccaccgctttctggtgtcgcgcctttcaacccgggggggtaggaagctttctgttgctccgcataactgtggtcagctaatagctgctgcctttccgagacagttgtcttatggagttgcttggagaacgtaaaataagaggcctaagcaatgcgtctgatgtacacctgtcgtggaataactgttcccgctctagtagttctcacgctcattcttccgctgtacctctgctccctcattcggagcgtagctgggtatgaatgaaattccgggcttgtagcacagagaaaacttctctcccacaattggnttggtgctggggaggaagctcctgattggtggaaagtccgaggaagtgggcaagccggagggatttcgtgtacctcaggtgccctcactctgaccggccccctatcattacgtaattttctacgactcgcggtagctcaggcagagcgggttcctgcagcggcgcgaccctctgacgtctccgcttctaattggtcaagagctgcgactgcagttctgaagcctaactggttgcccgtgccgcctcggaggtgaagtgtactgcgctgattggcttccaggcgccggccgcgtgtgatgtcccgggcaacgattggctctcgcctaccgggggcttctctcaccgggactcgggactcccgggaagtggaccggcagaagagggggctagctagctgtctctgcggaccagggagacccccgcgcccccccggtgtgaggcggcctcacagggccgggtgggctggcgagccgacgcggcggcggaggaggctgtgaggagtgtgtggaacaggacccgggacagaggaaccatggctccgcagaacctgagcaccttttgcctgttgctgctatacctcatcggggcggtgattgccggacgagatttctataagatcttgggggtgcctcgaagtgcctctataaaggatattaaaaaggcctataggaaactagccctgcagcttcatcccgaccggaaccctgatgatccacaagcccaggagaaattccaggatctgggtgctgcttatgaggttctgtcagatagtgagaaacggaaacagtacgatacttatggtgaagaaggattaaaagatggtcatcagagctcccatggagacattttttcacacttctttggggattttggtttcatgtttggaggaacccctcgtcagcaagacagaaatattccaagaggaagtgatattattgtagatctagaagtcactttggaagaagtatatgcaggaaattttgtggaagtagttagaaacaaacctgtggcaaggcaggctcctggcaaacggaagtgcaattgtcggcaagagatgcggaccacccagctgggccctgggcgcttccaaatgacccaggaggtggtctgcgacgaatgccctaatgtcaaactagtgaatgaagaacgaacgctggaagtagaaatagagcctggggtgagagacggcatggagtacccctttattggagaaggtgagcctcacgtggatggggagcctggagatttacggttccgaatcaaagttgtcaagcacccaatatttgaaaggagaggagatgatttgtacacaaatgtgacaatctcattagttgagtcactggttggctttgagatggatattactcacttggatggtcacaagggtacataatttcccgggataagatctacaggcannggcgaagctatgggagaacgggggcggctcccccatttggcgacacatatccagggcctggaaatcctttgggtgggtttcccaagaaaggttccaaggagcggagaaggtcttaccgcttggacgggcg

SEQ ID NO: 36659 - DNA, 1881 bp, Homo sapiens
  misc_feature (418)..(418): n is a, c, g, or t
accgagacctggcggaccccgttgctagagcggcagattgcggctcaagcgtctgagaaaatctaggctggggtcgagagtccgcaacagtggcacctggagccagacccaccgctttctggtgtcgcgcctttcaacccgggggggtaggaagctttctgttgctccgcataactgtggtcagctaatagctgctgcctttccgagacagttgtcttatggagttgcttggagaacgtaaaataagaggcctaagcaatgcgtctgatgtacacctgtcgtggaataactgttcccgctctagtagttctcacgctcattcttccgctgtacctctgctccctcattcggagcgtagctgggtatgaatgaaattccgggcttgtagcacagagaaaacttctctcccacaattggnttggtgctggggaggaagctcctgattggtggaaagtccgaggaagtgggcaagccggagggatttcgtgtacctcaggtgccctcactctgaccggccccctatcattacgtaattttctacgactcgcggtagctcaggcagagcgggttcctgcagcggcgcgaccctctgacgtctccgcttctaattggtcaagagctgcgactgcagttctgaagcctaactggttgcccgtgccgcctcggaggtgaagtgtactgcgctgattggcttccaggcgccggccgcgtgtgatgtcccgggcaacgattggctctcgcctaccgggggcttctctcaccgggactcgggactcccgggaagtggaccggcagaagagggggctagctagctgtctctgcggaccagggagacccccgcgcccccccggtgtgaggcggcctcacagggccgggtgggctggcgagccgacgcggcggcggaggaggctgtgaggagtgtgtggaacaggacccgggacagaggaaccatggctccgcagaacctgagcaccttttgcctgttgctgctatacctcatcggggcggtgattgccggacgagatttctataagatcttgggggtgcctcgaagtgcctctataaaggatattaaaaaggcctataggaaactagccctgcagcttcatcccgaccggaaccctgatgatccacaagcccaggagaaattccaggatctgggtgctgcttatgaggttctgtcagatagtgagaaacggaaacagtacgatacttatggtgaagaaggattaaaagatggtcatcagagctcccatggagacattttttcacacttctttggggattttggtttcatgtttggaggaacccctcgtcagcaagacagaaatattccaagaggaagtgatattattgtagatctagaagtcactttggaagaagtatatgcaggaaattttgtggaagtagttagaaacaaacctgtggcaaggcaggctcctggcaaacggaagtgcaattgtcggcaagagatgcggaccacccagctgggccctgggcgcttccaaatgacccaggaggtggtctgcgacgaatgccctaatgtcaaactagtgaatgaagaacgaacgctggaagtagaaatagagcctggggtgagagacggcatggagtacccctttattggagaaggtgagcctcacgtggatggggagcctggagatttacggttccgaatcaaagttgtcaagcacccaatatttgaaaggagaggagatgatttgtacacaaatgtgacaatctcattagttgagtcactggttggctttgagatggatattactcacttggatggtcacaagtacatattcccgggttagtcacaggcaggccacgttgagacggagctccacttgcacacattcaggccttgatatcctt

SEQ ID NO: 36660 - DNA, 2351 bp, Homo sapiens
  misc_feature (418)..(418): n is a, c, g, or t
accgagacctggcggaccccgttgctagagcggcagattgcggctcaagcgtctgagaaaatctaggctggggtcgagagtccgcaacagtggcacctggagccagacccaccgctttctggtgtcgcgcctttcaacccgggggggtaggaagctttctgttgctccgcataactgtggtcagctaatagctgctgcctttccgagacagttgtcttatggagttgcttggagaacgtaaaataagaggcctaagcaatgcgtctgatgtacacctgtcgtggaataactgttcccgctctagtagttctcacgctcattcttccgctgtacctctgctccctcattcggagcgtagctgggtatgaatgaaattccgggcttgtagcacagagaaaacttctctcccacaattggnttggtgctggggaggaagctcctgattggtggaaagtccgaggaagtgggcaagccggagggatttcgtgtacctcaggtgccctcactctgaccggccccctatcattacgtaattttctacgactcgcggtagctcaggcagagcgggttcctgcagcggcgcgaccctctgacgtctccgcttctaattggtcaagagctgcgactgcagttctgaagcctaactggttgcccgtgccgcctcggaggtgaagtgtactgcgctgattggcttccaggcgccggccgcgtgtgatgtcccgggcaacgattggctctcgcctaccgggggcttctctcaccgggactcgggactcccgggaagtggaccggcagaagagggggctagctagctgtctctgcggaccagggagacccccgcgcccccccggtgtgaggcggcctcacagggccgggtgggctggcgagccgacgcggcggcggaggaggctgtgaggagtgtgtggaacaggacccgggacagaggaaccatggctccgcagaacctgagcaccttttgcctgttgctgctatacctcatcggggcggtgattgccggacgagatttctataagatcttgggggtgcctcgaagtgcctctataaaggatattaaaaaggcctataggaaactagccctgcagcttcatcccgaccggaaccctgatgatccacaagcccaggagaaattccaggatctgggtgctgcttatgaggttctgtcagatagtgagaaacggaaacagtacgatacttctttggggattttggtttcatgtttggaggaacccctcgtcagcaagacagaaatattccaagaggaagtgatattattgtagatctagaagtcactttggaagaagtatatgcaggaaattttgtggaagtagttagaaacaaacctgtggcaaggcaggctcctggcaaacggaagtgcaattgtcggcaagagatgcggaccacccagctgggccctgggcgcttccaaatgacccaggaggtggtctgcgacgaatgccctaatgtcaaactagtgaatgaagaacgaacgctggaagtagaaatagagcctggggtgagagacggcatggagtacccctttattggagaaggtgagcctcacgtggatggggagcctggagatttacggttccgaatcaaagttgtcaagcacccaatatttgaaaggagaggagatgatttgtacacaaatgtgacaatctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggtatacaatggactgcaaggatattgagagtgaataaaattggactttgtttaaaataagtgaataagcgatatttattatctgcaaggtttttttgtgtgtgtttttgtttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgtttttaaatacattttgttgttattttt

SEQ ID NO: 36661 - DNA, 1999 bp, Homo sapiens
  misc_feature (418)..(418): n is a, c, g, or t
accgagacctggcggaccccgttgctagagcggcagattgcggctcaagcgtctgagaaaatctaggctggggtcgagagtccgcaacagtggcacctggagccagacccaccgctttctggtgtcgcgcctttcaacccgggggggtaggaagctttctgttgctccgcataactgtggtcagctaatagctgctgcctttccgagacagttgtcttatggagttgcttggagaacgtaaaataagaggcctaagcaatgcgtctgatgtacacctgtcgtggaataactgttcccgctctagtagttctcacgctcattcttccgctgtacctctgctccctcattcggagcgtagctgggtatgaatgaaattccgggcttgtagcacagagaaaacttctctcccacaattggnttggtgctggggaggaagctcctgattggtggaaagtccgaggaagtgggcaagccggagggatttcgtgtacctcaggtgccctcactctgaccggccccctatcattacgtaattttctacgactcgcggtagctcaggcagagcgggttcctgcagcggcgcgaccctctgacgtctccgcttctaattggtcaagagctgcgactgcagttctgaagcctaactggttgcccgtgccgcctcggaggtgaagtgtactgcgctgattggcttccaggcgccggccgcgtgtgatgtcccgggcaacgattggctctcgcctaccgggggcttctctcaccgggactcgggactcccgggaagtggaccggcagaagagggggctagctagctgtctctgcggaccagggagacccccgcgcccccccggtgtgaggcggcctcacagggccgggtgggctggcgagccgacgcggcggcggaggaggctgtgaggagtgtgtggaacaggacccgggacagaggaaccatggctccgcagaacctgagcaccttttgcctgttgctgctatacctcatcggggcggtgattgccggacgagatttctataagatcttgggggtgcctcgaagtgcctctataaaggatattaaaaaggcctataggaaactagccctgcagcttcatcccgaccggaaccctgatgatccacaagcccaggagaaattccaggatctgggtgctgcttatgaggttctgtcagatagtgagaaacggaaacagtacgatacttatggtgaagaaggattaaaagatggtcatcagagctcccatggagacattttttcacacttctttggggattttggtttcatgtttggaggaacccctcgtcagcaagacagaaatattccaagaggaagtgatattattgtagatctagaagtcactttggaagaagtatatgcaggaaattttgtggaagtagttagaaacaaacctgtggcaaggcaggctcctggcaaacggaagtgcaattgtcggcaagagatgcggaccacccagctgggccctgggcgcttccaaatgacccaggaggtggtctgcgacgaatgccctaatgtcaaactagtgaatgaagaacgaacgctggaagtagaaatagagcctgggtgtaatctgctctgactaggtgagcctcacgtggatggggagcctggagatttacggttccgaatcaaagttgtcaagagaggagatgatttgtacacaaatgtgacaatctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctatgtggattttccaaaagaacagttaacagaggaagcgagagaaggtatcaaacagctactgaaacaagggtcagtgcagaaggtatacaatggactgcaaggatattgagagtgaataaaattggactttgttta

SEQ ID NO: 36662 - DNA, 1031 bp, Homo sapiens
cggacgcgtgggtcgacccacgcgtccggttagaaacaaacctgtggcaaggcaggctcctggcaaacggaagtgcaattgtcggcaagagatgcggaccacccagctgggccctgggcgcttccaaatgacccaggaggtggtctgcgacgaatgccctaatgtcaaactagtgaatgaagaacgaacgctggaagtagaaatagagcctggggtgagagacggcatggagtacccctttattggagaaggtgagcctcacgtggatggggagcctggagatttacggttccgaatcaaagttgtcaagcacccaatatttgaaaggagaggagatgatttgtacacaaatgtgacaatctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggtatacaatggactgcaaggatattgagagtgaataaaattggactttgtttaaaataagtgaataagcgatatttattatctgcaaggtttttttgtgtgtgtttttgtttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgtttttaaatacattttgttgttattttt

SEQ ID NO: 36663 - DNA, 820 bp, Homo sapiens
gtgctgactaaggatccccagcttacccttactggagaaggtgagcctcacgtggatggggagcctggagatttacggttccgaatcaaagttgtcaagcacccaatatttgaaaggagaggagatgatttgtacacaaatgtgacaatctcattagttgagtcactggttggctttgagatggatattactcacttggatggtcacaaggtacatatttcccgggataagatcaccaggccaggagcgaagctatggaagaaaggggaagggctccccaactttgacaacaacaatatcaagggctctttgataatcacttttgatgtggattttccaaaagaacagttaacagaggaagcgagagaaggtatcaaacagctactgaaacaagggtcagtgcagaaggtatacaatggactgcaaggatattgagagtgaataaaattggactttgtttaaaataagtgaataagcgatatttattatctgcaaggtttttttgtgtgtgtttttgtttttattttcaatatgcaagttaggcttaatttttttatctaatgatcatcatgaaatgaataagagggcttaagaatttgtccatttgcattcggaaaagaatgaccagcaaaaggtttactaatacctctccctttggggatttaatgtctggtgctgccgcctgagtttcaagaattaaagctgcaagaggactccaggagcaaaagaaacacaatatagagggttggagttgttagcaatttcattcaaaatgccaactggagaagtctgtttttaaatacattttgttgttattttt

SEQ ID NO: 36664 - DNA, 1748 bp, Homo sapiens
gcagtatgatcggtgtctagctgaagttgtctttaaatgcccttactcgtcacagtttaaacacttaggatgtggcaatcttaagtatcaatggcattttatgtccagctaacatcctaaagcattagaaattaaaaacgaaagacttttaaaaacatacatcaaacatgcttgcaccagagaagctttttaaaataatacactctcatagccaggtgctaatttaattttacttatgaaattaagagaggtgatgggttctagcaacagatattttcacggacatattctaaaaccactagagaattcgctacctctcagagccatcgatgctttgagctacctttataaacagggcacaaatgtttactgctgtggtttacaagaaaagggctactcacttattttgaaaccaacgaaccaacttttaactagggtgaacaaagcactcaaagtgctttgtgaaattggagcatacagagattttgagcttcaagtatttgctagttttaaaaagaatacaccttttctttaccttgtagcagcaattaaaagtcacacaaagcttgcatcgagtagggccaactgccacttgggtagcctatggtcacattcaatactgagaatgacttggaactcacagattaatatgaaagaagcagcgttcatcccaagacccatgctcacaattacagctccgtgccctgaggtagagttgagatttggattaagaaatagatttctaatacgactcaagatcatcctacaatattttctttggaaactaatttagcccatgatattttaaagagagacaagagaaggcctatttatcttgtctaagtgaacggcatttgtatattcataagctatttttggtaagaattttaaatcttttagctcaaggcctacagggcatcatgatctttgccttccttgaaaatacaatttaaattgtacaaacactttataaaaagctaattattggtgttagaacatgaccccacacaatgctgcttgacccctgaaactgacattcatgagcataacctttgttacattgttctttttgatgtaatttgtagaaatgttttttagttcgtaatggaaaatgtatgtaccctgaaaaattacttattttgtttaactttggtataaaggtgttgggcattttcttggggagggggggattacaaaagaagtttgtctcccacatcaaaaaacgttcaaagaaattaagtatttattatattttttgcagatgtttccatacaattcacataacctttttgtaaagagagatgaagaaatggattaaagatttttaatatttgaaatggtaaatagaactaatttattgtaatatatttctgttatttatagatgtttccttaatgttttactgtgcattaccactttcatttaagccttatccttgtgaatttaccatttcttttttaaaacatgtctagatgcatattttaaataactggaatgtaaatcactagcatatctgaattcccaaatgtaatttttaaaaattattttggtttggaaaaaaaagattcatttgaaagccttcagatggaggggtgggaacatttttatggctttatgaattggaatttcataggcttatttacctagattgtgtgtgaacaaaaaaatattgtaaatagatgaatgtttcccataatgtaaaaagaagaaattaataaaataattaatgcactgctaaaaaaaatgtg

SEQ ID NO: 36665 - DNA, 1539 bp, Homo sapiens
gcagtatgatcggtgtctagctgaagttgtctttaaatgcccttactcgtcacagtttaaacacttaggatgtggcaatcttaagtatcaatggcattttatgtccagctaacatcctaaagcattagaaattaaaaacgaaagacttttaaaaacatacatcaaacatgcttgcaccagagaagctttttaaaataatacactctcatagccaggtgctaatttaattttacttatgaaattaagagaggtgatgggttctagcaacagatattttcacggacatattctaaaaccactagagaattcgctacctctcagagccatcgatgctttgagctacctttataaacagggcacaaatgtttactgctgtggtttacaagaaaagggctactcacttattttgaaaccaacgaaccaacttttaactagggtgaacaaagcactcaaagtgctttgtgaaattggagcatacagagattttgagcttcaagtatttgctagttttaaaaagaatacaccttttctttaccttgtagcagcaattaaaagtcacacaaagcttgcatcgagtagggccaactgccacttgggtagcctatggtcacattcaatactgagaatgacttggaactcacagattaatatgaaagaagcagcgttcatcccaagacccatgctcacaattacagctccgtgccctgaggtagagttgagatttggattaagaaatagatttctaatacgactcaagatcatcctacaatattttctttggaaactaatttagcccatgatattttaaagagagacaagagaaggcctatttatcttgtctaagtgaacggcatttgtatattcataagctatttttggtaagaattttaaatcttttagctcaaggcctacagggcatcatgatctttgccttccttgaaaatacaatttaaattgtacaaacactttataaaaagctaattattggtgttagaacatgaccccacacaatgctgcttgacccctgaaactgacattcatgagcataacctttgttacattgttctttttgatgtaatttgtagaaatgttttttagttcgtaatggaaaatgtatgtaccctgaaaaattacttattttgtttaactttggtataaaggtgttgggcattttcttggggagggggggattacaaaagaagtttgtctcccacatcaaaaaacgttcaaagaaattaagtatttattatattttttgcagatgtttccatacaattcacataacctttttgtaaagagagatgaagaaatggattaaagatttttaatatttgaaatggtaaatagaactaatttattgtaatatatttctgttatttatagatgtttccttaatgttttactgtgcattaccaatttcataggcttatttacctagattgtgtgtgaacaaaaaaatattgtaaatagatgaatgtttcccataatgtaaaaagaagaaattaataaaataattaatgcactgctaaaaaaaatgtg

SEQ ID NO: 36666 - DNA, 324 bp, Homo sapiens
cccaggagctcaagatcagcctgggcaacatagtgaagccccatctctacaaaataaaattgaatttaaaactagctgggcatagtggcacgcacctgtcatcccagctactcaggaggctgagatgggaggacaccttgaacccaggagtttgaggttacagtgagctatgatcatgccactgcactctagcctgggtgacagagcgagatcttgtctctaaatgaaaaagaaaactaattaaaaatgtcattgagtaggaaagaaaagatcatacatactatgctaagacttatgtgtatgtacatcagcacttatcaagct

SEQ ID NO: 36667 - DNA, 286 bp, Homo sapiens
catgttacacagggtagcatcagtaatatacccatttaaaaattatctgttcctctcttagtggtttgaccctacatttctaagtacatacataatttctgctgctagttttattttaacatatctacattgcacaaagacaggtacaagtaactgaattcaagtgagccttgacactttaatgagggtgttctgtgctgattaagcacttctgtaaatatcaagaattatactatgcaaagacttgtttgtacgtcagcactaagaacttctattgagtaggaaa

SEQ ID NO: 36668 - DNA, 326 bp, Homo sapiens
ccagttagacttccatgggtcccacaaatgcacaaaccctccatcttgggctgactgcactgagtgtttgctgacctgcatctctctgggatggaacccccagaggttgactcttggccacaaccactactaagatctcttcagtgctacctctaaactgggaaaggaatataaacactgagattccaccagggctgcagttggcagctcaggaatgccaagttttgaactgtagccaggactgaagggcacaaggaacctacatcttcagaacactgagagggaacatggctgcaactgtgaggaaacataggggaaacatataa

SEQ ID NO: 36669 - DNA, 291 bp, Homo sapiens
ggcagagggaacaacaaaaaaaaagttttttcagtgaatgaataaataaatgagacttgaaagatttttacctttgtgttttctctctgacaatcaattatacctttcacttatctcttgtttctgatgaacaagtttaacattcaacaagcaacatggcttcttgcaacatcaacaaatgcccatcattttcaaggccgcatagtattccattctatggagagccatgatttatccaatcctctatcgatggactttattgtcattttcatcttcttataaataatgatg

SEQ ID NO: 36670 - DNA, 449 bp, Homo sapiens
catgtaggttaagagctccctggagtaagactgaccagaattctgctttggcctcttattatctgatcaagtttctcaacttctctgattttaaattctctttgtctataaaattgagataatagtattgggttggtttgtgaagtagatgcttaaattaacttaaagggtttagcactttgcctatcatgtaaatggtcaataaatgttagtaatgattaaataatattgttgaatgaattgctctattagtctttcattctcttcttccctatttttttttactcttttctatgtatctttctctcatttttgctctcttggtatgccaaagggacattactattttcagtcaaatccacacggcttatggagaagacttatctcccaagaattgttttggtttgttgtaaccacttagagaaatttgttttattatcaaggacaaa

SEQ ID NO: 36671 - DNA, 498 bp, Homo sapiens
aaaggaatagaggataaagatttaatatcagataatacaagtaaaactcctaacccagtgggagaaaatatcaactgttagcttataaatcccctgaaactcaccaaggcaaatgaaatatatcctcattttttaaattagccacagggagtaactgaagagatgtagaagacattttatatcatgtaaaaacaagtgttttatgacactttttggccaaatagtgagaaaataaaggtaaaacaatacatatatgttagaaatgagcatatttgtagagcttcatatttgattatgtattcatatgcatttgggctcatattatctgttcttatagttggcttcatagttctggtttttagacaacaagccctcttgcccctgctcctcggcacagccagcaaggagtgtagaggggggaaacagcggaatagagaggtcacttggccgccatattatcctcctctccctctacttatcttttcataagctctttat

SEQ ID NO: 36672 - DNA, 611 bp, Homo sapiens
gctctcctttctgactgtgctctgtccatttcctctgatagttctacagtgtcagccggttgcctacaaggagcttatcggacaatatctgtgcagtctgtgggcagaagatcattgtggagcttgatgaagaagggctcattgaaaacacctaccagctttcctgtaatcatgtctttcatgaattctgcatccgaggttggtgtatcgttgggaaaaagcagacttgcccttactgcaaagagaaagttgatttgaagaggatgatcagtaatccctgggagcgcacacattttctgtatggacaaatcctggattggcttcgttatttggtggcctggcaacctgtggtgataggaatagttcaaggcattaactattcactagggctggaataggacagcagaccccagaagcaacatactgcatggttgaaatccttggtccaacatttaatattaatttttttaattttagagatgatcccaagtgtttagaaaactaagtaaactttgttgtcaagcaatttgtccatgtggaaagaatttaaagagaagctgaacaatggaataaacaaataaagcatgttttttcatctttcccattaaaac

SEQ ID NO: 36673 - DNA, 553 bp, Homo sapiens
atattcgttctggttatctattattaattattcgtgggcgggatggtttagctgcacgactctcttaatttatccatcgctacagttctacagtgtcagccggttgcctacaaggagcttatcggacaatatctgtgcagtctgtgggcagaagatcattgtggagcttgatgaagaagggctcattgaaaacacctaccagctttcctgtaatcatgtctgggagcgcacacattttctgtatggacaaatcctggattggcttcgttatttggtggcctggcaacctgtggtgataggaatagttcaaggcattaactattcactagggctggaataggacagcagaccccagaagcaacatactgcatggttgaaatccttggtccaacatttaatattaatttttttaattttagagatgatcccaagtgtttagaaaactaagtaaactttgttgtcaagcaatttgtccatgtggaaagaatttaaagagaagctgaacaatggaataaacaaataaagcatgttttttcatctttcccattaaaac

SEQ ID NO: 36674 - DNA, 1579 bp, Homo sapiens
ctcctccagtcctgccgcccggtaacaaaaccggggttcccgccacacgcacccggtagggctcaggacgctttatcggcgacaatggctggctgaatgggaggcctgaggtcctgaaggaaccgggggtgctggcgaccgggacctcgaggccgctgctggggaggacgctggccagcgtgcagggggcggaggcggggcgtgccgggaggctcccatctcccgccccgcacaacccgggcagggccgccgctccgccgccgccgcagatccggctctcaccctcggctcccgaggccccgcggcgcctccttctgcggactctgcgggaccctccccggcaggcgctgtgccctggagaaggcacagtggctcaggcatggccgcggggacggcggcgcggaaggcagcgccggtgctggaggcccccccgcagcaggagcagctctctcatacaaagctttctgcagaagacacatggaacctgcagcaggagaggatgtacaagatgcaccggggccacgattccatgcacgtggaaatgatcttgatcttcctctgcgttctggtcattgcccagatagtgctggttcagtggagacagaggcatggccgatcctacaatctggtgaccttgttgcagatgtgggttgtccccttatatttcacgataaaattatactggtggcggtttctgtctatgtgggggatgttctccgttattaccagttacatcctcttcagagctacccgaaaacccctctcaggaaggacaccacgattggtctacaaatggtttcttttgatctacaaactcagctatgcatttggtgttgtgggttacttggcgatcgtgtttacaatgtgtggattcaatctgtttttcaaaatcaaagctagagattccatggattttggcattgtgtctttgttctacggcctctactatggagtaatggggagagactttgccgagatctgctcagactacatggcttccactatagggttctacagtgtcagccggttgcctacaaggagcttatcggacaatatctgtgcagtctgtgggcagaagatcattgtggagcttgatgaagaagggctcattgaaaacacctaccagctttcctgtaatcatgtctttcatgaattctgcatccgaggttggtgtatcgttgggaaaaagcagacttgcccttactgcaaagagaaagttgatttgaagaggatgatcagtaatccctgggagcgcacacattttctgtatggacaaatcctggattggcttcgttatttggtggcctggcaacctgtggtgataggaatagttcaaggcattaactattcactagggctggaataggacagcagaccccagaagcaacatactgcatggttgaaatccttggtccaacatttaatattaatttttttaattttagagatgatcccaagtgtttagaaaactaagtaaactttgttgtcaagcaatttgtccatgtggaaagaatttaaagagaagctgaacaatggaataaacaaataaagcatgttttttcatctttcccattaaaac

SEQ ID NO: 36675 - DNA, 1791 bp, Homo sapiens
ctcctccagtcctgccgcccggtaacaaaaccggggttcccgccacacgcacccggtagggctcaggacgctttatcggcgacaatggctggctgaatgggaggcctgaggtcctgaaggaaccgggggtgctggcgaccgggacctcgaggccgctgctggggaggacgctggccagcgtgcagggggcggaggcggggcgtgccgggaggctcccatctcccgccccgcacaacccgggcagggccgccgctccgccgccgccgcagatccggctctcaccctcggctcccgaggccccgcggcgcctccttctgcggactctgcgggaccctccccggcaggcgctgtgccctggagaaggcacagtggctcaggcatggccgcggggacggcggcgcggaaggcagcgccggtgctggaggcccccccgcagcaggagcagctctctcatacaaagctttctgcagaagacacatggaacctgcagcaggagaggatgtacaagatgcaccggggccacgattccatgcacgtggaaatgatcttgatcttcctctgcgttctggtcattgcccagatagtgctggttcagtggagacagaggcatggccgatcctacaatctggtgaccttgttgcagatgtgggttgtccccttatatttcacgataaaattatactggtggcggtttctgtctatgtgggggatgttctccgttattaccagttacatcctcttcagagctacccgaaaacccctctcaggaaggacaccacgattggtctacaaatggtttcttttgatctacaaactcagctatgcatttggtgttgtgggttacttggcgatcgtgtttacaatgtgtggattcaatctgtttttcaaaatcaaagctagagattccatggattttggcattgtgtctttgttctacggcctctactatggagtaatggggagagactttgccgagatctgctcagactacatggcttccactatagggttctacagtgtcagccggttgcctacaaggagcttatcggacaatatctgtgcagtctgtgggcagaagatcattgtggagcttgatgaagaagggctcattgaaaacacctaccagctttcctgtaatcatgtgtgctgaggacactgaaatgaatgagacatagtcctacaggtaacacatggtctaggagaaacatgtcccttacagaacctcccgaaaaaagcgatgtgcctcatcaagtcatgactccaccactagaccctgaagatgggaccattccatgccatcatgaaccagacattgccttttcatatctagaagcctccctaacaagatgcttcagctttcatgaattctgcatccgaggttggtgtatcgttgggaaaaagcagacttgcccttactgcaaagagaaagttgatttgaagaggatgatcagtaatccctgggagcgcacacattttctgtatggacaaatcctggattggcttcgttatttggtggcctggcaacctgtggtgataggaatagttcaaggcattaactattcactagggctggaataggacagcagaccccagaagcaacatactgcatggttgaaatccttggtccaacatttaatattaatttttttaattttagagatgatcccaagtgtttagaaaactaagtaaactttgttgtcaagcaatttgtccatgtggaaagaatttaaagagaagctgaacaatggaataaacaaataaagcatgttttttcatctttcccattaaaac

SEQ ID NO: 36676 - DNA, 1812 bp, Homo sapiens
ctcctccagtcctgccgcccggtaacaaaaccggggttcccgccacacgcacccggtagggctcaggacgctttatcggcgacaatggctggctgaatgggaggcctgaggtcctgaaggaaccgggggtgctggcgaccgggacctcgaggccgctgctggggaggacgctggccagcgtgcagggggcggaggcggggcgtgccgggaggctcccatctcccgccccgcacaacccgggcagggccgccgctccgccgccgccgcagatccggctctcaccctcggctcccgaggccccgcggcgcctccttctgcggactctgcgggaccctccccggcaggcgctgtgccctggagaaggcacagtggctcaggcatggccgcggggacggcggcgcggaaggcagcgccggtgctggaggcccccccgcagcaggagcagctctctcatacaaagctttctgcagaagacacatggaacctgcagcaggagaggatgtacaagatgcaccggggccacgattccatgcacgtggaaatgatcttgatcttcctctgcgttctggtcattgcccagatagtgctggttcagtggagacagaggcatggccgatcctacaatctggtgaccttgttgcagatgtgggttgtccccttatatttcacgataaaattatactggtggcggtttctgtctatgtgggggatgttctccgttattaccagttacatcctcttcagagctacccgaaaacccctctcaggaaggacaccacgattggtctacaaatggtttcttttgatctacaaactcagctatgcatttggtgttgtgggttacttggcgatcgtgtttacaatgtgtggattcaatctgtttttcaaaatcaaagctagagattccatggattttggcattgtgtctttgttctacggcctctactatggagtaatggggagagactttgccgagatctgctcagactacatggcttccactatagggttctacagtgtcagccggttgcctacaaggagcttatcggacaatatctgtgcagtctgtgggcagaagatcattgtggagcttgatgaagaagggctcattgaaaacacctaccagctttcctgtaatcatgtgtgctgaggacactgaaatgaatgagacatagtcctacaggtaacacatggtctaggagaaacatgtcccttacagaacctcccgaaaaaagcgatgtgcctcatcaagtcatgactccaccactagaccctgaagatgggaccattccatgccatcatgaaccagacattgccttttcatatctagaagcctccctaacaagatgcttcagctttcatgaattctgcatccgaggttggtgtatcgttgggaaaaagcagacttgcccttactgcaaagagaaagttgatttgaagaggatgatcagtaatccctgggagcgcacacattttctgtatggacaaatcctggattggcttcgttatttggtggcctggcaacctgtggtgataggaatagttcaaggcattaactattcactagggctggaataggacagcagaccccagaagcaacatactgcatggttgaaatccttggtccaacatttaatattaatttttttaattttagagatgatcccaagtgtttagaaaactaagtaaactttgttgtcaagcaatttgtccatgtggaaagaatttaaagagaagctgaacaatggaataaacaaacaacaaaacgtcttttgtttgtcataacgatatcaatgtcaatattataattct

SEQ ID NO: 36677 - DNA, 503 bp, Homo sapiens
tcacataaggggcttttaattgagcacatagaattaacaagaaaggaaatacccattcattacattgtttattatatttgcaaatgacatttatgaatatttctgctacttggctgtatatagaacaacctccttaactgagatttagctgggagcgcacacattttctgtatggacaaatcctggattggcttcgttatttggtggcctggcaacctgtggtgataggaatagttcaaggcattaactattcactagggctggaataggacagcagaccccagaagcaacatactgcatggttgaaatccttggtccaacatttaatattaatttttttaattttagagatgatcccaagtgtttagaaaactaagtaaactttgttgtcaagcaatttgtccatgtggaaagaatttaaagagaagctgaacaatggaataaacaaacaacaaaacgtcttttgtttgtcataacgatatcaatgtcaatattataattct

SEQ ID NO: 36678 - DNA, 1437 bp, Homo sapiens
ctcctccagtcctgccgcccggtaacaaaaccggggttcccgccacacgcacccggtagggctcaggacgctttatcggcgacaatggctggctgaatgggaggcctgaggtcctgaaggaaccgggggtgctggcgaccgggacctcgaggccgctgctggggaggacgctggccagcgtgcagggggcggaggcggggcgtgccgggaggctcccatctcccgccccgcacaacccgggcagggccgccgctccgccgccgccgcagatccggctctcaccctcggctcccgaggccccgcggcgcctccttctgcggactctgcgggaccctccccggcaggcgctgtgccctggagaaggcacagtggctcaggcatggccgcggggacggcggcgcggaaggcagcgccggtgctggaggcccccccgcagcaggagcagctctctcatacaaagctttctgcagaagacacatggaactggtgaccttgttgcagatgtgggttgtccccttatatttcacgataaaattatactggtggcggtttctgtctatgtgggggatgttctccgttattaccagttacatcctcttcagagctacccgaaaacccctctcaggaaggacaccacgattggtctacaaatggtttcttttgatctacaaactcagctatgcatttggtgttgtgggttacttggcgatcgtgtttacaatgtgtggattcaatctgtttttcaaaatcaaagctagagattccatggattttggcattgtgtctttgttctacggcctctactatggagtaatggggagagactttgccgagatctgctcagactacatggcttccactatagggttctacagtgtcagccggttgcctacaaggagcttatcggacaatatctgtgcagtctgtgggcagaagatcattgtggagcttgatgaagaagggctcattgaaaacacctaccagctttcctgtaatcatgtctttcatgaattctgcatccgaggttggtgtatcgttgggaaaaagcagacttgcccttactgcaaagagaaagttgatttgaagaggatgatcagtaatccctgggagcgcacacattttctgtatggacaaatcctggattggcttcgttatttggtggcctggcaacctgtggtgataggaatagttcaaggcattaactattcactagggctggaataggacagcagaccccagaagcaacatactgcatggttgaaatccttggtccaacatttaatattaatttttttaattttagagatgatcccaagtgtttagaaaactaagtaaactttgttgtcaagcaatttgtccatgtggaaagaatttaaagagaagctgaacaatggaataaacaaataaagcatgttttttcatctttcccattaaaac

SEQ ID NO: 36679 - DNA, 1273 bp, Homo sapiens
ctcctccagtcctgccgcccggtaacaaaaccggggttcccgccacacgcacccggtagggctcaggacgctttatcggcgacaatggctggctgaatgggaggcctgaggtcctgaaggaaccgggggtgctggcgaccgggacctcgaggccgctgctggggaggacgctggccagcgtgcagggggcggaggcggggcgtgccgggaggctcccatctcccgccccgcacaacccgggcagggccgccgctccgccgccgccgcagatccggctctcaccctcggctcccgaggccccgcggcgcctccttctgcggactctgcgggaccctccccggcaggcgctgtgccctggagaaggcacagtggctcaggcatggccgcggggacggcggcgcggaaggcagcgccggtgctggaggcccccccgcagcaggagcagctctctcatacaaagctttctgcagaagacacatggaacctgcagcaggagaggatgtacaagatgcaccggggccacgattccatgcacgtggaaatgatcttgatcttcctctgcgttctggtcattgcccagatagtgctggttcagtggagacagaggcatggccgatcctacaatctggtgaccttgttgcagatgtgggttgtccccttatatttcacgataaaattatactggtggcggtttctgtctatgtgggggatgttctccgttattaccagttacatcctcttcagagctacccgaaaacccctctcaggaaggacaccacgattggtctacaaatggtttcttttgatctacaaactcagctatgcatttggtgttgtgggttacttggcgatcgtgtttacaatgtgtggattcaatctgtttttcaaaatcaaagctagagattccatggattttggcattgtgtctttgttctacggcctctactatggagtaatggggagagactttgccgagatctgctcagactacatggcttccactatagggttctacagtgtcagccggttgcctacaaggagcttatcggacaatatctgtgcagtctgtgggcagaagatcattgtggagcttgatgaagaagggctcattgaaaacacctaccagctttcctgtaatcatgttttaaatgccagaaaacattccactctttatgttctatattttccacattaagggctgtagtggaaatgtgatgagacactgcaaaaaataggtaaaatatatggaagaatattcaggatggatggatgg

SEQ ID NO: 36680 - DNA, 425 bp, Homo sapiens
gggtttcaccatgttggccaggctgttcttgaactcctgacctcaggtgatccacctgcctcagcctcccaaagtggctgagattacaggcgtgaccaccacgcccggccaagtcctacttctaggtgtgaaaaatgattgcaaactttaacaccactacagtaagcttttaaaaatttgacctacaataactttgaagactgaaagttattctgttaatgtaatgtactgaaagtccaacactgcagattagctcagcaataccattttaggaatattcacttaagaactaaaagcatcaaaacacatatgcaacaaaccatgaagcatcatgcatcaaatctttctactagttaaatctatcaaacagaagagtataacaagaaaatcaatgcctaatattgagataactgatccaaacattc

SEQ ID NO: 36681 - DNA, 1525 bp, Homo sapiens
aaaattctatagtgaatcctgtttgcttcatggactgagtatagtagcgtatctttttctgtgactagaagttatttatgaaagagaatcatttatgtttgaagaagtaaatatgcctcagtttcaaatggtcctttaagggctctgtataaacgattccaatatatttctcagttgttattaaagtacttgatttttttcttgtctaacttttagcaatttttatattaatatttcaaagaaccatgtttaagtaaattactagcaaaggaactctttgggggaactttatgaaattttctcttggcagttgctaaaagttttcttacgttttctaaaagttcagtaatagtacatttatctttagaaaagtttgcttttcagaaagtgtttccatttttcttgtggtcagaatgtgctgtgaattttaaatgtatttttaagatattatagctaaattgtacctcactgttttctctaaaaagttttactgcttttgcttccactccactattcagtgataacaagggtaacaagtttccactagaattgcttgtcactttattcttgtacttttgttttactactgaacatctttttaaatcgttgccacaaaatatctcgcttttatcattttcacattgctctagtatatcaactttggaaacaagacatcattctatttatagcattctgtttttagtagtggtatttccatttacaaaatacagtaattcttgatcgctgaagacgtcaaatcctagaaaacatagcatgcctacgcgtgatgttaacatcattctcgaatagttgttggttgaagattcatttgatgaatccgatttttcagaaatagacgagtctgatgatacagacgattctggtgttagttctctgtagaaataactccaagaacacttttaatagtttattttcacattgaaaatcagatttgctccagcctcaaagagtatatttatgtaaaattaggtaagcgatatagaagcaagctgcactttttttctaaatgggaaggtattaaaaaagaaaagtctcattttagtaacatagtcttccttaaactctatgccacttgtaagatttctgaaaactgaagacatagaagggaacgggcttgatatgaacgacagctttgctggtaaataaacccaactgaacctaagattatctaaggtaacctctttttctagtcttttattgtgtgaacagttacctcctgctgagttgttggcagaatttccatataatcttgcttatgaccatttctacattatttgtatcatcttttagaagtcttacccaggttgatataggttaccgttctctagatctgtgtctccaattcttcttacatggcattaggtattttaagcttgttttttttcagacatcgtatagtcaattcttgaatgtgttgagaggtgctatgtcattgtaagctttattcttcttctctgaatgattagcttgtttaaattttaccttaaattcttttttttctttt

SEQ ID NO: 36682 - DNA, 440 bp, Homo sapiens
tgccttctctcctcattccagtctgcctgtctgtctgggtgacaataactctggggaaaaatgacaaggacaaaatatgagtttctccccacccagttttagaagcccaggtcccactgatgacacccagaaagaccctctgggaaagttgtcagacaagatctgtcagctccaggacatagattttcttcagtaacatcaaatcccaatattttgttctgtttttactcactctaacccaagcatgatggagttgcttatggccctgtaggcaagtcagaaggcagaaacttgctgtttgtcatttccccaacagaggttgggtggcagcacttgacagatatacttggaggatgaagaccatttgggggattcaaaactaataaaattaaaaactaaaaaaagacatacttggaggggagggtctcccagtgcatgac

SEQ ID NO: 36683 - DNA, 491 bp, Homo sapiens
gactctgtctcaaaaataaaataaaataaaataataaagaggttaagaagatggcttaaagtcacacagccagcaagtcgggggagcttagtctctgtgacactatcacccatgctgtagaccatcaccatctgatagaaataatgtgagccccatatattatttaaagtgttctaatagccacattaaaaagtaaaaagaaccatgtgagattaattttaataatatatttcctttaacccaatatagccaaaatattatcatttcaacatgtaatcaatataaaaactattaatgagacagttactttttttgtgctaagtctttgaaatctggtgtggatgtaacacatagcacatctcggtttggagactaaattttcattggaaatacttggtctgtatttagatttcataaaatttcataaaattagattttataaaatttaggtttcacaaaatttacagttgaaaaagtagatttacatatca

SEQ ID NO: 36684 - DNA, 338 bp, Homo sapiens
tgcgtgtatagtttaagtcatacaaacaatacaagcgagtaaagtgccaaagggaatgtcaacgttttcccatatttttcttcagtaagatgataagaaatgcattgttaagagggttatagtcactgagaatcttagtggaggcactcttgtctatgccagggttgactggaggagacactactacagaactgggctccttaacagaaataaggctgataggatcctgaaataacagaggccaagtagtaagacttaactgtcagaagcaaggtgtgcacagtttttgcaatgagtggcaagattgatgtggcatccaggggcccattctacagaga

SEQ ID NO: 36685 - DNA, 760 bp, Homo sapiens
ccgcattaatgcaaacctacacacccgccacccacccccgccgttagaaatcataggtgggatgctggatatagaaccaagactttggaggaaaggcatccgagaaagctttgaggatcagaggaaaaaagcactgcagtttgctcagtggtggaaaccatatgacttcaccaaaagtaaaaactattgaggtgtaccttccattttaaaatttttcttcagatcccgttcagttttatttccattgcatctaatgaagcaactgaccctcaggtcacaggcagagagaatcacagcagcagactgctctgggtcagtgacaactgtacatcaggagattgtgttgttttcttcttcacctgctcctatctatggacttcattttagtcaccatggagtaaaaacatatattcgatgatctgctcacattcctgctctctacctacttcttggtattccgaattgttcagttaatttagagaaggccttttctgaagggatatctagaaagcataggaaatccttggttcagagggaagtgggtctgcttcatggttgttaagtctactgtctggcttcttttgcatttttaaaaataagacgatttaattttaatttcataggattttatagaaaagctcttaattttctactagcagtatatagtatcacttctattctttttgttaaaggaaaaggaaatgtccccaaagtattaaagaattaaatgatactgaaaatttgtatgattcaaatttgt

SEQ ID NO: 36686 - DNA, 2174 bp, Homo sapiens
cgtccttcatcataacagtcggcatcttcctcctcctcatcttcatcatcaatgtcgtcatcatacaagtcgtcgtaaagcaaatctaaggttacacctcaaggaactaaagaaacgaagaacaaacctaacccaaaccctaacacagcagaagaaaataaataacaaagattagagcagaactaaacaaaattgaaacagataaacattcaaatcaaaagccatcggaaaccagtactgatgaacaccaacatgttccagaagacccaagagaaaaatcacaagatgaagtcttgagagatgaccctccaaaaaaagaacatctacgggatacaaagtctacatttgctggcagtccagagcgtgagtccattcacatcctgagtgttgatgagaagaacaagttgggagccaagattatcaaagcagagatgatggggaatatggaattagctgaacaacttaaagttcaacttgaaaaggcaaataaattcaaagaaactataacacagataccaaaaaaatctggggtagagaatgaagaccagcaagaagtaatccttgtcagaacagatcagtctggaagagtatggcctgtgaacacacccggaaaatctctggaatcacaaggaggaagaagaaagagacagatggtttcaacccatgaggaaagagaaagggtcagatactttcatgatgatgataatctaagcctaaatgatttagtcaaaaatgaaaagatgggaacagcagaaaatcaaaacaagctctttatgagaatggcatctaagtttatgggaaaaacagatggagactattacaccctggatgacatgtttgtctccaaagcagctgagagagaacgtcttggtgaagaggaagagaaccaaaggaaaaaagctattgctgagcatcggagtcttgctgcacaaatggaaaaatgtctgtattgttttgacagctctcaatttcccaagcatcttattgttgcaataggtgttaaggtttatttatgtttacccaacgtacggtctcttactgaggggcactgcctgatagtccctttgcagcaccatagagcagctactttgttggatgaagacatctgggaggagatccagatgttcagaaaatcattggtaaagatgtttgaagataaaggattagactgcatttttttggaaactaatatgagcatgaagaaacagtatcacatggtttatgaatgtattcctcttcccaaggaagtgggtgacatggctcccatctattttaagaaagccataatggaatctgatgaagagtggtccatgaacaagaagttgatagatctctcttcaaaagatatcagaaagtctgtacccagagggttaccttacttctctgtggattttggccttcacggagggtttgcccatgtcattgaagatcagcacaaattccctcattactttggaaaggaaatcataggtgggatgctggatatagaaccaagactttggaggaaaggcatccgagaaagctttgaggatcagaggaaaaaagcactgcagtttgctcagtggtggaaaccatatgacttcaccaaaagtaaaaactattgaggtgtaccttccattttaaaatttttcttcagatcccgttcagttttatttccattgcatctaatgaagcaactgaccctcaggtcacaggcagagagaatcacagcagcagactgctctgggtcagtgacaactgtacatcaggagattgtgttgttttcttcttcacctgctcctatctatggacttcattttagtcaccatggagtaaaaacatatattcgatgatctgctcacattcctgctctctacctacttcttggtattccgaattgttcagttaatttagagaaggccttttctgaagggatatctagaaagcataggaaatccttggttcagagggaagtgggtctgcttcatggttgttaagtctactgtctggcttcttttgcatttttaaaaataagacgatttaattttaatttcataggattttatagaaaagctcttaattttctactagcagtatatagtatcacttctattctttttgttaaaggaaaaggaaatgtccccaaagtattaaagaattaaatgatactgaaaatttgtatgattcaaatttgt

SEQ ID NO: 36687 - DNA, 1144 bp, Homo sapiens
tcactattctccagataaaatctagaacagtcatccaataattaagccagaaagggagtatgaacaaacatgaagtaaagatgtttgtgagatgttcagaaaatcattggtaaagatgtttgaagataaaggattagactgcatttttttggaaactaatatgagcatgaagaaacagtatcacatggtttatgaatgtattcctcttcccaaggaagtgggtgacatggctcccatctattttaagaaagccataatggaatctgatgaagagtggtccatgaacaagaagttgatagatctctcttcaaaagatatcagaaagtctgtacccagagggttaccttacttctctgtggattttggccttcacggagggtttgcccatgtcattgaagatcagcacaaattccctcattactttggaaaggaaatcataggtgggatgctggatatagaaccaagactttggaggaaaggcatccgagaaagctttgaggatcagaggaaaaaagcactgcagtttgctcagtggtggaaaccatatgacttcaccaaaagtaaaaactattgaggtgtaccttccattttaaaatttttcttcagatcccgttcagttttatttccattgcatctaatgaagcaactgaccctcaggtcacaggcagagagaatcacagcagcagactgctctgggtcagtgacaactgtacatcaggagattgtgttgttttcttcttcacctgctcctatctatggacttcattttagtcaccatggagtaaaaacatatattcgatgatctgctcacattcctgctctctacctacttcttggtattccgaattgttcagttaatttagagaaggccttttctgaagggatatctagaaagcataggaaatccttggttcagagggaagtgggtctgcttcatggttgttaagtctactgtctggcttcttttgcatttttaaaaataagacgatttaattttaatttcataggattttatagaaaagctcttaattttctactagcagtatatagtatcacttctattctttttgttaaaggaaaaggaaatgtccccaaagtattaaagaattaaatgatactgaaaatttgtatgattcaaatttgt

SEQ ID NO: 36688 - DNA, 307 bp, Homo sapiens
agaagaacaagttgggagccaagattatcaaagcagagatgatggggaatatggtaagactcttagatgttgctttagagaataatgattaaatgtttaacttcttatgagtaattttagaagttccttagcagtgtggatatagcacactgtgaaaataactgttggttattgattccttaaagaaattctcaggcctggcaccatgcctgtaatcccagcactttgggaggccaaggcaggcggatcacttgaggtcaggagttcgagaccagcctggccaaaatggtgaaaccctgtctctagt

SEQ ID NO: 36689 - DNA, 2478 bp, Homo sapiens
tagtcaatggaaatatttcagtcaaaattagaagatgctgaaaaagctgcatccacgaaagaagattatagacgggaacggtggaggaaacccacatattcagataaagcacaaaattgtcaagaaagtagagaatcagacttagtaaaatatggtaacagttcaagggatagatatgctacaacagatactgcaaaaaatagcaataatgaaaaatttattggtgatgaaaaagataagagacctgggtctttagaaacgtgtagaagagaatctaacccaaggcaaaatcaagagttttcttttggcaatttgagagctaaattcttgagaccctctgatgatgaagaactgtcatttcacagcaagggcagaaaatttgaaccacttagttcatcttcagcattggtagctcagggctctttgtgtagtggttttagaaaacccaccaagaacagtgaagaaagattaacatcatggagtcgctctgatgggagaggagacaagaaacattcaaatcaaaagccatcggaaaccagtactgatgaacaccaacatgttccagaagacccaagagaaaaatcacaagatgaagtcttgagagatgaccctccaaaaaaagaacatctacgggatacaaagtctacatttgctggcagtccagagcgtgagtccattcacatcctgagtgttgatgagaagaacaagttgggagccaagattatcaaagcagagatgatggggaatatggaattagctgaacaacttaaagttcaacttgaaaaggcaaataaattcaaagaaactataacacagataccaaaaaaatctggggtagagaatgaagaccagcaagaagtaatccttgtcagaacagatcagtctggaagagtatggcctgtgaacacacccggaaaatctctggaatcacaaggaggaagaagaaagagacagatggtttcaacccatgaggaaagagaaagggtcagatactttcatgatgatgataatctaagcctaaatgatttagtcaaaaatgaaaagatgggaacagcagaaaatcaaaacaagctctttatgagaatggcatctaagtttatgggaaaaacagatggagactattacaccctggatgacatgtttgtctccaaagcagctgagagagaacgtcttggtgaagaggaagagaaccaaaggaaaaaagctattgctgagcatcggagtcttgctgcacaaatggaaaaatgtctgtattgttttgacagctctcaatttcccaagcatcttattgttgcaataggtgttaaggtttatttatgtttacccaacgtacggtctcttactgaggggcactgcctgatagtccctttgcagcaccatagagcagctactttgttggatgaagacatctgggaggagatccagatgttcagaaaatcattggtaaagatgtttgaagataaaggattagactgcatttttttggaaactaatatgagcatgaagaaacagtatcacatggtttatgaatgtattcctcttcccaaggaagtgggtgacatggctcccatctattttaagaaagccataatggaatctgatgaagagtggtccatgaacaagaagttgatagatctctcttcaaaagatatcagaaagtctgtacccagagggttaccttacttctctgtggattttggccttcacggagggtttgcccatgtcattgaagatcagcacaaattccctcattactttggaaaggaaatcataggtgggatgctggatatagaaccaagactttggaggaaaggcatccgagaaagctttgaggatcagaggaaaaaagcactgcagtttgctcagtggtggaaaccatatgacttcaccaaaagtaaaaactattgaggtgtaccttccattttaaaatttttcttcagatcccgttcagttttatttccattgcatctaatgaagcaactgaccctcaggtcacaggcagagagaatcacagcagcagactgctctgggtcagtgacaactgtacatcaggagattgtgttgttttcttcttcacctgctcctatctatggacttcattttagtcaccatggagtaaaaacatatattcgatgatctgctcacattcctgctctctacctacttcttggtattccgaattgttcagttaatttagagaaggccttttctgaagggatatctagaaagcataggaaatccttggttcagagggaagtgggtctgcttcatggttgttaagtctactgtctggcttcttttgcatttttaaaaataagacgatttaattttaatttcataggattttatagaaaagctcttaattttctactagcagtatatagtatcacttctattctttttgttaaaggaaaaggaaatgtccccaaagtattaaagaattaaatgatactgaaaatttgtatgattcaaatttgt

SEQ ID NO: 36690 - DNA, 1651 bp, Homo sapiens
tagtcaatggaaatatttcagtcaaaattagaagatgctgaaaaagctgcatccacgaaagaagattatagacgggaacggtggaggaaacccacatattcagataaagcacaaaattgtcaagaaagtagagaatcagacttagtaaaatatggtaacagttcaagggatagatatgctacaacagatactgcaaaaaatagcaataatgaaaaatttattggtgatgaaaaagataagagacctgggtctttagaaacgtgtagaagagaatctaacccaaggcaaaatcaagagttttcttttggcaatttgagagctaaattcttgagaccctctgatgatgaagaactgtcatttcacagcaagggcagaaaatttgaaccacttagttcatcttcagcattggtagctcagggctctttgtgtagtggttttagaaaacccaccaagaacagtgaagaaagattaacatcatggagtcgctctgatgggagaggagacaagaaacattcaaatcaaaagccatcggaaaccagtactgatgaacaccaacatgttccagaagacccaagagaaaaatcacaagatgaagtcttgagagatgaccctccaaaaaaagaacatctacgggatacaaagtctacatttgctggcagtccagagcgtgagtccattcacatcctgagtgttgatgagaagaacaagttgggagccaagattatcaaagcagagatgatggggaatatggaattagctgaacaacttaaagttcaacttgaaaaggcaaataaattcaaagaaactataacacagataccaaaaaaatctggggtagagaatgaagaccagcaagaagtaatccttgtcagaacagatcagtctggaagagtatggcctgtgaacacacccggaaaatctctggaatcacaaggaggaagaagaaagagacagatggtttcaacccatgaggaaagagaaagggtcagatactttcatgatgatgataatctaagcctaaatgatttagtcaaaaatgaaaagatgggaacagcagaaaatcaaaacaagctctttatgagaatggcatctaagtttatgggaaaaacagatggagactattacaccctggatgacatgtttgtctccaaagcagctgagagagaacgtcttggtgaagaggaagagaaccaaaggaaaaaagctattgctgagcatcggagtcttgctgcacaaatggaaaaatgtctgtattgttttgacagctctcaatttcccaagcatcttattgttgcaataggtgttaaggtttatttatgtttacccaacgtacggtctcttactgaggggcactgcctgatagtccctttgcagcaccatagagcagctactttgttggatgaagacatctgggaggagatccaggtcagcataataaatgttcattatcattttaaaactcatgagcaatttttgtaaattattgtgataaattccaataggtataacttcatttaatgattttagtttctaaacttaaacacgtgtgttttcatagttgtatatatctgtggatcatgatgtttccatcattttatttcccttgtgtactccagattttgagaccttttatctacgaaataaactgtga

SEQ ID NO: 36691 - DNA, 508 bp, Homo sapiens
ccaaactacctgtccccatctaacatctgccccatcaggtatcaaaggcatctgtgaaacaggaggaaggagcacccctccaatgcaggcgtcatgtcaagtggagtctccccagcaggctgtccttcccatggatgtctttctgccaggctggagaactgtggtccctgaccagacgcggggtggggggccaccgccatcttgctggtgatatgacagccagcatatccactccaaagggtgtcgcaaagactctgcaaaactaaaagggttgctcatcaaaaggcagttgtcaaataagaacacccgtcttctccacggcactgagaccatccagatctggcttgggactggggtgaagtaggagtagctggtaacttagtgtgatgcttgggccagagtcgtgggtaagggaaaatgacatcccacaaaagcaaagggtccaagaacaggatttctgttctcttgcattggattctactactccctacttttgaatacatcagga

SEQ ID NO: 36692 - DNA, 249 bp, Homo sapiens
tttttcttttgcttctggttttctattggtttgtttgctattgacttggaggaatttctcatacattttggatattaacgctttatcatatacatggtttacaaatattttctcccaccccataggttattttttttccactttggtaattgtttcttttactgtgcagaagtattttaatttgataaaatcacacctatttttgtgtgtgttgcctctgtagaaattctgtttctagttattgctacc

SEQ ID NO: 36693 - DNA, 498 bp, Homo sapiens
cctgtgccccaggtgtgtttgctaccatacctccccaggggatagccctccaaacctgattggccaactagtctggtcttaaagtcctacagggacggccatcacgatactcactcagctatggcgaagacctgagtcctaattttggcttaaccccaaacttgggcgattcagttttacctgtgtcctctctataccatagtttatgacaaggggttttctgtggctggtctccaaggcctcttccaatcttgacattctatgatcctgtaagtctttgaataatggcccaggatgccaacaagaagtcaccaatgagagttcaggtgttctgttggaaatctttgtaaaatcacagagaaaaggagaagaaaaagaataaagaggaaaaactggacacataaataggaagacaaagaatgaatgtggactggggagagaagagtcattgacagggacaagaaataaataactttgacgcaaatcctgggaagactc

SEQ ID NO: 36694 - DNA, 116 bp, Homo sapiens
ctcaggaggctaaggctagagaatcacttaaacccgagaggtggaggaagttgcagtgagccgagatcacatgcactgtactccagactcagcaacaagagcaaaactctgtctca

SEQ ID NO: 36695 - DNA, 370 bp, Homo sapiens
tttttttttgaggcagggtctcgctctgtcgcccaggctggagtgcagtggcacaaactcagatcactgcagcctccgcttcccaggctcaagcgatcctccccccttggcctcccaaagtgctaggatttcgggcacgacactaccgccggctaaattttgtattttgtgtagagctgggtttccccatgttgcccaggctggtcttgaactactgggctcaagtggtcagcccgcctcagctttccaaactgctggaattacagtattatttttaaaaccacatatttcattattttaaaaacgatgctcttttcttgagtatttaggtatttccatttttgtttcatgttagtaaaacaaaaatttg

SEQ ID NO: 36696 - DNA, 5378 bp, Homo sapiens
agaatctgctgagcccccactaacccagagtgataaaagagagacttctcacaccacagcagcagcgactggtcggagttcccatgctgatgcaagagaatgtgctatttcaacccaggcagagcaagaagcaaaaacccttcaaacttcaacagactcagtctccaaagaaggcaacacaaattgcaagggagaaggcatgcaagttaatactctatttgaaacaagccaggttccagactggagtgatcctcctcaggtacaagttcaggaaacagtcagagagacaatctcttgcagccagatgccagctttctcagagcctgctggggaggagtccccattcactgggaccacaacaatttccttctcaaacttaggaggggtccacaaggaaaatgcatcattagctcaacactcggaggtcaaaccctgtacctgtggtccacagcaggaagaaaaacaagacagagatggcaacatacctgacaatttcagggaagacctaaaatatgagcagagcatctcagaagccaatgatgagactatgtccccaggtgtgttctcaaggcatctccccaaggatgctcgtgctgacttcagggagcctgtggctgtctctgttgcttcccctgaacccacagatactgccctcaccctggaaaatgtgtgtgatgagccaagggacagagaagcagtgtgtgcaatggagtgttttgaggctagtgaccaaggaacatgttttgataccatagattctcttgttgggacaccagttgataactattcgcctcaagaaatttgctctgtagatacggaactggcagaaggtcaaaacaaagtatctgatttatgttcttctaatgacaagacactggaagtcttttttcagacacaagtgtctgagacttcagtgtctacgtgcaaaagcagcaaggacggcaactcagtcatgtcccctctttttatcagtactttcaccttgaacatttcacacacagctagtgaaggtgccacaggagaaaatctagccaaggtggagaaatccacctacccactggcctccacagtacatgctggccaggagcagccaagccccagcaactcaggagggcttgatgaaacacagctcctttcttctgagaacaatcctttagtgcaatttaaagaaggaggtgacaagagccccagtcctagtgccgcagacaccacagccacaccagccagttatagttcaattgtgagttttccttgggagaagccaacaacattaactgctaataatgagtgctttcaagcgaccagagagactgttaccattgccaccgaagtccacccagccaaataccttgctgtgtcaattcctgaggacaagcatgcaggtggcactgaggagaggttccctcgtgcatcccatgaaaaggtttcccaatttccttcccaagtgcaggtggatcatattttaagtggtgctaccatcaaatctacaaaagagctactttgcagggcacccagtgtgccaggagtcccacaccatgtcctgcagctcccagagggagagggtttctgcagtaattcccctcttcaggttgataacctgtctggagataagagccagactgtggacagagcagactttaggagctatgaagagaatttccaagaaagaggaagtgaaacaaagcagggggtccagcagcagagcctgtcccagcagggttctctttctgcacctgatttccaacaaagtttgcctacgacatctgctgcacaagaggaaagaaacttggtgcccacggccccctcaccagcaagctctagggaaggagcagggcagcgctcaggttgggggacgagggtctccgtggtggctgaaactgctggggaagaagacagtcaggctctgagcaacgttccatctctctctgatatccttttggaagagtctaaagaatatagacctggaaattgggaggcaggcaacaagctgaagattataactctagaggcttccgcttctgaaatctggccaccacgacaactgacaaattctgagagcaaggcatcagacggtggtctcataattcctgacaaggtctgggctgtacctgatagtctaaaggcagatgctgttgtgcctgaattggccccctctgaaatagcagcattggctcacagtccagaggatgctgagtcagcccttgctgatagcagagaaagccataaaggcgaagagcccaccatcagtgtacactggagaagtctttcttcccggggtttcagccaaccgagactcctggagtcatccgtggaccctgtagatgaaaaggagttatctgtcacagattcactgtcagcggcttctgaaactggagggaaggaaaatgttaacaatgtgagtcaagaccaggaggaaaaacaactcaagatggatcacactgccttctttaaaaagtttctgacctgccctaaaatcctagagtcctctgtagatcccattgatgagataagtgtgatagagtacaccagggctggaaaaccagagccctctgaaaccacaccacagggcgccagagaaggaggtcaatcaaatgacggaaacatgggccacgaagcggaaatccagtcggccattttgcaagttccatgtctccagggaaccattctgagtgaaaatagaatcagcagaagccaagaaggcagtatgaagcaggaggcagaacaaattcaacctgaggaggcaaaaactgccatttggcaagtcctgcaacccagcgaaggcggtgaaagaattccaagtggatgtagcataggccaaatacaagaaagcagtgatgggagcttaggggaggctgagcaaagcaaaaaggacaaagcagaattgatttcccccacttcacctctttctagttgtcttccaataatgactcactcttctcttggggttgacacgcacaactccacaggccaaattcatgacgtccctgaaaatgacatagttgagcccagaaagcgtcagtatgtgtttcctgtttcacagaaaaggggaactattgagaatgagcgtgggaaacctttgccctcttctcctgatcttaccaggttcccttgtacttcatctcctgaaggaaatgtcacagactttttgataagccacaaaatggaggaacctaaaatagaggtgcttcaaattggggaaaccaaacccccaagctcatctagctcctcagcgaagaccttggcatttatttcaggagaacgtgagttagagaaagcccctaagttactgcaggatccatgtcaaaagggcaccctgggctgtgcgaaaaagtccagggagagagagaagtccctggaagcccgagcaggcaaatcgccagggaccctcacagcagtgacggggtcagaggaggtcaagaggaagccagaagccccaggcagtggacatttagctgagggagtaaagaagaaaattttgtccagggtggcagcactgaggctgaaactggaagaaaaggaaaatatcagaaagaactcagcctttcttaaaaagatgcccaaactcgaaacatcattatcacacacagaagagaaacaagacccaaaaaagccatcttgcaaaagagaaggaagagctccagtattactgaaaaaaatccaagctgagatgttccctgaacactctggaaatgtaaaattaagctgccaatttgcagaaattcatgaagattctactatctgctggacaaaagattcaaagtccatagcccaagtgcagagaagtgcaggggacaactccactgtttcctttgccatcgtgcaagccagtccgaaggaccagggactctattactgctgcatcaagaacagctacggaaaagtgactgctgaatttaacctcacagctgaagttctcaaacagctgtcaagtcgccaggatactaaaggatgtgaagagattgaattcagccaactcatcttcaaagaagacttcctccatgacagctactttgggggccgcctgcgtggtcagatcgccacggaggagctgcactttggagaaggggttcaccgcaaagccttccgcagcacagtgatgcacggcctcatgcctgtcttcaaacctggccatgcctgtgtgcttaaggtgcacaatgccattgcctatgggaccagaaataatgatgagctcatccaaaggaactacaaactcgctgcccaggaatgctatgttcaaaatactgccaggtattatgccaagatctacgctgctgaagcacagcctctggaaggctttggagaagtacctgagatcattcctatttttcttatccatcggcctgagaacaatatcccgtatgctacagtggaggaggagctgattggagaatttgtgaagtattccatcagggatgggaaagaaataaacttcttgagaagagaatcagaagctggtcagaaatgttgcaccttccagcactgggtgtaccagaaaacaagtggctgcctcctggtgacggacatgcaaggtgtaggaatgaagctaactgacgttggcatagcaacgctggctaaagggtacaagggatttaaaggcaactgttccatgaccttcattgatcagtttaaagcactacaccagtgtaacaagtattgcaaaatgctgggactgaaatcccttcaaaacaacaaccagaaacagaagcagccgagcattgggaaaagcaaagttcaaacaaactctatgacagtaaagaaggcagggcctgagaccccaggcgaaaagaaaacctaacgtccctgggtaacctaatggccactggctagcagcacacaatctcgccagggaaaatctgaggccacacaggagagaatatacagcctgcagagagtgcgtggcaatccttactcccagccgactgtgcgccaagatgcttctaaacccatcacctgctgtcttcactcaaatgatttcagaacaggatttgcgaccaggtttatggggagattgaatcaacgattggtctcaaagacagtccattctttatatacacgtttagcatttttaccaacctcacatcatgtgtatatttgtgtatttgcacatggttgtgctgtcgaggacctggtgctgagaagagtctgttcacagccaaaattcttcccactgtcattcctaacctgggatttctagacacatcctgctgtgatgtaaacagaaatcacgaattcgctcactggatcaagttgttccactggtgtctaatacgctattgttgccggaggtgggttctgtgacgtgaagccatttcccatcattcaacagccagttacaattttctgtttaattaaattcatatttaaacaaaaaaaaaaga

SEQ ID NO: 36697 - DNA, 877 bp, Homo sapiens
ctttcaagtttttctttttaaactgatgaaagtgtcctgtttttaaaagctatgtttccttccacccaaactcacaggtacaagggatttaaaggcaactgttccatgaccttcattgatcagtttaaagcactacaccagtgtaacaagtattgcaaaatgctgggactgaaatcccttcaaaacaacaaccagaaacagaagcagccgagcattgggaaaagcaaagttcaaacaaactctatgacagtaaagaaggcagggcctgagaccccaggcgaaaagaaaacctaacgtccctgggtaacctaatggccactggctagcagcacacaatctcgccagggaaaatctgaggccacacaggagagaatatacagcctgcagagagtgcgtggcaatccttactcccagccgactgtgcgccaagatgcttctaaacccatcacctgctgtcttcactcaaatgatttcagaacaggatttgcgaccaggtttatggggagattgaatcaacgattggtctcaaagacagtccattctttatatacacgtttagcatttttaccaacctcacatcatgtgtatatttgtgtatttgcacatggttgtgctgtcgaggacctggtgctgagaagagtctgttcacagccaaaattcttcccactgtcattcctaacctgggatttctagacacatcctgctgtgatgtaaacagaaatcacgaattcgctcactggatcaagttgttccactggtgtctaatacgctattgttgccggaggtgggttctgtgacgtgaagccatttcccatcattcaacagccagttacaattttctgtttaattaaattcatatttaaacaaaaaaaaaaga

SEQ ID NO: 36698 - DNA, 4154 bp, Homo sapiens
agaatctgctgagcccccactaacccagagtgataaaagagagacttctcacaccacagcagcagcgactggtcggagttcccatgctgatgcaagagaatgtgctatttcaacccaggcagagcaagaagcaaaaacccttcaaacttcaacagactcagtctccaaagaaggcaacacaaattgcaagggagaaggcatgcaagttaatactctatttgaaacaagccaggttccagactggagtgatcctcctcaggtacaagttcaggaaacagtcagagagacaatctcttgcagccagatgccagctttctcagagcctgctggggaggagtccccattcactgggaccacaacaatttccttctcaaacttaggaggggtccacaaggaaaatgcatcattagctcaacactcggaggtcaaaccctgtacctgtggtccacagcaggaagaaaaacaagacagagatggcaacatacctgacaatttcagggaagacctaaaatatgagcagagcatctcagaagccaatgatgagactatgtccccaggtgtgttctcaaggcatctccccaaggatgctcgtgctgacttcagggagcctgtggctgtctctgttgcttcccctgaacccacagatactgccctcaccctggaaaatgtgtgtgatgagccaagggacagagaagcagtgtgtgcaatggagtgttttgaggctagtgaccaaggaacatgttttgataccatagattctcttgttgggacaccagttgataactattcgcctcaagaaatttgctctgtagatacggaactggcagaaggtcaaaacaaagtatctgatttatgttcttctaatgacaagacactggaagtcttttttcagacacaagtgtctgagacttcagtgtctacgtgcaaaagcagcaaggacggcaactcagtcatgtcccctctttttatcagtactttcaccttgaacatttcacacacagctagtgaaggtgccacaggagaaaatctagccaaggtggagaaatccacctacccactggcctccacagtacatgctggccaggagcagccaagccccagcaactcaggagggcttgatgaaacacagctcctttcttctgagaacaatcctttagtgcaatttaaagaaggaggtgacaagagccccagtcctagtgccgcagacaccacagccacaccagccagttatagttcaattgtgagttttccttgggagaagccaacaacattaactgctaataatgagtgctttcaagcgaccagagagactgttaccattgccaccgaagtccacccagccaaataccttgctgtgtcaattcctgaggacaagcatgcaggtggcactgaggagaggttccctcgtgcatcccatgaaaaggtttcccaatttccttcccaagtgcaggtggatcatattttaagtggtgctaccatcaaatctacaaaagagctactttgcagggcacccagtgtgccaggagtcccacaccatgtcctgcagctcccagagggagagggtttctgcagtaattcccctcttcaggttgataacctgtctggagataagagccagactgtggacagagcagactttaggagctatgaagagaatttccaagaaagaggaagtgaaacaaagcagggggtccagcagcagagcctgtcccagcagggttctctttctgcacctgatttccaacaaagtttgcctacgacatctgctgcacaagaggaaagaaacttggtgcccacggccccctcaccagcaagctctagggaaggagcagggcagcgctcaggttgggggacgagggtctccgtggtggctgaaactgctggggaagaagacagtcaggctctgagcaacgttccatctctctctgatatccttttggaagagtctaaagaatatagacctggaaattgggaggcaggcaacaagctgaagattataactctagaggcttccgcttctgaaatctggccaccacgacaactgacaaattctgagagcaaggcatcagacggtggtctcataattcctgacaaggtctgggctgtacctgatagtctaaaggcagatgctgttgtgcctgaattggccccctctgaaatagcagcattggctcacagtccagaggatgctgagtcagcccttgctgatagcagagaaagccataaaggcgaagagcccaccatcagtgtacactggagaagtctttcttcccggggtttcagccaaccgagactcctggagtcatccgtggaccctgtagatgaaaaggagttatctgtcacagattcactgtcagcggcttctgaaactggagggaaggaaaatgttaacaatgtgagtcaagaccaggaggaaaaacaactcaagatggatcacactgccttctttaaaaagtttctgacctgccctaaaatcctagagtcctctgtagatcccattgatgagataagtgtgatagagtacaccagggctggaaaaccagagccctctgaaaccacaccacagggcgccagagaaggaggtcaatcaaatgacggaaacatgggccacgaagcggaaatccagtcggccattttgcaagttccatgtctccagggaaccattctgagtgaaaatagaatcagcagaagccaagaaggcagtatgaagcaggaggcagaacaaattcaacctgaggaggcaaaaactgccatttggcaagtcctgcaacccagcgaaggcggtgaaagaattccaagtggatgtagcataggccaaatacaagaaagcagtgatgggagcttaggggaggctgagcaaagcaaaaaggacaaagcagaattgatttcccccacttcacctctttctagttgtcttccaataatgactcactcttctcttggggttgacacgcacaactccacaggccaaattcatgacgtccctgaaaatgacatagttgagcccagaaagcgtcagtatgtgtttcctgtttcacagaaaaggggaactattgagaatgagcgtgggaaacctttgccctcttctcctgatcttaccaggttcccttgtacttcatctcctgaaggaaatgtcacagactttttgataagccacaaaatggaggaacctaaaatagaggtgcttcaaattggggaaaccaaacccccaagctcatctagctcctcagcgaagaccttggcatttatttcaggagaacgtgagttagagaaagcccctaagttactgcaggatccatgtcaaaagggcaccctgggctgtgcgaaaaagtccagggagagagagaagtccctggaagcccgagcaggcaaatcgccagggaccctcacagcagtgacggggtcagaggaggtcaagaggaagccagaagccccaggcagtggacatttagctgagggagtaaagaagaaaattttgtccagggtggcagcactgaggctgaaactggaagaaaaggaaaatatcagaaagaactcagcctttcttaaaaagatgcccaaactcgaaacatcattatcacacacagaagagaaacaagacccaaaaaagccatcttgcaaaagagaaggaagaggtgaggctctgttgctgtccatcattgttaaagtttgggcttgtagaccaggtatccagttcctgtgtcctcgagggtcctttgcaattaaggccagtgtcccccaggtgggcattgatgctatggttgtggccaagtggcttcagcatgtggcatcagaatcacctggaggacttgttaaaacccagattgctcccctcccccagtgtgtgaaatttgcacttctaacaagttcccaggtgatctatcgggagaaccacgattgagaaccactgataaaggccgcctgtaggcatgtctgttggaggggaatgtgatgaaggtgcttttccgtttcattatcctcttttacaaaatctatttaaaaatataaacagaagcattaatcagtgtagctaattagtataatgaaatagaccatgcactaagcaggatttgtggaaatgaatattttggtacaaattgggattctcctctttaatcactgatttttcattaaaaataacttccttgaaaatt

SEQ ID NO: 36699 - DNA, 490 bp, Homo sapiens
ctccagtattactgaaaaaaatccaagctgagatgttccctgaacactctggaaatgtaaaattaagctgccaatttgcagaaattcatgaagattctactatctgctggacaaaagattcaaagtccatagcccaagtgcagagaaggtgcgatgtttttccctggttacttttcacagttgttgcttgtttatttcacaacatggttgtaaaaaagaaaaaagaataaattataggacgtgaaaaggaaaattgaagcagagattccacatccacaatattaaaaaagactaaatatcggaagacaagtgtctggatggggaaaatgatggaggattcttgcccaggttttgccagaattgagttctggggttttgggaagtcacacaacctttcactacattttttaaatcaggggaaggaacatgtcaaatgatattctagtctgaggttctgtggtcctaagattaaagagctctcatctgtatg

SEQ ID NO: 36700 - DNA, 579 bp, Homo sapiens
atgaagttgtgtcatttaggaaacatggtgtcttaagaaaacttggggaaaataatcagttgacatggtagcgatattcttccatcagttaaatgttgtttcctgatctggtgacattgttttcagagatcactactgtatgctgagtgtgtgccaaggaacataaatatgaatgttccatgtccacactaatgagactgaagggaatgtaaccagcacagcacacactggtggaggatgacggaggagctggcacacactcctggacaaacatagatgactgtggtcccattcagaaaaagaagggaagaggaacatggtacaggggactctgatccttagcctgtatcagatcctagaccacaatagttgggttaagcacagtagactcacagctaaaagcatatcttcttttgagaattgtctactcatgtccttagcccactttgaaagaaattatagatgatgcgaacaaatggaaacacatcccatggactcttgggccaggctgccaggatctgtcattttccatgtggctttggccagattacctgactgccctgttcctgtttcctgatc

SEQ ID NO: 36701 - DNA, 1763 bp, Homo sapiens
ctcttttttttttttaacattaatctcaatgcgctgggattacaggtgtgagccaccgcgcctggccgacatttaacaatcttttgatttacatttttatagccactctatcaagatttgactcatgctgagtgtgggtcctgggaacctgcatgaccagcagtctgatgggagcacccatgaccataatggctacactctagtcatgaattaacatttcattaaacccaaacgtctgcttcaattcttcctccagtgtgatgtacagtttccttgcagtgcccaagggctctagagctcatcccacccaaaccaaagaatgctggtcaagtgggaaggagtccctgttctcagctgtagagggtgtggggagcactccgagtgccgtatctcagaacatctaagaacagtctaggaaaacacactccatttgtggttctccagagaatcagcacttggaatcctttgccaccgcgtaccccaggctctgaatcctgactgcgagattacacctgccagttcaccatcgactgtgtcacacggctcagcacagctcccaggccaacccatcctgatttccatctacttctaaactgcatcactctactcctcacagcaacaactcaaattccctaatgactaatctgttcttaaaaaaaaaaaaaaaaaaaaaagagagagatggggtttcgcagtgttgcctaggctgatcttgaactcctgagctcaagcaatcctcttaccccagcctcccaaagtgttgggattacaggcgtgagccagcacacccagactaatctgctctgagtaacattttaccaagccagatttctgaaactttttttaaaaattaaaatcccatgcacacacaagttacaggcaagcttgaatgtacactggaaacgcagacctctgttgctttattactaatggtgacaactttcctacatccttttaccagcttctagaacaaggcacccatgaagagggcaacacacatcatgccccactgctccctgtgcaccggaagaagggcctgatcatcagggacagccgcctttcaagcctgacaatgatgtctgtccttgtaccattttcacatcctttgttatggcagacccgcaaaggaaggtttatacctaaatccctaatgacttctcagtccaagaaagtttctgtgtaaaaaagcagcagctttcctgcggtgaaggggaaggtcaaagagtcaccaacacataaaggatttcaaaaaggaaaatttacaatttctcatgcacactctacagccctgctggtgccctgggccaagtgctgtgctggaggcacttctaaaaggcaggattcccacatgatgaagtgccaggctctggagccagacagcctgggttcacatgcaggcaccactgtttaccagtcacttgacctaggcatgtcactctctgtgcctcagtttcagatgaaacaaggatagcagtatgtacatatcatgtggttctcacaaggactaaatgaaatactacattgttattatattattatatttctgctaaaaagttgggggcaggtgccgagcacggtggctcacgcctgtaatcccagcactttgggaggctgaggcgggcggatcacatgaagtcaggagttcgaggccagcctggccaacatggtgaaactccgactctactaaacatataaaaattatccaggcatggtggcacacacctgtaataccagctactcaggaggctgggacaggagaatca

SEQ ID NO: 36702 - DNA, 405 bp, Homo sapiens
ataccgtttcttgcaaaagcacacaggtagtaagtggcacagctgtgatctgaagctagtgactcactgttatcatgtaaggcagaagtgtgtaccccacatggggagagacgcacagggaggtccagtcatttggaggaagataaaaatttttccagcctgggcaacatggcaagaccacatcaccacaaaattattgggggcaggtgccgagcacggtggctcacgcctgtaatcccagcactttgggaggctgaggcgggcggatcacatgaagtcaggagttcgaggccagcctggccaacatggtgaaactccgactctactaaacatataaaaattatccaggcatggtggcacacacctgtaataccagctactcaggaggctgggacaggagaatca

SEQ ID NO: 36703 - DNA, 1024 bp, Homo sapiens
ggaggatcaaggacctttttgtgaacacacaaagtttgagatgccttggacacattgaagtggagcggtcagggaggcaagggtggaggtgggatgcggaggggaggtgggatgcagagcgtcgtggatggatcagttttgctcgatagagggacatgtttttctgtggcaacaggagggcaaaaggagaaggtggccacagatgccggtagatgagctgagagtgattgtattccctatcctctcggaagcttgaggcaaggccatcaacagacaatcagagggaataagaagagatagaatatatgaagaaagggagaaaagatgaaatcgtaattgtgtagcagggcaagaagtccagaaatttctgtgctgtgccaagttcccagttgaggcggtgaacatgaaaatatactgatacccattgcctggtttttctccaaggacacttggctcctagggcacaaaacagaaagtacgtggtttgtccaggccgagggctttgcatagttgcagtggatggagaggaggtcaaggaatggaggcacatggtagagagagactgtccccagagcacggggactcctggccggatgagggggacaggggcaggaggaggcaggtggaaagtagagggagggctcagtggtctggaggctacaggaagtgacggggggaccagaaggagctggaaaccagtgtggttgtggcccagggtgggatgtttggatttctgatgtcagagagggtccagtccttctgatgatggggaggggtggaggctgaatctatggtagagatagtgagaggaactggaacaatgtagctgtcaagtggaaatgggagaaagggctgggcgtggtggctcacgcctgtaatcccagcatattgggaggctgaggcaagaggatcgtgttagctcaggagttctgggctgcattgagctgtgattgtgccactgcactccagccttggcaacagagtgcccagttaaaaataaaaataaaataaaataaaaaaatta

SEQ ID NO: 36704 - DNA, 5139 bp, Homo sapiens
aggtcccagtaaccgccggttggaggcggccgaaccgcagtagggaaagacccaggctgcgggacgcggtgcaggctgcggcgctgacggcctctgctccttccgcgggtttccgactccctgccctagattttctgcttagcgacttggggtcccctctcgtttgcttctggtaggagtcgcaatcccagcagcaatagcccagaagaggacacggttcccgtaccgaagggttcagtaccagcagcccgaccatcacgcggcgggatgtctgtggttggcattgacctcggctttctcaactgctacattgctgtcgcgagaagtggcggcatcgagaccatcgccaatgagtacagcgacaggtgtaccccggcctgtatatcattgggatcaagaactcgagccattggaaatgcagcaaagagccagatagtcacgaacgtaagaaatacaattcatggcttcaaaaagcttcatgggcgatcatttgatgatcccattgtgcaaactgaaaggatcaggcttccctatgaactgcagaaaatgcctaatggaagtgcaggagttaaggtgcggtacttagaggaagagagaccttttgcaattgagcaagttactggaatgctgttagccaagcttaaagagacttcagaaaatgctttgaagaaaccagtggctgactgtgtgatttcaattcctagcttttttactgatgccgagagaagatctgtgatggctgcagcccaggttgcaggcttaaattgtttaaggttgatgaatgaaactactgcagttgcactggcgtatggaatttataaacaggatcttcccccattagatgagaaaccaagaaatgtagtatttattgatatgggacattctgcctatcaggtctcggtttgtgcttttaacaaaggaaaacttaaagtcttggctactacctttgatccatatttgggtggcaggaactttgatgaggctttagtagactacttctgtgatgagttcaagaccaaatataagataaatgtgaaagaaaactctcgggccttgttgcgtttatatcaggaatgtgaaaaactaaagaagctaatgagtgcaaatgcatcagatcttccattgaacattgagtgtttcatgaatgaccttgatgtttctagtaaaatgaacagggctcaatttgaacaactgtgtgcttcccttttggccagggttgaaccacctttaaaagcagtaatggaacaagctaacttacaacgtgaagacattagtagtatagaaattgtaggaggagcaacacgaattcctgcagtgaaagaacaaatcactaaattctttcttaaagacataagtaccacattaaatgctgatgaagctgttgcaagaggatgtgcgttacagtgtgcgattctctcaccagcatttaaagtgcgtgaattttccataacagaccttgttccctattcaatcacattaaggtggaagacctcttttgaagatggaagtggggaatgtgaagttttctgtaagaaccatcctgccccattctcaaaagtcattactttccacaagaaggaaccatttgaactagaagcattttatactaatttacatgaagtgccttatcctgatgcaagaattgggagcttcactattcagaatgtttttccacagtctgatggtgatagttccaaagtgaaggttaaagttcgtgttaacatccatggaatcttcagtgtggctagcgcatcagtaattgagaagcaaaatttggaaggcgatcacagtgatgctccaatggagacagaaacttcatttaaaaatgaaaacaaagataatatggataaaatgcaggttgatcaagaagaagggcatcaaaaatgtcatgctgaacacactccagaagaggaaattgatcatacaggagccaaaacaaagtcagctgtctcagacaaacaagaccgattaaatcagacacttaaaaaaggaaaagtcaaaagtattgatctaccgatccagagtagcctatgtagacaactaggccaagatcttctcaacagctacattgaaaatgaggggaagatgatcatgcaagataagttagagaaagaaagaaatgatgctaagaatgccgttgaagaatatgtatatgattttagagacaggctgggcactgtctatgaaaaattcatcactccagaagacttgagtaaactgtctgcagtattggaagacacagaaaattggctttatgaagacggagaggaccaacctaaacaagtttatgtggataagcttcaagaactaaagaaatacggccagcctattcaaatgaagtacatggagcatgaagagagaccaaaagccttaaatgacttgggaaaaaagatccaacttgtcatgaaagtgatagaagcttatagaaacaaggatgaaagatatgatcatctggatcctactgaaatggaaaaggttgaaaaatgtatcagtgatgccatgagttggctgaatagtaagatgaatgcacagaacaaactaagtctcactcaagatcctgtggtaaaagtttcagaaatagtagcaaagtcaaaggaactggataatttctgtaaccccatcatttacaagcccaaaccaaaagcagaagttcctgaagacaaaccaaaagctaatagtgaacacaatggcccaatggatggacagagtggaactgaaactaaatcagattcaacaaaagacagctcacagcatactaaatcctctggagagatggaagtggactaagtcttaattttaccttcacattaattcaaaccgtgcaagtaaccacggggtccatcttttacatctggtacacacaacagacgctcagttgttcttaaccacttttgtcatttgttttttggagtagttttgaaaagtgttttatattgagtgcacttctgttcatttccattgctgcttatatgcagtgttagccgaattagatttacaagacaatctaagctttccggataattttatatatcaaacatacaggatggatacatagttggcaacagtctaccttatttaaagcttctactgggataaacctcaattcctttattcaggaaaggatactttattgcattattgttgcagaagcatagatttaattgcatctttattttgaaaaacaaatgaaaattgatggggtttaaagctacagaggcactgacctttttctagttattgtattgctacaatttaaatattaaaacaaataagagctttctcaacaaattagtccatctcattgatgtaccacagaaatccaaagctttgctgtcatcacataaatgaattaaatcacatgtgaaagggaacacacccaattttatgttaaggtgaaaccagcagtttgcttcttttattagtaatgtggattgatgttttctcagagtaactcgttgtcttttcgcttgaaatttttgatcttgtcctgaagactagctgctgctaaaacaatgctagcctaaagatacaggagtctctgacaaaatgactttcatgttaaggggaaatgctgtttatctactcagacatgcatctgtgatgttcatagccttgtttcagttataatagttgtcttgtttttttcttaattgattttgttaataataccttaacacagggtaggaagaagtggcacagtgtattgcattatatacatttatcattgatttacctaatgttaccttgtagattaaacactattaagtggtaatacttgaaaaggagcacttataccataagtcttaggaaataatgtttgtaataaacttaactatgttacatatcaacaggcaaaaatatagaatgttacatagtgttgtgtgattaaattatagttcctgctgttaacattaccttttgaaaccttggctccagttttggtgcttcttatacaaattaaatgcgaaaagggactgtaaacttaagatgtattttaaggactttatctgtgcttcatcacccaacttgttcacattgttaatttctgtccagagacctgaaactgcttaagtatgggaacagactgaaatggtgtttcaacctgcaagagacagaagcatagacaagtatatgagcccttatgtccttaatgccaatcaactagattgacctaggttaaaatttcaaaaggctcattttctcccaaagctaaatctttatattaggaacaattaaatattgacttaagttgtaaaaattgagagtacaatatctttagggatagtcattatttctcacaactagttctctacgagagattttgtttctacaatgtagtcagcacttaatggagagtatggagtagtgcattttgcagggatttttattccgtcttttgaggggaagaatctcttttttgcattaaaaaatcatataaacttaatatatttttaaactctcctagtctttaaactttctcttaattctcttaaaatgaaataggtatatccaataggtgatgaaatacattttttacaaacatagatgctttttatttgtatgttgaatgtacagattcatttcaagaaaagcatgaagataatgaaagcaaatatgtaacaatacaagtagggactttagagcttctatttgggttaaaacatccactcacttggttaggagctatgcctcagaaacttcctgggagtaaatatgggaacaacttttctattaatacatctaaattttctagtatatcctgacattttccattcctgctctgaagtcacttttagttttgtgttttagtcagatagtaccactaatttttgtaattatataacacttcatttaataacttatatacatccaaatatatatactttttctacccaattattcaacttaaaagatttcaaaaacgatttagccttataatgtatttatttatttaattcattaatgaaagagagtgctctctttaatgcagctttgggtagacagtctaattcagtccaattttaatctgcattaaaatatgcaatgctagacaaagattttcaaaataaaaagctattatttcagaaattattttaaaagatgcatagtaaaacagtgttttcctatggtaagcaaata

SEQ ID NO: 36705 - DNA, 3979 bp, Homo sapiens
aggtcccagtaaccgccggttggaggcggccgaaccgcagtagggaaagacccaggctgcgggacgcggtgcaggctgcggcgctgacggcctctgctccttccgcgggtttccgactccctgccctagattttctgcttagcgacttggggtcccctctcgtttgcttctggtaggagtcgcaatcccagcagcaatagcccagaagaggacacggttcccgtaccgaagggttcagtaccagcagcccgaccatcacgcggcgggatgtctgtggttggcattgacctcggctttctcaactgctacattgctgtcgcgagaagtggcggcatcgagaccatcgccaatgagtacagcgacaggtgtaccccggcctgtatatcattgggatcaagaactcgagccattggaaatgcagcaaagagccagatagtcacgaacgtaagaaatacaattcatggcttcaaaaagcttcatgggcgatcatttgatgatcccattgtgcaaactgaaaggatcaggcttccctatgaactgcagaaaatgcctaatggaagtgcaggagttaaggtgcggtacttagaggaagagagaccttttgcaattgagcaagttactggaatgctgttagccaagcttaaagagacttcagaaaatgctttgaagaaaccagtggctgactgtgtgatttcaattcctagcttttttactgatgccgagagaagatctgtgatggctgcagcccaggttgcaggcttaaattgtttaaggttgatgaatgaaactactgcagttgcactggcgtatggaatttataaacaggatcttcccccattagatgagaaaccaagaaatgtagtatttattgatatgggacattctgcctatcaggtctcggtttgtgcttttaacaaaggaaaacttaaagtcttggctactacctttgatccatatttgggtggcaggaactttgatgaggctttagtagactacttctgtgatgagttcaagaccaaatataagataaatgtgaaagaaaactctcgggccttgttgcgtttatatcaggaatgtgaaaaactaaagaagctaatgagtgcaaatgcatcagatcttccattgaacattgagtgtttcatgaatgaccttgatgtttctagtaaaatgaacagggctcaatttgaacaactgtgtgcttcccttttggccagggttgaaccacctttaaaagcagtaatggaacaagctaacttacaacgtgaagacattagtagtatagaaattgtaggaggagcaacacgaattcctgcagtgaaagaacaaatcactaaattctttcttaaagacataagtaccacattaaatgctgatgaagctgttgcaagaggatgtgcgttacagtgtgcgattctctcaccagcatttaaagtgcgtgaattttccataacagaccttgttccctattcaatcacattaaggtggaagacctcttttgaagatggaagtggggaatgtgaagttttctgtaagaaccatcctgccccattctcaaaagtcattactttccacaagaaggaaccatttgaactagaagcattttatactaatttacatgaagtgccttatcctgatgcaagaattgggagcttcactattcagaatgtttttccacagtctgatggtgatagttccaaagtgaaggttaaagttcgtgttaacatccatggaatcttcagtgtggctagcgcatcagtaattgagaagcaaaatttggaaggcgatcacagtgatgctccaatggagacagaaacttcatttaaaaatgaaaacaaagataatatggataaaatgcaggttgatcaagaagaagggcatcaaaaatgtcatgctgaacacactccagaagaggaaattgatcatacaggagccaaaacaaagtcagctgtctcagacaaacaagaccgattaaatcagacacttaaaaaaggaaaagtcaaaagtattgatctaccgatccagagtagcctatgtagacaactaggccaagatcttctcaacagctacattgaaaatgaggggaagatgatcatgcaagataagttagagaaagaaagaaatgatgctaagaatgccgttgaagaatatgtatatgattttagagacaggctgggcactgtctatgaaaaattcatcactccagaagacttgagtaaactgtctgcagtattggaagacacagaaaattggctttatgaagacggagaggaccaacctaaacaagtttatgtggataagcttcaagaactaaagaaatacggccagcctattcaaatgaagtacatggagcatgaagagagaccaaaagccttaaatgacttgggaaaaaagatccaacttgtcatgaaagtgatagaagcttatagaaacaaggatgaaagatatgatcatctggatcctactgaaatggaaaaggttgaaaaatgtatcagtgatgccatgagttggctgaatagtaagatgaatgcacagaacaaactaagtctcactcaagatcctgtggtaaaagtttcagaaatagtagcaaagtcaaaggaactggataatttctgtaaccccatcatttacaagcccaaaccaaaagcagaagttcctgaagacaaaccaaaagctaatagtgaacacaatggcccaatggatggacagagtggaactgaaactaaatcagattcaacaaaagacagctcacagcatactaaatcctctggagagatggaagtggactaagtcttaattttaccttcacattaattcaaaccgtgcaagtaaccacggggtccatcttttacatctggtacacacaacagacgctcagttgttcttaaccacttttgtcatttgttttttggagtagttttgaaaagtgttttatattgagtgcacttctgttcatttccattgctgcttatatgcagtgttagccgaattagatttacaagacaatctaagctttccggataattttatatatcaaacatacaggatggatacatagttggcaacagtctaccttatttaaagcttctactgggataaacctcaattcctttattcaggaaaggatactttattgcattattgttgcagaagcatagatttaattgcatctttattttgaaaaacaaatgaaaattgatggggtttaaagctacagaggcactgacctttttctagttattgtattgctacaatttaaatattaaaacaaataagagctttctcaacaaattagtccatctcattgatgtaccacagaaatccaaagctttgctgtcatcacataaatgaattaaatcacatgtgaaagggaacacacccaattttatgttaaggtgaaaccagcagtttgcttcttttattagtaatgtggattgatgttttctcagagtaactcgttgtcttttcgcttgaaatttttgatcttgtcctgaagactagctgctgctaaaacaatgctagcctaaagatacaggagtctctgacaaaatgactttcatgttaaggggaaatgctgtttatctactcagacatgcatctgtgatgttcatagccttgtttcagttataatagttgtcttgtttttttcttaattgattttgttaataataccttaacacagggtaggaagaagtggcacagtgtattgcattatatacatttatcattgatttacctaatgttaccttgtagattaaacactattaagtggtaatacttgaaaaggagcacttataccataagtcttaggaaataatgtttgtaataaacttaactatgttacatatcaacaggcaaaaatatagaatgttacatagtgttgtgtgattaaattatagttcctgctgttaacattaccttttgaaaccttggctccagttttggtgcttcttatacaaattaaatgcgaaaagggactgta

SEQ ID NO: 36706 - DNA, 4746 bp, Homo sapiens
aggtcccagtaaccgccggttggaggcggccgaaccgcagtagggaaagacccaggctgcgggacgcggtgcaggctgcggcgctgacggcctctgctccttccgcgggtttccgactccctgccctagattttctgcttagcgacttggggtcccctctcgtttgcttctggtaggagtcgcaatcccagcagcaatagcccagaagaggacacggttcccgtaccgaagggttcagtaccagcagcccgaccatcacgcggcgggatgtctgtggttggcattgacctcggctttctcaactgctacattgctgtcgcgagaagtggcggcatcgagaccatcgccaatgagtacagcgacaggtgtaccccggcctgtatatcattgggatcaagaactcgagccattggaaatgcagcaaagagccagatagtcacgaacgtaagaaatacaattcatggcttcaaaaagcttcatgggcgatcatttgatgatcccattgtgcaaactgaaaggatcaggcttccctatgaactgcagaaaatgcctaatggaagtgcaggagttaaggtgcggtacttagaggaagagagaccttttgcaattgagcaagttactggaatgctgttagccaagcttaaagagacttcagaaaatgctttgaagaaaccagtggctgactgtgtgatttcaattcctagcttttttactgatgccgagagaagatctgtgatggctgcagcccaggttgcaggcttaaattgtttaaggttgatgaatgaaactactgcagttgcactggcgtatggaatttataaacaggatcttcccccattagatgagaaaccaagaaatgtagtatttattgatatgggacattctgcctatcaggtctcggtttgtgcttttaacaaaggaaaacttaaagtcttggctactacctttgatccatatttgggtggcaggaactttgatgaggctttagtagactacttctgtgatgagttcaagaccaaatataagataaatgtgaaagaaaactctcgggccttgttgcgtttatatcaggaatgtgaaaaactaaagaagctaatgagtgcaaatgcatcagatcttccattgaacattgagtgtttcatgaatgaccttgatgtttctagtaaaatgaacagggctcaatttgaacaactgtgtgcttcccttttggccagggttgaaccacctttaaaagcagtaatggaacaagctaacttacaacgtgaagacattagtagtatagaaattgtaggaggagcaacacgaattcctgcagtgaaagaacaaatcactaaattctttcttaaagacataagtaccacattaaatgctgatgaagctgttgcaagaggatgtgcgttacagtgtgcgattctctcaccagcatttaaagtgcgtgaattttccataacagaccttgttccctattcaatcacattaaggtggaagacctcttttgaagatggaagtggggaatgtgaagttttctgtaagaaccatcctgccccattctcaaaagtcattactttccacaagaaggaaccatttgaactagaagcattttatactaatttacatgaagtgccttatcctgatgcaagaattgggagcttcactattcagaatgtttttccacagtctgatggtgatagttccaaagtgaaggttaaagttcgtgttaacatccatggaatcttcagtgtggctagcgcatcagtaattgagaagcaaaatttggaaggcgatcacagtgatgctccaatggagacagaaacttcatttaaaaatgaaaacaaagataatatggataaaatgcaggttgatcaagaagaagggcatcaaaaatgtcatgctgaacacactccagaagaggaaattgatcatacaggagccaaaacaaagtcagctgtctcagacaaacaagaccgattaaatcagacacttaaaaaaggaaaagtcaaaagtattgatctaccgatccagagtagcctatgtagacaactaggccaagatcttctcaacagctacattgaaaatgaggggaagatgatcatgcaagataagttagagaaagaaagaaatgatgctaagaatgcccagaacaaactaagtctcactcaagatcctgtggtaaaagtttcagaaatagtagcaaagtcaaaggaactggataatttctgtaaccccatcatttacaagcccaaaccaaaagcagaagttcctgaagacaaaccaaaagctaatagtgaacacaatggcccaatggatggacagagtggaactgaaactaaatcagattcaacaaaagacagctcacagcatactaaatcctctggagagatggaagtggactaagtcttaattttaccttcacattaattcaaaccgtgcaagtaaccacggggtccatcttttacatctggtacacacaacagacgctcagttgttcttaaccacttttgtcatttgttttttggagtagttttgaaaagtgttttatattgagtgcacttctgttcatttccattgctgcttatatgcagtgttagccgaattagatttacaagacaatctaagctttccggataattttatatatcaaacatacaggatggatacatagttggcaacagtctaccttatttaaagcttctactgggataaacctcaattcctttattcaggaaaggatactttattgcattattgttgcagaagcatagatttaattgcatctttattttgaaaaacaaatgaaaattgatggggtttaaagctacagaggcactgacctttttctagttattgtattgctacaatttaaatattaaaacaaataagagctttctcaacaaattagtccatctcattgatgtaccacagaaatccaaagctttgctgtcatcacataaatgaattaaatcacatgtgaaagggaacacacccaattttatgttaaggtgaaaccagcagtttgcttcttttattagtaatgtggattgatgttttctcagagtaactcgttgtcttttcgcttgaaatttttgatcttgtcctgaagactagctgctgctaaaacaatgctagcctaaagatacaggagtctctgacaaaatgactttcatgttaaggggaaatgctgtttatctactcagacatgcatctgtgatgttcatagccttgtttcagttataatagttgtcttgtttttttcttaattgattttgttaataataccttaacacagggtaggaagaagtggcacagtgtattgcattatatacatttatcattgatttacctaatgttaccttgtagattaaacactattaagtggtaatacttgaaaaggagcacttataccataagtcttaggaaataatgtttgtaataaacttaactatgttacatatcaacaggcaaaaatatagaatgttacatagtgttgtgtgattaaattatagttcctgctgttaacattaccttttgaaaccttggctccagttttggtgcttcttatacaaattaaatgcgaaaagggactgtaaacttaagatgtattttaaggactttatctgtgcttcatcacccaacttgttcacattgttaatttctgtccagagacctgaaactgcttaagtatgggaacagactgaaatggtgtttcaacctgcaagagacagaagcatagacaagtatatgagcccttatgtccttaatgccaatcaactagattgacctaggttaaaatttcaaaaggctcattttctcccaaagctaaatctttatattaggaacaattaaatattgacttaagttgtaaaaattgagagtacaatatctttagggatagtcattatttctcacaactagttctctacgagagattttgtttctacaatgtagtcagcacttaatggagagtatggagtagtgcattttgcagggatttttattccgtcttttgaggggaagaatctcttttttgcattaaaaaatcatataaacttaatatatttttaaactctcctagtctttaaactttctcttaattctcttaaaatgaaataggtatatccaataggtgatgaaatacattttttacaaacatagatgctttttatttgtatgttgaatgtacagattcatttcaagaaaagcatgaagataatgaaagcaaatatgtaacaatacaagtagggactttagagcttctatttgggttaaaacatccactcacttggttaggagctatgcctcagaaacttcctgggagtaaatatgggaacaacttttctattaatacatctaaattttctagtatatcctgacattttccattcctgctctgaagtcacttttagttttgtgttttagtcagatagtaccactaatttttgtaattatataacacttcatttaataacttatatacatccaaatatatatactttttctacccaattattcaacttaaaagatttcaaaaacgatttagccttataatgtatttatttatttaattcattaatgaaagagagtgctctctttaatgcagctttgggtagacagtctaattcagtccaattttaatctgcattaaaatatgcaatgctagacaaagattttcaaaataaaaagctattatttcagaaattattttaaaagatgcatagtaaaacagtgttttcctatggtaagcaaata

SEQ ID NO: 36707 - DNA, 2474 bp, Homo sapiens
aggtcccagtaaccgccggttggaggcggccgaaccgcagtagggaaagacccaggctgcgggacgcggtgcaggctgcggcgctgacggcctctgctccttccgcgggtttccgactccctgccctagattttctgcttagcgacttggggtcccctctcgtttgcttctggtaggagtcgcaatcccagcagcaatagcccagaagaggacacggttcccgtaccgaagggttcagtaccagcagcccgaccatcacgcggcgggatgtctgtggttggcattgacctcggctttctcaactgctacattgctgtcgcgagaagtggcggcatcgagaccatcgccaatgagtacagcgacaggtgtaccccggcctgtatatcattgggatcaagaactcgagccattggaaatgcagcaaagagccagatagtcacgaacgtaagaaatacaattcatggcttcaaaaagcttcatgggcgatcatttgatgatcccattgtgcaaactgaaaggatcaggcttccctatgaactgcagaaaatgcctaatggaagtgcaggagttaaggtgcggtacttagaggaagagagaccttttgcaattgagcaagttactggaatgctgttagccaagcttaaagagacttcagaaaatgctttgaagaaaccagtggctgactgtgtgatttcaattcctagcttttttactgatgccgagagaagatctgtgatggctgcagcccaggttgcaggcttaaattgtttaaggttgatgaatgaaactactgcagttgcactggcgtatggaatttataaacaggatcttcccccattagatgagaaaccaagaaatgtagtatttattgatatgggacattctgcctatcaggtctcggtttgtgcttttaacaaaggaaaacttaaagtcttggctactacctttgatccatatttgggtggcaggaactttgatgaggctttagtagactacttctgtgatgagttcaagaccaaatataagataaatgtgaaagaaaactctcgggccttgttgcgtttatatcaggaatgtgaaaaactaaagaagctaatgagtgcaaatgcatcagatcttccattgaacattgagtgtttcatgaatgaccttgatgtttctagtaaaatgaacagggctcaatttgaacaactgtgtgcttcccttttggccagggttgaaccacctttaaaagcagtaatggaacaagctaacttacaacgtgaagacattagtagtatagaaattgtaggaggagcaacacgaattcctgcagtgaaagaacaaatcactaaattctttcttaaagacataagtaccacattaaatgctgatgaagctgttgcaagaggatgtgcgttacagtgtgcgattctctcaccagcatttaaagtgcgtgaattttccataacagaccttgttccctattcaatcacattaaggtggaagacctcttttgaagatggaagtggggaatgtgaagttttctgtaagaaccatcctgccccattctcaaaagtcattactttccacaagaaggaaccatttgaactagaagcattttatactaatttacatgaagtgccttatcctgatgcaagaattgggagcttcactattcagaatgtttttccacagtctgatggtgatagttccaaagtgaaggttaaagttcgtgttaacatccatggaatcttcagtgtggctagcgcatcagtaattgagaagcaaaatttggaaggcgatcacagtgatgctccaatggagacagaaacttcatttaaaaatgaaaacaaagataatatggataaaatgcaggttgatcaagaagaagggcatcaaaaatgtcatgctgaacacactccagaagaggaaattgatcatacaggagccaaaacaaagtcagctgtctcagacaaacaagaccgattaaatcagacacttaaaaaaggaaaagtcaaaagtattgatctaccgatccagagtagcctatgtagacaactaggccaagatcttctcaacagctacattgaaaatgaggtatgtaaatctgagttgatgctgaaataggtggtagtttattctgaaattttgtagaagtcaatgattatctccaaaatttagggcactagtttataactcctaaggaattatattaagtagattactaaactattttttacaaaatactgagctgttttaatgccatatgtactgtgtagctatcatcttagttgtgtgaaaaacatgtattgcctcctctatagagaaagacttttctgaaattgattcttccttttattctgtctttaacaatgacacccagcagaccacatatggggaaatattagctgctcccctcttctcctgtgttgtccttaaagattatatctctgttcaaaatgttttctgacatccattaaatatttttttaa

SEQ ID NO: 36708 - DNA, 2306 bp, Homo sapiens
agagagagagagagagagagagagagagagagagagagagagagagacttaaccacttttgtcatttgttttttggagtagttttgaaaagtgttttatattgagtgcacttctgttcatttccattgctgcttatatgcagtgttagccgaattagatttacaagacaatctaagctttccggataattttatatatcaaacatacaggatggatacatagttggcaacagtctaccttatttaaagcttctactgggataaacctcaattcctttattcaggaaaggatactttattgcattattgttgcagaagcatagatttaattgcatctttattttgaaaaacaaatgaaaattgatggggtttaaagctacagaggcactgacctttttctagttattgtattgctacaatttaaatattaaaacaaataagagctttctcaacaaattagtccatctcattgatgtaccacagaaatccaaagctttgctgtcatcacataaatgaattaaatcacatgtgaaagggaacacacccaattttatgttaaggtgaaaccagcagtttgcttcttttattagtaatgtggattgatgttttctcagagtaactcgttgtcttttcgcttgaaatttttgatcttgtcctgaagactagctgctgctaaaacaatgctagcctaaagatacaggagtctctgacaaaatgactttcatgttaaggggaaatgctgtttatctactcagacatgcatctgtgatgttcatagccttgtttcagttataatagttgtcttgtttttttcttaattgattttgttaataataccttaacacagggtaggaagaagtggcacagtgtattgcattatatacatttatcattgatttacctaatgttaccttgtagattaaacactattaagtggtaatacttgaaaaggagcacttataccataagtcttaggaaataatgtttgtaataaacttaactatgttacatatcaacaggcaaaaatatagaatgttacatagtgttgtgtgattaaattatagttcctgctgttaacattaccttttgaaaccttggctccagttttggtgcttcttatacaaattaaatgcgaaaagggactgtaaacttaagatgtattttaaggactttatctgtgcttcatcacccaacttgttcacattgttaatttctgtccagagacctgaaactgcttaagtatgggaacagactgaaatggtgtttcaacctgcaagagacagaagcatagacaagtatatgagcccttatgtccttaatgccaatcaactagattgacctaggttaaaatttcaaaaggctcattttctcccaaagctaaatctttatattaggaacaattaaatattgacttaagttgtaaaaattgagagtacaatatctttagggatagtcattatttctcacaactagttctctacgagagattttgtttctacaatgtagtcagcacttaatggagagtatggagtagtgcattttgcagggatttttattccgtcttttgaggggaagaatctcttttttgcattaaaaaatcatataaacttaatatatttttaaactctcctagtctttaaactttctcttaattctcttaaaatgaaataggtatatccaataggtgatgaaatacattttttacaaacatagatgctttttatttgtatgttgaatgtacagattcatttcaagaaaagcatgaagataatgaaagcaaatatgtaacaatacaagtagggactttagagcttctatttgggttaaaacatccactcacttggttaggagctatgcctcagaaacttcctgggagtaaatatgggaacaacttttctattaatacatctaaattttctagtatatcctgacattttccattcctgctctgaagtcacttttagttttgtgttttagtcagatagtaccactaatttttgtaattatataacacttcatttaataacttatatacatccaaatatatatactttttctacccaattattcaacttaaaagatttcaaaaacgatttagccttataatgtatttatttatttaattcattaatgaaagagagtgctctctttaatgcagctttgggtagacagtctaattcagtccaattttaatctgcattaaaatatgcaatgctagacaaagattttcaaaataaaaagctattatttcagaaattattttaaaagatgcatagtaaaacagtgttttcctatggtaagcaaata

SEQ ID NO: 36709 - DNA, 265 bp, Homo sapiens
tcctagcattgatgattttgagcaggttacttaagcttcctgagacttaataacaggtttgttatggtttataaaagataatctgggggaagtacctgccccatagtgatcaatcaggatatgatcataattattgccaagatgattatttgccaacatcttaaagatgatagccaaattattcaatgaattgaataagttaatctgaggctcacatactgattggagttcttttttccttaagggagcttcactattcagaatg

SEQ ID NO: 36710 - DNA, 183 bp, Homo sapiens
accccctggtgttttggtaacacaaatttggcagatgtattttctaaaataatctattgaatcaacacagctcatttcacaccaggagtagatcattttttaacaaccctttcctttatgtgataacattattgcagtaataactatgcaataataaataataatgaccattttattcatttg

SEQ ID NO: 36711 - DNA, 660 bp, Homo sapiens
gaagtttggaatatagtagaagttattaaattatgttgatttataacaaggtttcagaaaatgatgggatgagctttatttaacagataatgcacatttgttatatgcaaaagcatataatgctttgctgtcaggaataaaacctttgggatttatattgtggtagggcagctggacttgtgcacaaatacctgtactataatcacaaatatatctgtgagtcacaaatataccaaatattactgaatttaaaaggcagaaaatgcatttgattaggagaaaacctgagacagaactttaaaggcataaaagtggaattttagctagtctttgaagggattgataagatttttttttttaagttttggattgataggattttgattggcaaagattactgaaagagagcattcctgcctgagagattagcgtaagcaaaggcttggaggtgagaagcccaggagatgtggggaatggtgagttaggttttaatttttaaactatgacctatagtaagaaatacatgtcacacttctatctaatatatgcatgtatgaatgtttgtgtgtgggtaaaacaagaagtttcataatacagtaactgtccttaacagtggcaggtgcagttggatgttatctattttgtttgactaaaaaaaaa

SEQ ID NO: 36712 - DNA, 265 bp, Homo sapiens
ggacattttgaacgttcatttggacgtgtagtgttgtcttgtttttcatgtgtttgatgtgtcccagtgttgatttccattcatctggtggaacagttatctcttccaattttattgtataggttggatagggaaagattttactgatgtatgtgggtcttaggatgttggtttataggagtgtgttgacttttattgtagtttagtgcagcagtgtagtctccgtgtagtttcttcagctgtaatccatgctagtgatgttcgc

SEQ ID NO: 36713 - DNA, 240 bp, Homo sapiens
tacctttctcaatgtaatgaagtattttacagtcaatttgtgatgtaaatgttgctcttgtctttcctcacttacaaattactttgacattgaacagctgtgagacagacatattgagatgcctgccgttgttattattcattttatgctgtccaagatatcatttaatttagacttacaagtatttccttgtgattatattactctgtccttgttaataaagtgctgctgtgtttgact

SEQ ID NO: 36714 - DNA, 390 bp, Homo sapiens
caggaagatcacttgagcccagaagttcaaggctacagtgaacttgaaccactgcactccatccagcctagtcaacagagccagatcctgtctcaaaaaaaattataattaaaaacaaaagcaagatttggtaaattgagaaaggctggaacagaattgatattactgtagcactggaatctatgtttaattggggggtggggaaagatggtacacatagccaaaatattcagagctgcctaatgaacactttcttacattctggaagcaaagtgtttttaggaagtctgatccacaaagatttaaattatggaacacactgtcaaatggatgatatcttcttcaagcctcccttctcttgccaaatacttttccaatgtaaatcctgac

SEQ ID NO: 36715 - DNA, 437 bp, Homo sapiens
tttacatgaagtgaacaccaagtggccaatgggaaacctctagggggtatttggacccaagaagattctgtatctggggcccttgagcggctgctctggccactccaaccctgtggagtgtactttcattttcaataaagctctgcttttgttgtttcattctttccttgctttgtgcattttgtccaattctttcttcaaaatgccaagaacctggacaccctccaccggtaacaaatgcccatatttacatattagtttaagtttgctatttcagagagctgcgatgataggtacatcagtactgaaaaagcactactacttggttcttcagtagggaacattactgtttagaatgaatactactacatcaaatgaaatgatcctggttattttgaatcatggaagacatttttttaaaatgctcctagttaaaa

SEQ ID NO: 36716 - DNA, 462 bp, Homo sapiens
acctgctctatgttcttctctccttctttctccctctcttttttagtgaaagtgtctcactatgttgcccaggctggagtacagtggctattcacaggtgcaatcatagctcactgcagcctcaaattcctaggctcaagcaatcctcctgcctcagcctcctgattagctggggctatagacagtgcatccacatccaacatctatgttcttcctgaacttttattttgccttcctttggtttgattagtcatttatttactattcaattttcccctctgttagtgtggatggcatatactgtgacagccattctgcatgtttacagacattctggctgtctatcctgggcacaaggtcagactgcgtttcctaaccactcaagtaatgtgtggccatgtaactagctttgaccaataaaatgtgagtataagtgctatgtgtgtgtcacctccagatgga

SEQ ID NO: 36717 - DNA, 423 bp, Homo sapiens
tcttttcctgcgttaattctactagcacttgagtgttttgctgtggctatctgccccttatctcttgctctgttgagattaaagcctggaccacaggattaaaaaacattcttaaagttttaccacggaagcgaagcggccaacacaccttttcccctttgccttgttttcgcggagatgaagctccagccagtagctttgaagggccccattctcttcccattgaccagagagagagttcaggacagtatagacagcccagtggccaagggatgagttttgcaggtgtctgagtgaatgattaatcctccagctgtaagaggtgtcaggagaggctgggcgcggtggctcaagcctgtaatcccagcactttgggaggccaaggtgggtggatcacgaggtcaggagatcgagaccatcctg

SEQ ID NO: 36718 - DNA, 327 bp, Homo sapiens
gcatcagtgtacttttgatattaattctcattttttagaaaaaacttagaacttttttcataatcttagccagtttgattgcacataaaaattctttcacaagattcatttttcacaaatgttttacaactttcttatccattcaatttttgccctatattttcttatttttcatctcgaaacaactactctactttatgacaaaaattactctcttttgttgggtgtggtgcctcactcctgtaatcccagcactttgggaggctgagatcacttgaggtcaaaagtttgagaccagcctggccaacatggtgaaactccatttct

SEQ ID NO: 36719 - DNA, 725 bp, Homo sapiens
gcctaggctggtcttaaactctgaccttaagtgatcctcccgcctcagcctcccaaaatgctaggtttataggcataagccaccacacctggcccgctctacctttctgctcccaaaattgactccccctttcacaacagcaactcctcttctcacctgtagttccaagagaaaaaacatttctttattccttttgattgtcaaaaactatttcataccaactttttgaaatttaaaattgaatcaagcataatttttaagtgcaaatcaaggatatatagctgttactcaattttaatggggaaaagctttgttatgatagaatatctaatgtatttgatagtcattcatttcttatctatgcagggaactatccaggagcttaaaattttattgggagacagaatacatgagggggcctcaaaaccctcaaaaaaaaagttaaggtcagttaataagatttccatctaaaaattaaactagaaaaatctgcacatagtggagattagccatctgtaaaatgaaaccaaagaaccatccaggaggcaagattggaattggaagattcagaaaaggatgctgaaccaacttcattttaccctttctataaaaaacacttttttttttttaacagagaaggcaaatggttatcatggaacctaaaaaaggggaattaagagatcattactgggccaggagcggtggctcatgcctgtaatcctagc

SEQ ID NO: 36720 - DNA, 273 bp, Homo sapiens
tagaataaaaggacattcataaatatttttagaaagcccattagaagtgtttgaattattatgtgatttatataggataaaatccatgttttggttgtacacgtctgtaagtttggataaatgcatagtcatgtaaccaccaccaaaattaaaatttaaaacaattctggccaggtgtggtggctcacccttgtaatcccaacacttcgggaggccgaggtgggtagattatgaggtcaagagatcgagaccattctggccaacatggagaaa

SEQ ID NO: 36721 - DNA, 1611 bp, Homo sapiens
  misc_feature (1602)..(1611): n is a, c, g, or t
ctagtagctacctcacagggcagttgttgaaaataagctaatgctcctaaaaccctgagaacagtgctctgtgtatgataagtgttcatagacgtcacattatttatttattttgaaaattcttcttttagtcaaacttataagttttctgtggctcaaaatattctcaaccagggtttctttagtggccatcagctcccagggggtgatatcatggaagctgttatgcttaggaatttgtttaaaaagacgtcctgccctgtgccccagtacatttcaacaccacccagccacacagccgccttctggcccaacactcttaaagacacagtgcttgggaaatgtcctcatgcccctttcctgaggcaggtttgccactgtttccccaggcctggcagtcacagatggcagtcactgacctgctgtgatttgagagatggagagaaaaccttccactcttcttattctccctaatagcctcagtctctgccttcagttccacatttccctttggcgtaagctatgattgtcgtccaaggcccctcctagataggcaaggactcatgataccaagagtgtgatcaggggatagagatgagatgtctgggttggatgcgggagtggggtattttctaactaatggggtgcaaggggtacctgagcatgctctcaaaatgtgttataccctaaaaaatgtttttaaggtagtgtgttgatataacagttgttaagaccatgatgctagaggcaagatcgtgagatccatagagaaggtagttgaagggtagggccttttattcacatatatgctgccttctccaccaactgatgtgatatccttttatattcgtgactccagtgaacccacgcctctgaggatttacacccttgtatttgtactcctcttgagtctgggctggcctgtgactttaatcagtgcaatgcagaagtggttcagtgccagttctaagactacaaagagaaagaaaagttcaaccttccaatatcccagcagacatcaggccccagctgtgtcaccagcttcacgcccacgagtgaccacaacaaacccagcagaaccaaccagcgcatcccagccctggttgcagaatcatgagtaaataaaatggttgctgttctaagccatcgtgctttggagtggtttcttatatgtcagtagatgactgaaacaaccaaagccacagcctccgcctcccccagccccattcccccactcctccccacttgctaacctccatgaagccctgggacttgggcagctgaaggtgcagaaaagatgccaaatgaaaaagccaccctccttgacaacaacccagctgaggggagcaggcagagaggggcggttgaaggaagcacgctgcctggtgtttgaaagcatatgaggggctgccctgagcgcatctccttacattcttgtctcaagaccacccagcaggcatggcccctccaggtaaccttgcactctcctcccggacccctccccagtccccagacaaacccacctctccctcctggactctccatgggtcccttctccccacctgccactgggatcaggaagaataaagacctgaactcacnnnnnnnnnn

SEQ ID NO: 36722 - DNA, 658 bp, Homo sapiens
agtggtcaagagaatgcagtgggaatgacgcagtgcaacttcttggatgtagcttgtacctgcaaccccacaaggttccttgtgaagcttgaggtgtaaggtctaccctgaggagaaggagggcacagattctgaaagagggccttttaaaatgaaggacttattttccctgatgcatgctgtattacattttctgacatgatgaagggactgggcttgagaccatttagttatagaaacataatgttgcacattttttttgtatgcctgaggtcgtggccactacaataaatactatttacaaaattttgaatttttcagcttacgtgacaattttcgattctgcagaactccactgacatagttagagctcaatatcaggtttcctgaatcaaagttaaatgcatttaaaaaattctgtttataggagcacttcccaagagggcaaatgggaggtatatcttggccctttgtgctctcagattattttttcaaaacctgccttgagaatgctgaggaaggccttgacatttagctgctccaaattatcccattgttgttctggacacttacttgctagtaatattggagagatcagtgctgtggtttctgctgcaaacacttagaatatggtatcatcctcaaagttaaaaaaaaa

SEQ ID NO: 36723 - DNA, 143 bp, Homo sapiens
atttgaaatacatctatcacctagatattgagatatattatacatttaatatagtgtgttgctggtatagggatagacaaatgaacattggatcagaatagcactgaaacaagatctacccctatatgggcatgtccctatta

SEQ ID NO: 36724 - DNA, 295 bp, Homo sapiens
tgacatgtggctttttattatacaaattgcaacattacaacataaacaaaacatcaagataatatggctcaaagaaaaaaaagaatatccagaaatcaattattaaaaaaaggagatgtaaaaattatgtgagacaatttgaattaaagtcttgatctattttttaaaagaaaaaaataaattaccctagaaaatcaaaattacatctcaatgatgctcaatgagtaaaatggaaattaaaaaaacaaaatgaaataacaaaaatgaaaccaacaaaaagataaaaagcacagaa

SEQ ID NO: 36725 - DNA, 350 bp, Homo sapiens
ttaatgaaaatctgtattaatttgatggatgcattgtattcacacattttgaattttgtgtattatttaaaacaaaaactaggttttattttccaaatctgaggttttgtgaatttattttatactaagtatatgaaattaactcatggtaaggctgttaaagaaaagtgatttagatcaggaaggtacagctcaatatactattatgcataaatatgtatagtaaaatgaatattgtccttagtcacaagtaatataagaagaaaatcaactcttggataaatgaagaataagaaataagatacaaagtctaggtttgataatatttagataatattcaggcaatatcc

SEQ ID NO: 36726 - DNA, 370 bp, Homo sapiens
aattattttcaatacatcaaaattattatttcatgaattgcagtttagctaagtttaagaatcaatgaattgaataaaaaattaaataaaaacagtacaggtgtaaagagcaaatacaattttaaaataagagactgacttctccctgttgaaaataagaaaaataaagaaagagatacctccttccttttcttagagcactttagagatttcctaattgtaattgtttttctctgtctctttgaaatgtatgtaaatctctttaaaagctaaagaagtcttttccagctttatgaccagggaatgtcttttcttatggaacctggggactcatccttttggggattatcgttttacagggaagatggct

SEQ ID NO: 36727 - DNA, 210 bp, Homo sapiens
ctgacgtttttactgcctcttcaaaagtagtaagacttacattcaaaggatatttatggttaaaatgtagtaaaagttagccaatagaaattagaaattcatagaatcagcccaagtaattagatcttatttacttattctttcagttattcccatggtcaaggcacagaagaggtggggtgggtataattatagtttgaataagaagtt

SEQ ID NO: 36728 - DNA, 422 bp, Homo sapiens
tttatttttttttattctgatctagtgccagcaggggggaaaaatagtaatctcctcggagccattgtcattgctgaggaccaagaacagcaaaaaagctgtctgcacagaaatgctaaaccccaaaataagaaacataggacatttctgcaacccaaattctcacaaatgcaccagtctatccctagatcaaggaaataactgaaaatctgaaaggtatccagctgaaattcaaggacagttcttcactgtagctgagctgccctccagctttgaaagaaccttgtgtgaagacgtgactctgaccagtctccccaaacagctgaagagcagaacacaaaccatgaagtgtctacactgagtccattttccaagaggtatatgaaaagattttaaggtcaacacagaaaataaacctaccc

SEQ ID NO: 36729 - DNA, 459 bp, Homo sapiens
cctttagcatgacgtctctcaacttcagtttcctcatgggtagattgagggattgaataagataagtggtggcaatcacaaatcttcacaaggtttacccggatgagacaggcatcataaatgagcaaagaagactgggggcagtggttgggtagtaggtgtgtggaggtatgggggatagcacaggtgaaactaaatgcaaggcaacgttagtcctgcgtcagggagatattagggagtagaaggacctggagagaaaatgcctcatccaatgagagccagacttactcagttccagttaattgttatgtaagaatgagggcccagtgttatcagaactttcaatgttttgagagaatcctaaagttcagatttttatgtgaaatctattctagtgttaaaacatcagcaatttggccgggcgcagtggctcacgcctgtcatcccagcactttggag

SEQ ID NO: 36730 - DNA, 423 bp, Homo sapiens
tccatccctccatcctccattcctccatccctccatgcctctgtccctgcatccctccgtccctccatccctccgtccctccatccctccatccctccacccctccattctccattcctccacccctccattctccattcctccatcctccatccctccgtccctccatctctccatcccttcatcctccattctccatcctccatccctccatctctccatccctccattttctatcctgccatctctccatccctccatctctccatccctccattctccctccctcctccatcctccattctccttccatctctccatccctccattctccatccctccattctccatccctccgtctctccatccctccatctgtccatccctccatcctccttccctctattcctccatcctccatcc

SEQ ID NO: 36731 - DNA, 248 bp, Homo sapiens
ggagggatcttcttcagcagcccccgcccgccccgcccctgcgcccgtggaccgcgggctccaagccccagttccctaagcccaggcgccggcgatccagatctgcctggaggggaggggaggacggtggatcggagcccccgcaccctcgccccagcccatcacccgccttcctgtccctctccttgctaactctccggggccctgccggccgcgggcggagctccctccgcggcgctcggcgagcc

SEQ ID NO: 36732 - DNA, 370 bp, Homo sapiens
gacagatttactctgaagattcaatgaaaaaacatccacaaacaacttttctacaagaaacaaaacattttaaagaaaacatttacttcagccgggcgcggtggcttacgcctgtaatcccagcactttgggagggcgaggcgggtgcatcacgaggtcagaagttcgaaaccagactggccagtatggtgaaactgtgtctctactaaaaatacaaaaattagcctggcgtggtggtgtgtgcctgtgatcccagctactcaggaggctgaggcaggagaatcgcttgaacctgggaggcagaggttgcagtgagctgagatcaggccattgtgctccagcctgggcaacagagcgagactccgactca

SEQ ID NO: 36733 - DNA, 269 bp, Homo sapiens
acgccaatttttttacttgtagaggcaaggtctcactatgttgcccaggctcctggactcaagcaatcctcctgccttggcctcccaaagcactgggattacagacatgagccactgcacctgacctatttttagttttttgggaaacctccatactgctctccacagtggttgtacatttacattcctcccagtagtgtgtgagggttcccctagagattattttattttatttttatttatttattttttgagacagagtctcgctc

SEQ ID NO: 36734 - DNA, 834 bp, Homo sapiens
acagttctctaccgagagagtgtcttcaagctctgccccaagcttacctacttggatggctataccgagaggaccaggaagcacctgtactcagatgccgaggtggatggtgtggatgaagaggaggaggacgaagaaggagaagatgaggaagacgaggacgaagggggtcgatacacacagtgttctcactgtgcggggtctcacagtctagttgatcagacacgagtcgacaaagatacacggggttttgtgggttctctgagagcctgatgaactactttagaggtgaaagctgaattacaagtggcagcttagccatgcaaagatctgggtgagcaggcagcaagaacaacaagtgcaaaggccctgaagtggcggtgagcacggtgagtggaggagcagcaggggaggccggtgagggtggagtggaagatttgaaggcaagaacaagaggaaggaagctttggtctcaaaaggctttggaggtgagggcactgggataaattatctagcctttgtcagctctaccgagcccagaatgttcttcattcattcatacgttcattcgtaaacactggttgaacaactgtttaatgagcacctactttacattgggggtacaacagagaacaaaatagacaagaatccctgtcctcatggagtggatatgctagttgagggggcagatgattaaaagacaaaatacaggccaggcgaggtggctcatgcctgtaatcccagcagttgggaaggccaaagtgggaggatcgctggaggccaggagttcaagaccaacctcggcaacatagtgagaccctgtctttacaggaa

SEQ ID NO: 36735 - DNA, 172 bp, Homo sapiens
tttctcgtaggcattccttctgcgttgaacgcatattcactattctagctgaagggtataatatacagccacgaagggggtcgatacacacagtgttctcactgtgcggggtctcacagtctagttgatcagacacgagtcgacaaagatacacggggttttgtgggttctc

SEQ ID NO: 36736 - DNA, 354 bp, Homo sapiens
gtgagttcactctctcttcttgagctgggacgtcgttttctcctgcccttggacatcggtgctcctggttctaggaccttcatattcagactgggacttacactgttggccccatggtttccatcaaagtctcctcagcctttgggcttagactgagctacgccactggctttcctggggctccagcttggagaaggcaggtcatgggacttctcagcctcccctaattatgggagctaatccctcgtaataaatctcttgctatctctctattgtttctgtttttctagagaactctgactaatacagggatccaaattgcttcagtcttgtggcaccttcatttcaataagc

SEQ ID NO: 36737 - DNA, 374 bp, Homo sapiens
ttcctctccttggctgttgagtcttgggtttccacttgttaaggctgggcttggttaactcctctgattctcctcgcatcaagaagacagtttcttactgtagcaagctgcacccaccatgagccacatgggaagggctgagaaaggccacttttgacagcctcctattgaagcatgcagcaaagggagacagggaggaatagattcagacggaattgccttaaactcctccatgcatatttatatttgaaaaaaagtgcttgggaactaaaagtcaagaaacctattttctactataaaattttatttattttctgtgactttaggtaagtcagcaatccctttaaatgaaaaatgtttaatagaattaaaaa

SEQ ID NO: 36738 - DNA, 681 bp, Homo sapiens
gtcctaattattagtatctataacacctttgttgtctttcttatattttttctaattcacattaaaacaagtgtataactattaaaatacaaaatgtttgcacaccacctaacactttgtgtagcactggtggcacacaccccacactgggggaagttgtggactacgtgagcttcagttctttcgcacagtgttgaattcatgcttgtgaacacctacagagctgggaactgaggatgcggcagaaaataagcagaagtctctaggctggtgtgggagagtacacagatcatggcagtacaaatgactgcgatttatgatgggtgccacaaaggaaaagtataagagttgcgaacctatggatataaaaaacatgaaacaggcccagtagctcccgcctgtaatcccagcactttgggaggccaaggtgggtggattgcttgagccaaggaatccgagaccagcctgagcaacatagttagacccctgtctctaaaaaaaaaaaaaaaaaaaaaatacaaaaattagccaggcatggtggcatactcctgtagtcccaactactcaggagggtaaggtggtaggatcgcttgagccctggaggttgaagctgcagtgagccgtaattgcaccactgccctccagcctggcagcctgggtgacagagcaggatcctgtctg

SEQ ID NO: 36739 - DNA, 865 bp, Homo sapiens
taaaatttcgtggtccaccactaggaagtattaactcctgtgaagaacaaaataaaccaaaagtattaatttccatttttaactagtttagatggttttcccttgggcttaaaatggaaagcttttactgtgtgtatgtgtgtgtgtgcgcgtgcatgtgtgtgtatctgtatctatatcatacagcatatcaaagaaaatatttcttccttcctactctccattatgattactttttctctatttctctgtccatctactagaaaatggtgttgctagaaatggaaaagggatcacagtaagtcggatagtgaacgtctctgttcaatcccagggtcacagagacaagcgctattttcccttttctcccacacaaggtaatttaaaattgcactcattttgtgatttctcttgaaacatacacacaaccaaaggcctgactgagactgtctgtcaggacaatctggaatttagcaatgccagccaggctcaaatgactgcctgacccactgggaccctggatcaagtgatgtgccagagggcatggatggaatatgatattaaggcagcctattgattctctagattacctccttgagaaactaattatatttaatctttataagtgaagatttttgtattttaaaatctactttttttgtcaacataaaaatattagttttgatcctcagaagctcttgtctctgattttaaagagatattacttagttccccatcttttatggtatcagtaagttagtggaaatagtggtgaataaatcccacagaaaatagttagagaaaatcaaacataagcttcactgcagacataggggtgcctattcttcttcagtcaaaaaaaaaa

SEQ ID NO: 36740 - DNA, 419 bp, Homo sapiens
ttttattagagattgtaaaggttataacatcactttggtgtttcgtagtcaagttttaacataaggatgtgcctgaaaaatcatttgtaattagagaatgggaagattcttgggttgcatttttgtcagcaaattgcagaggatcattattctgctctagagttgcaccgtccagttcagaagccactagccacatgtggctgttgagtacttgaaatgtattgatatgtgcaataagtgtagaagacatattggattttagagatccagtatggaaaatacaaagtatttcattagttttattcatcaaatattaaacaaatattggtttttatatggaaaaaatacttaaaattaattttgaattcttttgaaatacttttgatattgggttaaataaaatgtattttgggctgtgc

SEQ ID NO: 36741 - DNA, 395 bp, Homo sapiens
ttttttgatacagagttccgctcttgttgcctagcctggagtgcaatggcgccatctcggctcactgcaatctccgcctcccgggttcaagtgattctcctgtctcagcctcctgagtagctgagattacaggcacctgccaccatgcccagctaatttttgtgttttagtagagatggggtttcaccatgttaaggtgggaattctcaaagcatggtccctgtaccagcaacatcagcatcacctgggaacttgttagaaatgcagactttggctgggcacagtggatcacaaatcctgtaatcccaaaactgagggaggctgaggtgggaggatcttctgagcctaggagttactggacaacatggcaagaccgtatctctaccccccaccaa

SEQ ID NO: 36742 - DNA, 540 bp, Homo sapiens
tttggaaatcagagtttttgtttgtttgtttgtttcaatttgagagcaggtactgcttattaaccaaccagcttagaaaaataatcatggtagacaccttagttcactcttctaataagcctgttgatctggtcctccctgttgccagcatctccaccttctgcaaaatgggtggccttcattccatctcatggagaagataatttgaatggccgcaggaagttattttctttgaagtgttttccaacagtatagatctcatgaatcagatctccatgcagatgatgtcatatttatcaagagatcgagcaatcaaagcgttatctgtcaaagcatttcgcttcttattgattttgccataaccatgcttgcagattagttcatttactgacttcagatttgagtacccccatgcaatgtatgggtctacaatcctcagcatgttaattgaagcctttctgagtttcacaaagattccattgaagatttgataaaggcgtagaagctgcaacacctttcggacatttgggctcacaccat

SEQ ID NO: 36743 - DNA, 441 bp, Homo sapiens
tgagacagagtctcgctctgttgcccaggctggagtgcagtggcgcaatctcggctcactgcaacctctgcctcctgggttcacgccattctcctgcctcagcctcccgagtagctgggactacaggcgcccacgacattttttgtatttgtactagagacggggtttcaccatgttagccaggttggtttcgatctcctgacctcgtgatccacccgccttggcctcccaaagtgttgggattacaggagtgagccaccgtgctcagccttgaatttcttttttaaatctccccaccctgccaggaaaaaaaaaaacctccctgatattctgactgagattgtaaattgaatttacagtgtgattttgggaaaactgacatccaagaacaaaatatggctctccacttattcttctatcgctctcagaattttagttttc

SEQ ID NO: 36744 - DNA, 132 bp, Homo sapiens
caaacatgttgttaatattattacatacatatttaagtacttacaaaagatcatcaagatatgcaacttttttaattgttctgaaacaaaatggacaaagcagctaacattctggcattatttcctgcctga

SEQ ID NO: 36745 - DNA, 409 bp, Homo sapiens
ctacaggcgcccgccaccacgccctgctaattttttgtatttttagtagaggcgggatttcactgtgttagccaggatggtctcgatctcctgacctcgtgatccacctgccttggcctcccaaagtgctgggattatagccgtgagccaccgcgcccagcacatgatacaagattttatctctcttcctttcctctgcttccctgctcttgacaccctcatctccccaagactcctccctacccctgtcatgggggagggaattcaaacttcatttgcagataagtgaccatctgtccttccaaaggtttatggagaaaaggaagaattgtatagcctcctgggaagacagattaatccagattagctctaggcaaaggaatcagcctattcaagataacaccattta

SEQ ID NO: 36746 - DNA, 1684 bp, Homo sapiens
agcctcaacctgacactcagcagcaagttaggcctatctacaaatctcctgctctgtgcccgcgcagtccagtggaggagatattcctaattagggggcacttccaaggggcggagtctccgcggcgagtggccgtggaggggcgcaaggcagacggtctccagccacgatacctgggccaatcccagcctgtcacgtcatgcctagtgagctgaacaagctgcgtaactgtcgtgtgcctcagtttccccacgtgtataatggaaatgattacaataaacaggacctttttgaggagttgccatgaggactgtcagacgccaaggcgccccgagaggcacttcgcttccatgccgaggccaagggcgcacaggtgcgtctggacacgcgtggctgcatcgcgcacaggcgcaccacgttccacgacggcatcgtgttcagccagcggccggtgcgcctgggcgagcgtgtggcgctgcgagtgctgcgggaggagagcggctggtgcggcggcctccgcgtgggcttcacgcgcctggaccccgcgtgcgtgtccgtgcccagcctgccgcccttcctgtgccccgacctggaggagcagagcccgacgtgggcggccgtgctgcctgagggctgcgcgctcactggggacttggtccgcttctgggtggaccgccgcggctgcctcttcgccaaggtcaacgccggctgccggctcctgctgcgtgagggcgtgcccgtcggcgccccgctctgggccgtgatggacgtgtatgggaccactaaggccatcgagctgctggatcccacagccagccggctcccaacacccatgccatgggacctcagcaacaaggctgtgcctgagcccaaagccacaccaggagaggagtgtgccatctgcttctatcacgctgccaacacccgccttgtgccctgcggccacacatacttctgcagatactgtgcctggcgggtcttcagcgatacggccaagtgccctgtgtgccgctggcagatagaggcggtagcccctgcgcagggccctcctgctctgagggttgaggaaggctcatgaaaggaggcttcccagtatgagtggcagcccgggcctagatctgagtctggcccctgcagagaggaaggaggcgcagccctaccttctttctggggaagagtcagaaaggctgattagcaagaggtgcggcagagagaggaaggcagggaggtgctgtctgctgcctccacctgttccccaacaggatagcaaggaaaaacccctctttctgtccatgccagaactatccttctgatggggtgctttgtttagagatggggtggcccaatccccaatcagttttacatctgagggagttcaggtatctgttgtgactggtgaagccctgtacctcctgggtattgaagaacctggacttgaagcaggaggtatctgcaaggaatgtataaagttccacatggaagctgggttgcctcccacaagtccccagtagagtggatctgtagttacccgccctgcctccctttcagggtggtcatgaggtcccagagagaccatgcatctgaagatgatttaaaacatgaaagtgtattgttgtcactgtggtaatttccttgccagtttctgagatatcaaaataaagtttgtgtttcctgaatgattttg

SEQ ID NO: 36747 - DNA, 1718 bp, Homo sapiens
  misc_feature (80)..(80): n is a, c, g, or t
ggccttctccaggcagttccttctagacctggggacctgtgcccgaggaccttagactgatgggtgcccagctctgcttngaggccatacagaaggggtttcaccatgttagccaggttggtcgcgatctcctgacctcgtgatccacccgcctcggcctcccaaagtgctgggattacaggcgtgagccaccgcacccggccttgaggacctggtctttcagcaccagctattggggttgtgcatctctggacctaccctcccagacgccaaggcgccccgagaggcacttcgcttccatgccgaggccaagggcgcacaggtgcgtctggacacgcgtggctgcatcgcgcacaggcgcaccacgttccacgacggcatcgtgttcagccagcggccggtgcgcctgggcgagcgtgtggcgctgcgagtgctgcgggaggagagcggctggtgcggcggcctccgcgtgggcttcacgcgcctggaccccgcgtgcgtgtccgtgcccagcctgccgcccttcctgtgccccgacctggaggagcagagcccgacgtgggcggccgtgctgcctgagggctgcgcgctcactggggacttggtccgcttctgggtggaccgccgcggctgcctcttcgccaaggtcaacgccggctgccggctcctgctgcgtgagggcgtgcccgtcggcgccccgctctgggccgtgatggacgtgtatgggaccactaaggccatcgagctgctggatcccacagccagccggctcccaacacccatgccatgggacctcagcaacaaggctgtgcctgagcccaaaggctttgggccaaaagatttggctctgcctactggaaacctaaaagcaacctggcatctctgccttcgagagcatttgcctactctccacaccaggagaggagtgtgccatctgcttctatcacgctgccaacacccgccttgtgccctgcggccacacatacttctgcagatactgtgcctggcgggtcttcagcgatacggccaagtgccctgtgtgccgctggcagatagaggcggtagcccctgcgcagggccctcctgctctgagggttgaggaaggctcatgaaaggaggcttcccagtatgagtggcagcccgggcctagatctgagtctggcccctgcagagaggaaggaggcgcagccctaccttctttctggggaagagtcagaaaggctgattagcaagaggtgcggcagagagaggaaggcagggaggtgctgtctgctgcctccacctgttccccaacaggatagcaaggaaaaacccctctttctgtccatgccagaactatccttctgatggggtgctttgtttagagatggggtggcccaatccccaatcagttttacatctgagggagttcaggtatctgttgtgactggtgaagccctgtacctcctgggtattgaagaacctggacttgaagcaggaggtatctgcaaggaatgtataaagttccacatggaagctgggttgcctcccacaagtccccagtagagtggatctgtagttacccgccctgcctccctttcagggtggtcatgaggtcccagagagaccatgcatctgaagatgatttaaaacatgaaagtgtattgttgtcactgtggtaatttccttgccagtttctgagatatcaaaataaagtttgtgtttcctgaatgattttg

SEQ ID NO: 36748 - DNA, 1158 bp, Homo sapiens
ctggactcagtgacttcagacacagaagtctgtccatggctccttatcacatccgcaaataccaggagagcgaccgcaagtcggtcgtgggcttgctctccggggggatggccgaacacgccccagccaccttccggcgattactgaagctgcctcgaaccctcatactcttacttgggggggcccttgccctactcctggtctctggctcctggattctggccctcgtgttcagcctcagcctccttcctgccctgtggttccttgccaaaaaaccctggacgcggtatgtagacatagcattgcgcacagacatgtctgacatcaccaaatcctacctgagtgagtgtggctcctgcttctgggtggctgaatctgaagagaaggtggtgggcacagtaggagctctgcccgttgatgatcccaccttgagggagaagcggttgcagctgtttcatctctctgtggacaatgagcaccgtggtcaggggatagcaaaagccctggtcaggactgtcctccagtttgcccgggaccagggctacagtgaagttgtcctggacaccagcaacatccagctctctgccatgggcctctaccagagcttgggcttcaagaagacgggccagtccttcttccacgtgtgggccaggctggtggatcttcatacagttcatttcatctatcacctcccttctgctcaggcagggcgtctatgatttctttccttctgtattggtcagaatagaatccattcggctgtagcagcaagcaatccccaacctctgactgcaatgacctttctgtgcaataaaagcttattgtccattaacatctgagtcccatgcgattgcctgtggggtagcttctgggtttctgcttcattcagtctttttgattcccatctgtttcatttttatggtctgggtgctgcttcccgacgtcaccgggatccctgggtgtttctctcctttccctggaagcctttctttcacccacaaggcaccgggaagcctttgtgctactgttcctcctgcgtgtgtccgtttggacctctgaatcatttccttcttgctgataggcttgttcttctggacagccaggaagactctcttgggtagtgggcgcatgcgattctggtggccctgccgttccctc

SEQ ID NO: 36749 - DNA, 319 bp, Homo sapiens
tggtagagatgggttctcacttttttgcccaggctgatcatgaactcctgcccacctcggccttccaaagtgaaccaccatgcctgacctctacctcttgatggagtttgctgcagagaattcaatctacaaaaccattcttcttattcattccacatgcccccttttgttcaacattgtaatcactaaacctctttcagttctttaaactcaccttgttctccagcttttggcctgaaaacatgtgtttctctccacctgaaatattctttcttgcctgttttttctagctgactgctatacatagtttaggttttag

SEQ ID NO: 36750 - DNA, 366 bp, Homo sapiens
atcatgactcttcactgttgatggtgactctgattcacctggtcaaggtagtgttcattaggtttctccactgcacacttagtctttccctctactttccacactgctgcctttggaggagtgttgctgtgcccagctcatgcttgtggagtggggatttaatgttctcactcttcgagggtagagtatctgcataaactacttggaattctgcatggaatatttgtgtcttctcccccatttatttatttaatcatttatttatatcacggtacactcatggacatttattttatgctttatgttataatcctatactactttatttattttgttgcttaaatttttccagatggaacaatttgg

SEQ ID NO: 36751 - DNA, 201 bp, Homo sapiens
ggctccgcagaacacagtgtgggactgcccacctgccggctggccctctgcacccctcccagtcctggcattctgtgggttgaatgggaggacaagaatggcagccagaggagggcaagccacagtgggtctgccccatagccagctcctcgcccacattttgtccagtccctggcacgaggtgatcggccagtcactggg

SEQ ID NO: 36752 - DNA, 356 bp, Homo sapiens
gtgagtgctggggagagcagaggcagaaggcagaatagatagcagggggcaaggccagtgggcagagacacggccgaccctgaagcatcccatgcctcagtttcctcctgcatacaggaaggttagataattgcataggaattttcaggttctaaaatgtgtgcagaacctaaacacagtaaaatactgcacaaagacatttaaagactagggagggtcgaagtcaatctttcaatcatacatttcatcaaaaacattctttcaggctgggcacagtggttcacccctatagtctcagcactttgggaggccgaggtggtaggatagcttgaggccaggagttctagaccagcctg

SEQ ID NO: 36753 - DNA, 278 bp, Homo sapiens
cccagctagaaagataggcataataccagcaattaatattcagcatttcacattatagtcaagaggatgtgtttttctttgtgatgtggctcataagctaagagtgttgggagccagactctgaactgtgtcttctttttgtggatgaggattaaggaggaaaaaaacagcgacgacaatcctgctccatctgtaaatgaacaaacatcttgattttatagctatttgctttgtaaaactaaggaatgaaacaaaaattactggatgcctaagtaaca

SEQ ID NO: 36754 - DNA, 298 bp, Homo sapiens
tttttttgtcaatcttaagattttaatttcagcttaggcctttcttatttccatcatggacctggctccctttgtaagtttaccagaatctgtcaactaatcctcagagcactccctttctgtctctcccacataagaatttgctaaatgatatccatataacctcttattctgtatttttaagggacaaagaattggctgtttcttataagttattttcctttatactatttataatttgtctacctaaatcacaatgtgttcataactcttctttctgtatttcttttcgtcgaca

SEQ ID NO: 36755 - DNA, 3498 bp, Homo sapiens
gaattcgaggatccgggtaccatggggctggagtggggaccgaggccctgctcactcccctggtgggccggcttgcccgcctgctggaggccacacccacagactcttgtggctatttccgggagaccattcggcgggacatccggcaggcgcgggagcggttcagtgggccacagctgcggcaggagctggctcgcctgcagcggagactggacagcgtggagctgctgagccccgacatcatcatgaacttgctgctctcctaccgcgatgtgcaggactactcggccatcattgagctggtggagacgctgcaggccttgcccacctgtgatgtggccgagcagcataatgtctgcttccactacacttttgccctcaaccggaggaacaggcctggggaccgggcgaaggccctgtctgtgctgctgccgctggtacagcttgagggctctgtggcgcccgatctgtactgcatgtgtggccgtatctacaaggacatgttcttcagctcgggtttccaggatgctgggcaccgggagcaggcctatcactggtatcgcaaggcttttgacgtagagcccagccttcactcaggcatcaatgcagctgtgctcctcattgctgccgggcagcactttgaggattccaaagagctccggctaataggcatgaagctgggctgcctgctggcccgcaaaggctgcgtggagaagatgcagtattactgggatgtgggtttctacctgggagcccagatcctcgccaatgaccccacccaggtggtgctggctgcagagcagctgtataagctcaatgcccccatatggtacctggtgtccgtgatggagaccttcctgctctaccagcacttcaggcccacgccagagccccctggagggccaccacgccgtgcccacttctggctccacttcttgctacagtcctgccaaccattcaagacagcctgtgcccagggcgaccagtgcttggtgctggtcctggagatgaacaaggtgctgctgcctgcaaagctcgaggttcggggtactgacccagtaagcacagtgaccctgagcctgctggagcctgagacccaggacattccctccagctggaccttcccagtcgcctccatatgcggagtcagcgcctcaaagcgcgacgagcgctgctgcttcctctatgcactccccccggctcaggacgtccagctgtgcttccccagcgtagggcactgccagtggttctgcggcctgatccaggcctgggtgacgaacccggattccacggcgcccgcggaggaggcggagggcgcgggggagatgttggagtttgattatgagtacacggagacgggcgagcggctggtgctgggcaagggcacgtatggggtggtgtacgcgggccgcgatcgccacacgagggtgcgcatcgccatcaaggagatcccggagcgggacagcaggttctctcagcccctgcatgaagagatcgctcttcacagacgcctgcgccacaagaacatagtgcgctatctgggctcagctagccagggcggctaccttaagatcttcatggaggaagtgcctggaggcagcctgtcctccttgctgcggtcggtgtggggacccctgaaggacaacgagagcaccatcagtttctacacccgccagatcctgcagggacttggctacttgcacgacaaccacatcgtgcacagggacataaaaggggacaatgtgctgatcaacaccttcagtgggctgctcaagatttctgacttcggcacctccaagcggctggcaggcatcacaccttgcactgagaccttcacaggaactctgcagtatatggccccagaaatcattgaccagggcccacgcgggtatgggaaagcagctgacatctggtcactgggctgcactgtcattgagatggccacaggtcgcccccccttccacgagctcgggagcccacaggctgccatgtttcaggtgggtatgtacaaggtccatccgccaatgcccagctctctgtcggccgaggcccaagcctttctcctccgaacttttgagccagacccccgcctccgagccagcgcccagacactgctgggggaccccttcctgcagcctgggaaaaggagccgcagccccagctccccacgacatgctccacggccctcagatgccccttctgccagtcccactccttcagccaactcaaccacccagtctcagacattcccgtgccctcaggcaccctctcagcacccacccagccccccgaagcgctgcctcagttatgggggcaccagccagctccgggtgcccgaggagcctgcggccgaggagcctgcgtctccggaggagagttcggggctgagcctgctgcaccaggagagcaagcgtcgggccatgctggccgcagtattggagcaggagctgccagcgctggcggagaatctgcaccaggagcagaagcaagagcagggggcccgtctgggcagaaaccatgtggaagagctgctgcgctgcctcggggcacacatccacactcccaaccgccggcagctcgcccaggagctgcgggcgctgcaaggacggctgagggcccagggccttgggcctgcgcttctgcacagaccgctgtttgccttcccggatgcggtgaagcagatcctccgcaagcgccagatccgtccacactggatgttcgttctggactcactgctcagccgtgctgtgcgggcagccctgggtgtgctaggaccggaggtggagaaggaggcggtctcaccgaggtcagaggagctgagtaatgaaggggactcccagcagagcccaggccagcagagcccgcttccggtggagcccgagcagggccccgctcctctgatggtgcagctgagcctcttgagggcagagactgatcggctgcgcgaaatcctggcggggaaggaacgggagtaccaggccctggtgcagcgggctctacagcggctgaatgaggaagcccggacctatgtcctggccccagagcctccaactgctctttcaacggaccagggcctggtgcagtggctacaggaactgaatgtggattcaggcaccatccaaatgctgttgaaccatagcttcaccctccacactctgctcacctatgccactcgagatgacctcatctacacccgcatcaggggagggatggtatgccgcatctggagggccatcttggcacagcgagcaggatccacaccagtcacctctggaccctgagagctgaatgagggcatcataggccagacaggcccaaggatggatgaatggagaggacaaaggcagcttctgacacaccagccccaggacctggggcgactggaggaagccaggcgagtggggcccaggactggttccagtgagagaaaccaaccacaggcacccaagcactaccagacaaagcgtattaaacagaacacttttgaacctttaaaaa

SEQ ID NO: 36756 - DNA, 518 bp, Homo sapiens
caggacttgacgttcccagattccctgtctcctctgtgaagatcaggcctgcagcaaaaaaccgtctgcccagtcctagcttcccaggccttccctggtgcagtggctacaggaactgaatgtggattcaggcaccatccaaatgctgttgaaccatagcttcaccctccacactctgctcacctatgccactcgagatgacctcatctacacccgcatcaggggagggatggtatgccgcatctggagggccatcttggcacagcgagcaggatccacaccagtcacctctggaccctgagagctgaatgagggcatcataggccagacaggcccaaggatggatgaatggagaggacaaaggcagcttctgacacaccagccccaggacctggggcgactggaggaagccaggcgagtggggcccaggactggttccagtgagagaaaccaaccacaggcacccaagcactaccagacaaagcgtattaaacagaacacttttgaacctttaaaaa

SEQ ID NO: 36757 - DNA, 3738 bp, Homo sapiens
agcctacaagtgaaggcagggcagcgttggcgggcgctcccttgagaagtccaggtggcgggcacctccgagccgattcccaggatcccccaagtggctctgagctgccgatcaccggatgccccagattcctgggacccaatcccggatttcagaacctcaggaccttgcaagtccgagctaggatttctccctggactttagattcctggaacgggacgtcaggccgtattccggatccctagatcccgtgggagattctccgattccgaacggattccagatcccaagattcctgatctgccggcccaggctcctgccccgcccccggttcccagtgcgcggcgccccgcgcctgagcgcccccgcatggcggggccgtgtccccggtccggggcggagcgcgccggcagctgctggcaggacccgctggccgtggcgctgagccggggccggcagctcgcggcgcccccgggccggggctgcgcgcggagccggccgctcagcgtggtctacgtgctgacccgggagccgcagcccgggctcgagcctcgggagggaaccgaggcggagccgctgcccctgcgctgcctgcgcgaggcttgcgcgcaggtcccccggccgcggccgcccccgcagctgcgcagcctgcccttcgggacgctggagctaggcgacaccgcggctctggatgccttctacaacgcggatgtggtggtgctggaggtgagcagctcgctggtacagccctccctgttctaccaccttggtgtgcgtgagagcttcagcatgaccaacaatgtgctcctctgctcccaggccgacctccctgacctgcaggccctgcgggaggatgttttccagaagaactcggattgcgttggcagctacacactgatcccctatgtggtgacggccactggtcgggtgctgtgtggtgatgcaggccttctgcggggcctggctgatgggctggtacaggctggagtggggaccgaggccctgctcactcccctggtgggccggcttgcccgcctgctggaggccacacccacagactcttgtggctatttccgggagaccattcggcgggacatccggcaggcgcgggagcggttcagtgggccacagctgcggcaggagctggctcgcctgcagcggagactggacagcgtggagctgctgagccccgacatcatcatgaacttgctgctctcctaccgcgatgtgcaggactactcggccatcattgagctggtggagacgctgcaggccttgcccacctgtgatgtggccgagcagcataatgtctgcttccactacacttttgccctcaaccggaggaacaggcctggggaccgggcgaaggccctgtctgtgctgctgccgctggtacagcttgagggctctgtggcgcccgatctgtactgcatgtgtggccgtatctacaaggacatgttcttcagctcgggtttccaggatgctgggcaccgggagcaggcctatcactggtatcgcaaggcttttgacgtagagcccagccttcactcaggcatcaatgcagctgtgctcctcattgctgccgggcagcactttgaggattccaaagagctccggctaataggcatgaagctgggctgcctgctggcccgcaaaggctgcgtggagaagatgcagtattactgggatgtgggtttctacctgggagcccagatcctcgccaatgaccccacccaggtggtgctggctgcagagcagctgtataagctcaatgcccccatatggtacctggtgtccgtgatggagaccttcctgctctaccagcacttcaggcccacgccagagccccctggagggccaccacgccgtgcccacttctggctccacttcttgctacagtcctgccaaccattcaagacagcctgtgcccagggcgaccagtgcttggtgctggtcctggagatgaacaaggtgctgctgcctgcaaagctcgaggttcggggtactgacccagtaagcacagtgaccctgagcctgctggagcctgagacccaggacattccctccagctggaccttcccagtcgcctccatatgcggagtcagcgcctcaaagcgcgacgagcgctgctgcttcctctatgcactccccccggctcaggacgtccagctgtgcttccccagcgtagggcactgccagtggttctgcggcctgatccaggcctgggtgacgaacccggattccacggcgcccgcggaggaggcggagggcgcgggggagatgttggagtttgattatgagtacacggagacgggcgagcggctggtgctgggcaagggcacgtatggggtggtgtacgcgggccgcgatcgccacacgagggtgcgcatcgccatcaaggagatcccggagcgggacagcaggttctctcagcccctgcatgaagagatcgctcttcacagacgcctgcgccacaagaacatagtgcgctatctgggctcagctagccagggcggctaccttaagatcttcatggaggaagtgcctggaggcagcctgtcctccttgctgcggtcggtgtggggacccctgaaggacaacgagagcaccatcagtttctacacccgccagatcctgcagggacttggctacttgcacgacaaccacatcgtgcacagggacataaaaggggacaatgtgctgatcaacaccttcagtgggctgctcaagatttctgacttcggcacctccaagcggctggcaggcatcacaccttgcactgagaccttcacaggaactctgcagtatatggccccagaaatcattgaccagggcccacgcgggtatgggaaagcagctgacatctggtcactgggctgcactgtcattgagatggccacaggtcgcccccccttccacgagctcgggagcccacaggctgccatgtttcaggtgggtatgtacaaggtccatccgccaatgcccagctctctgtcggccgaggcccaagcctttctcctccgaacttttgagccagacccccgcctccgagccagcgcccagacactgctgggggaccccttcctgcagcctgggaaaaggagccgcagccccagctccccacgacatgctccacggccctcagatgccccttctgccagtcccactccttcagccaactcaaccacccagtctcagacattcccgtgccctcaggcaccctctcagcacccacccagccccccgaagcgctgcctcagttatgggggcaccagccagctccgggtgcccgaggagcctgcggccgaggagcctgcgtctccggaggagagttcggggctgagcctgctgcaccaggagagcaagcgtcgggccatgctggccgcagtattggagcaggagctgccagcgctggcggagaatctgcaccaggagcagaagcaagagcagggggcccgtctgggcagaaaccatgtggaagagctgctgcgctgcctcggggcacacatccacactcccaaccgccggcagctcgcccaggagctgcgggcgctgcaaggatggatgaatggagaggacaaaggcagcttctgacacaccagccccaggacctggggcgactggaggaagccaggcgagtggggcccaggactggttccagtgagagaaaccaaccacaggcacccaagcactaccagacaaagcgtattaaacagaacacttttgaacctttaaaaa

SEQ ID NO: 36758 - DNA, 4552 bp, Homo sapiens
agcctacaagtgaaggcagggcagcgttggcgggcgctcccttgagaagtccaggtggcgggcacctccgagccgattcccaggatcccccaagtggctctgagctgccgatcaccggatgccccagattcctgggacccaatcccggatttcagaacctcaggaccttgcaagtccgagctaggatttctccctggactttagattcctggaacgggacgtcaggccgtattccggatccctagatcccgtgggagattctccgattccgaacggattccagatcccaagattcctgatctgccggcccaggctcctgccccgcccccggttcccagtgcgcggcgccccgcgcctgagcgcccccgcatggcggggccgtgtccccggtccggggcggagcgcgccggcagctgctggcaggacccgctggccgtggcgctgagccggggccggcagctcgcggcgcccccgggccggggctgcgcgcggagccggccgctcagcgtggtctacgtgctgacccgggagccgcagcccgggctcgagcctcgggagggaaccgaggcggagccgctgcccctgcgctgcctgcgcgaggcttgcgcgcaggtcccccggccgcggccgcccccgcagctgcgcagcctgcccttcgggacgctggagctaggcgacaccgcggctctggatgccttctacaacgcggatgtggtggtgctggaggtgagcagctcgctggtacagccctccctgttctaccaccttggtgtgcgtgagagcttcagcatgaccaacaatgtgctcctctgctcccaggccgacctccctgacctgcaggccctgcgggaggatgttttccagaagaactcggattgcgttggcagctacacactgatcccctatgtggtgacggccactggtcgggtgctgtgtggtgatgcaggccttctgcggggcctggctgatgggctggtacaggctggagtggggaccgaggccctgctcactcccctggtgggccggcttgcccgcctgctggaggccacacccacagactcttgtggctatttccgggagaccattcggcgggacatccggcaggcgcgggagcggttcagtgggccacagctgcggcaggagctggctcgcctgcagcggagactggacagcgtggagctgctgagccccgacatcatcatgaacttgctgctctcctaccgcgatgtgcaggactactcggccatcattgagctggtggagacgctgcaggccttgcccacctgtgatgtggccgagcagcataatgtctgcttccactacacttttgccctcaaccggaggaacaggcctggggaccgggcgaaggccctgtctgtgctgctgccgctggtacagcttgagggctctgtggcgcccgatctgtactgcatgtgtggccgtatctacaaggacatgttcttcagctcgggtttccaggatgctgggcaccgggagcaggcctatcactggtatcgcaaggcttttgacgtagagcccagccttcactcaggcatcaatgcagctgtgctcctcattgctgccgggcagcactttgaggattccaaagagctccggctaataggcatgaagctgggctgcctgctggcccgcaaaggctgcgtggagaagatgcagtattactgggatgtgggtttctacctgggagcccagatcctcgccaatgaccccacccaggtggtgctggctgcagagcagctgtataagctcaatgcccccatatggtacctggtgtccgtgatggagaccttcctgctctaccagcacttcaggcccacgccagagccccctggagggccaccacgccgtgcccacttctggctccacttcttgctacagtcctgccaaccattcaagacagcctgtgcccagggcgaccagtgcttggtgctggtcctggagatgaacaaggtgctgctgcctgcaaagctcgaggttcggggtactgacccagtaagcacagtgaccctgagcctgctggagcctgagacccaggacattccctccagctggaccttcccagtcgcctccatatgcggagtcagcgcctcaaagcgcgacgagcgctgctgcttcctctatgcactccccccggctcaggacgtccagctgtgcttccccagcgtagggcactgccagtggttctgcggcctgatccaggcctgggtgacgaacccggattccacggcgcccgcggaggaggcggagggcgcgggggagatgttggagtttgattatgagtacacggagacgggcgagcggctggtgctgggcaagggcacgtatggggtggtgtacgcgggccgcgatcgccacacgagggtgcgcatcgccatcaaggagatcccggagcgggacagcaggttctctcagcccctgcatgaagagatcgctcttcacagacgcctgcgccacaagaacatagtgcgctatctgggctcagctagccagggcggctaccttaagatcttcatggaggaagtgcctggaggcagcctgtcctccttgctgcggtcggtgtggggacccctgaaggacaacgagagcaccatcagtttctacacccgccagatcctgcagggacttggctacttgcacgacaaccacatcgtgcacagggacataaaaggggacaatgtgctgatcaacaccttcagtgggctgctcaagatttctgacttcggcacctccaagcggctggcaggcatcacaccttgcactgagaccttcacaggaactctgcagtatatggccccagaaatcattgaccagggcccacgcgggtatgggaaagcagctgacatctggtcactgggctgcactgtcattgagatggccacaggtcgcccccccttccacgagctcgggagcccacaggctgccatgtttcaggtgggtatgtacaaggtccatccgccaatgcccagctctctgtcggccgaggcccaagcctttctcctccgaacttttgagccagacccccgcctccgagccagcgcccagacactgctgggggaccccttcctgcagcctgggaaaaggagccgcagccccagctccccacgacatgctccacggccctcaggtgcttgcgggtggcgggatgggcacagtggagggcagaggagttgtggagctgtgagggtggaggagagcccagctgatggctctgtccctccctcagatgccccttctgccagtcccactccttcagccaactcaaccacccagtctcagacattcccgtgccctcaggcaccctctcagcacccacccagccccccgaagcgctgcctcagttatgggggcaccagccagctccgggtgcccgaggagcctgcggccgaggagcctgcgtctccggaggagagttcggggctgagcctgctgcaccaggagagcaagcgtcgggccatgctggccgcagtattggagcaggagctgccagcgctggcggagaatctgcaccaggagcagaagcaagagcagggggcccgtctgggcagaaaccatgtggaagagctgctgcgctgcctcggggcacacatccacactcccaaccgccggcagctcgcccaggagctgcgggcgctgcaaggacggctgagggcccagggccttgggcctgcgcttctgcacagaccgctgtttgccttcccggatgcggtgaagcagatcctccgcaagcgccagatccgtccacactggatgttcgttctggactcactgctcagccgtgctgtgcgggcagccctgggtgtgctaggaccggaggtggagaaggaggcggtctcaccgaggtcagaggagctgagtaatgaaggggactcccagcagagcccaggccagcagagcccgcttccggtggagcccgagcagggccccgctcctctgatggtgcagctgagcctcttgagggcagagactgatcggctgcgcgaaatcctggcggggaaggaacgggagtaccaggccctggtgcagcgggctctacagcggctgaatgaggaagcccggacctatgtcctggccccagagcctccaactgctctttcaacggaccagggcctggtgcagtggctacaggaactgaatgtggattcaggcaccatccaaatgctgttgaaccatagcttcaccctccacactctgctcacctatgccactcgagatgacctcatctacacccgcatcaggggagggatggtatgccgcatctggagggccatcttggcacagcgagcaggatccacaccagtcacctctggaccctgagagctgaatgagggcatcataggccagacaggcccaaggatggatgaatggagaggacaaaggcagcttctgacacaccagccccaggacctggggcgactggaggaagccaggcgagtggggcccaggactggttccagtgagagaaaccaaccacaggcacccaagcactaccagacaaagcgtattaaacagaacacttttgaacctttaaaaa

SEQ ID NO: 36759 - DNA, 4376 bp, Homo sapiens
agcctacaagtgaaggcagggcagcgttggcgggcgctcccttgagaagtccaggtggcgggcacctccgagccgattcccaggatcccccaagtggctctgagctgccgatcaccggatgccccagattcctgggacccaatcccggatttcagaacctcaggaccttgcaagtccgagctaggatttctccctggactttagattcctggaacgggacgtcaggccgtattccggatccctagatcccgtgggagattctccgattccgaacggattccagatcccaagattcctgatctgccggcccaggctcctgccccgcccccggttcccagtgcgcggcgccccgcgcctgagcgcccccgcatggcggggccgtgtccccggtccggggcggagcgcgccggcagctgctggcaggacccgctggccgtggcgctgagccggggccggcagctcgcggcgcccccgggccggggctgcgcgcggagccggccgctcagcgtggtctacgtgctgacccgggagccgcagcccgggctcgagcctcgggagggaaccgaggcggagccgctgcccctgcgctgcctgcgcgaggcttgcgcgcaggtcccccggccgcggccgcccccgcagctgcgcagcctgcccttcgggacgctggagctaggcgacaccgcggctctggatgccttctacaacgcggatgtggtggtgctggaggtgagcagctcgctggtacagccctccctgttctaccaccttggtgtgcgtgagagcttcagcatgaccaacaatgtgctcctctgctcccaggccgacctccctgacctgcaggccctgcgggaggatgttttccagaagaactcggattgcgttggcagctacacactgatcccctatgtggtgacggccactggtcgggtgctgtgtggtgatgcaggccttctgcggggcctggctgatgggctggtacaggctggagtggggaccgaggccctgctcactcccctggtgggccggcttgcccgcctgctggaggccacacccacagactcttgtggctatttccgggagaccattcggcgggacatccggcaggcgcgggagcggttcagtgggccacagctgcggcaggagctggctcgcctgcagcggagactggacagcgtggagctgctgagccccgacatcatcatgaacttgctgctctcctaccgcgatgtgcaggactactcggccatcattgagctggtggagacgctgcaggccttgcccacctgtgatgtggccgagcagcataatgtctgcttccactacacttttgccctcaaccggaggaacaggcctggggaccgggcgaaggccctgtctgtgctgctgccgctggtacagcttgagggctctgtggcgcccgatctgtactgcatgtgtggccgtatctacaaggacatgttcttcagctcgggtttccaggatgctgggcaccgggagcaggcctatcactggtatcgcaaggcttttgacgtagagcccagccttcactcaggcatcaatgcagctgtgctcctcattgctgccgggcagcactttgaggattccaaagagctccggctaataggcatgaagctgggctgcctgctggcccgcaaaggctgcgtggagaagatgcagtattactgggatgtgggtttctacctgggagcccagatcctcgccaatgaccccacccaggtggtgctggctgcagagcagctgtataagctcaatgcccccatatggtacctggtgtccgtgatggagaccttcctgctctaccagcacttcaggcccacgccagagccccctggagggccaccacgccgtgcccacttctggctccacttcttgctacagtcctgccaaccattcaagacagcctgtgcccagggcgaccagtgcttggtgctggtcctggagatgaacaaggtgctgctgcctgcaaagctcgaggttcggggtactgacccagtaagcacagtgaccctgagcctgctggagcctgagacccaggacattccctccagctggaccttcccagtcgcctccatatgcggagtcagcgcctcaaagcgcgacgagcgctgctgcttcctctatgcactccccccggctcaggacgtccagctgtgcttccccagcgtagggcactgccagtggttctgcggcctgatccaggcctgggtgacgaacccggattccacggcgcccgcggaggaggcggagggcgcgggggagatgttggagtttgattatgagtacacggagacgggcgagcggctggtgctgggcaagggcacgtatggggtggtgtacgcgggccgcgatcgccacacgagggtgcgcatcgccatcaaggagatcccggagcgggacagcaggttctctcagcccctgcatgaagagatcgctcttcacagacgcctgcgccacaagaacatagtgcgctatctgggctcagctagccagggcggctaccttaagatcttcatggaggaagtgcctggaggcagcctgtcctccttgctgcggtcggtgtggggacccctgaaggacaacgagagcaccatcagtttctacacccgccagatcctgcagggacttggctacttgcacgacaaccacatcgtgcacagggacataaaaggggacaatgtgctgatcaacaccttcagtgggctgctcaagatttctgacttcggcacctccaagcggctggcaggcatcacaccttgcactgagaccttcacaggaactctgcagtatatggccccagaaatcattgaccagggcccacgcgggtatgggaaagcagctgacatctggtcactgggctgcactgtcattgagatggccacaggtcgcccccccttccacgagctcgggagcccacaggctgccatgtttcaggtgggtatgtacaaggtccatccgccaatgcccagctctctgtcggccgaggcccaagcctttctcctccgaacttttgagccagacccccgcctccgagccagcgcccagacactgctgggggaccccttcctgcagcctgggaaaaggagccgcagccccagctccccacgacatgctccacggccctcagatgccccttctgccagtcccactccttcagccaactcaaccacccagtctcagacattcccgtgccctcaggcaccctctcagcacccacccagccccccgaagcgctgcctcagttatgggggcaccagccagctccgggtgcccgaggagcctgcggccgaggagcctgcgtctccggaggagagttcggggctgagcctgctgcaccaggagagcaagcgtcgggccatgctggccgcagtattggagcaggagctgccagcgctggcggagaatctgcaccaggagcagaagcaagagcagggggcccgtctgggcagaaaccatgtggaagagctgctgcgctgcctcggggcacacatccacactcccaaccgccggcagctcgcccaggagctgcgggcgctgcaaggacggctgagggcccagggccttgggcctgcgcttctgcacagaccgctgtttgccttcccggatgcggtgaagcagatcctccgcaagcgccagatccgtccacactggatgttcgttctggactcactgctcagccgtgctgtgcgggcagccctgggtgtgctaggaccggaggtggagaaggaggcggtctcaccgaggtcagaggagctgagtaatgaaggggactcccagcagagcccaggccagcagagcccgcttccggtggagcccgagcagggccccgctcctctgatggtgcagctgagcctcttgagggcagagactgatcggctgcgcgaaatcctggcggggaaggaacgggagtaccaggccctggtgcagcgggctctacagcggctgaatgaggaagcccggacctatgtcctggccccagagcctccaactgctctttcaacggaccagggcctggtgcagtggctacaggaactgaatgtggattcaggcaccatccaaatggggagggatggtatgccgcatctggagggccatcttggcacagcgagcaggatccacaccagtcacctctggaccctgagagctgaatgagggcatcataggccagacaggcccaaggatggatgaatggagaggacaaaggcagcttctgacacaccagccccaggacctggggcgactggaggaagccaggcgagtggggcccaggactggttccagtgagagaaaccaaccacaggcacccaagcactaccagacaaagcgtattaaacagaacacttttgaacctttaaaaa

SEQ ID NO: 36760 - DNA, 1804 bp, Homo sapiens
cgtgtagtcgatcttagagtatccccaagctctggaaaaggggacaatgtgctgatcaacaccttcagtgggctgctcaagatttctgacttcggcacctccaagcggctggcaggcatcacaccttgcactgagaccttcacaggaactctgcagtatatggccccagaaatcattgaccagggcccacgcgggtatgggaaagcagctgacatctggtcactgggctgcactgtcattgagatggccacaggtcgcccccccttccacgagctcgggagcccacaggctgccatgtttcaggtgggtatgtacaaggtccatccgccaatgcccagctctctgtcggccgaggcccaagcctttctcctccgaacttttgagccagacccccgcctccgagccagcgcccagacactgctgggggaccccttcctgcagcctgggaaaaggagccgcagccccagctccccacgacatgctccacggccctcagatgccccttctgccagtcccactccttcagccaactcaaccacccagtctcagacattcccgtgccctcaggcaccctctcagcacccacccagccccccgaagcgctgcctcagttatgggggcaccagccagctccgggtgcccgaggagcctgcggccgaggagcctgcgtctccggaggagagttcggggctgagcctgctgcaccaggagagcaagcgtcgggccatgctggccgcagtattggagcaggagctgccagcgctggcggagaatctgcaccaggagcagaagcaagagcagggggcccgtctgggcagaaaccatgtggaagagctgctgcgctgcctcggggcacacatccacactcccaaccgccggcagctcgcccaggagctgcgggcgctgcaaggacggctgagggcccagggccttgggcctgcgcttctgcacagaccgctgtttgccttcccggatgcggtgaagcagatcctccgcaagcgccagatccgtccacactggatgttcgttctggactcactgctcagccgtgctgtgcgggcagccctgggtgtgctaggaccggaggtggagaaggaggcggtctcaccgaggtcagaggagctgagtaatgaaggggactcccagcagagcccaggccagcagagcccgcttccggtggagcccgagcagggccccgctcctctgatggtgcagctgagcctcttgagggcagagactgatcggctgcgcgaaatcctggcggggaaggaacgggagtaccaggccctggtgcagcgggctctacagcggctgaatgaggaagcccggacctatgtcctggccccagagcctccaactgctctttcaacggaccagggcctggtgcagtggctacaggaactgaatgtggattcaggcaccatccaaatgctgttgaaccatagcttcaccctccacactctgctcacctatgccactcgagatgacctcatctacacccgcatcaggggagggatggtatgccgcatctggagggccatcttggcacagcgagcaggatccacaccagtcacctctggaccctgagagctgaatgagggcatcataggccagacaggcccaaggatggatgaatggagaggacaaaggcagcttctgacacaccagccccaggacctggggcgactggaggaagccaggcgagtggggcccaggactggttccagtgagagaaaccaaccacaggcacccaagcactaccagacaaagcgtattaaacagaacacttttgaacctttaaaaa

SEQ ID NO: 36761 - DNA, 1890 bp, Homo sapiens
aggtgttgaggtatattttggatgataggttcagtatgggtgcagtcggcctgaggatgacggcattcccctccctgctccaaccccatgatgaagcctagatgggcattggtgctcctgtttctgtcctaggaactctgcagtatatggccccagaaatcattgaccagggcccacgcgggtatgggaaagcagctgacatctggtcactgggctgcactgtcattgagatggccacaggtcgcccccccttccacgagctcgggagcccacaggctgccatgtttcaggtgggtatgtacaaggtccatccgccaatgcccagctctctgtcggccgaggcccaagcctttctcctccgaacttttgagccagacccccgcctccgagccagcgcccagacactgctgggggaccccttcctgcagcctgggaaaaggagccgcagccccagctccccacgacatgctccacggccctcaggtgcttgcgggtggcgggatgggcacagtggagggcagaggagttgtggagctgtgagggtggaggagagcccagctgatggctctgtccctccctcagatgccccttctgccagtcccactccttcagccaactcaaccacccagtctcagacattcccgtgccctcaggcaccctctcagcacccacccagccccccgaagcgctgcctcagttatgggggcaccagccagctccgggtgcccgaggagcctgcggccgaggagcctgcgtctccggaggagagttcggggctgagcctgctgcaccaggagagcaagcgtcgggccatgctggccgcagtattggagcaggagctgccagcgctggcggagaatctgcaccaggagcagaagcaagagcagggggcccgtctgggcagaaaccatgtggaagagctgctgcgctgcctcggggcacacatccacactcccaaccgccggcagctcgcccaggagctgcgggcgctgcaaggacggctgagggcccagggccttgggcctgcgcttctgcacagaccgctgtttgccttcccggatgcggtgaagcagatcctccgcaagcgccagatccgtccacactggatgttcgttctggactcactgctcagccgtgctgtgcgggcagccctgggtgtgctaggaccggaggtggagaaggaggcggtctcaccgaggtcagaggagctgagtaatgaaggggactcccagcagagcccaggccagcagagcccgcttccggtggagcccgagcagggccccgctcctctgatggtgcagctgagcctcttgagggcagagactgatcggctgcgcgaaatcctggcggggaaggaacgggagtaccaggccctggtgcagcgggctctacagcggctgaatgaggaagcccggacctatgtcctggccccagagcctccaactgctctttcaacggaccagggcctggtgcagtggctacaggaactgaatgtggattcaggcaccatccaaatgctgttgaaccatagcttcaccctccacactctgctcacctatgccactcgagatgacctcatctacacccgcatcaggggagggatggtatgccgcatctggagggccatcttggcacagcgagcaggatccacaccagtcacctctggaccctgagagctgaatgagggcatcataggccagacaggcccaaggatggatgaatggagaggacaaaggcagcttctgacacaccagccccaggacctggggcgactggaggaagccaggcgagtggggcccaggactggttccagtgagagaaaccaaccacaggcacccaagcactaccagacaaagcgtattaaacagaacacttttgaacctttaaaaa

SEQ ID NO: 36762 - DNA, 2141 bp, Homo sapiens
agcctacaagtgaaggcagggcagcgttggcgggcgctcccttgagaagtccaggtggcgggcacctccgagccgattcccaggatcccccaagtggctctgagctgccgatcaccggatgccccagattcctgggacccaatcccggatttcagaacctcaggaccttgcaagtccgagctaggatttctccctggactttagattcctggaacgggacgtcaggccgtattccggatccctagatcccgtgggagattctccgattccgaacggattccagatcccaagattcctgatctgccggcccaggctcctgccccgcccccggttcccagtgcgcggcgccccgcgcctgagcgcccccgcatggcggggccgtgtccccggtccggggcggagcgcgccggcagctgctggcaggacccgctggccgtggcgctgagccggggccggcagctcgcggcgcccccgggccggggctgcgcgcggagccggccgctcagcgtggtctacgtgctgacccgggagccgcagcccgggctcgagcctcgggagggaaccgaggcggagccgctgcccctgcgctgcctgcgcgaggcttgcgcgcaggtcccccggccgcggccgcccccgcagctgcgcagcctgcccttcgggacgctggagctaggcgacaccgcggctctggatgccttctacaacgcggatgtggtggtgctggaggtgagcagctcgctggtacagccctccctgttctaccaccttggtgtgcgtgagagcttcagcatgaccaacaatgtgctcctctgctcccaggccgacctccctgacctgcaggccctgcgggaggatgttttccagaagaactcggattgcgttggcagctacacactgatcccctatgtggtgacggccactggtcgggtgctgtgtggtgatgcaggccttctgcggggcctggctgatgggctggtacaggctggagtggggaccgaggccctgctcactcccctggtgggccggcttgcccgcctgctggaggccacacccacagactcttgtggctatttccgggagaccattcggcgggacatccggcaggcgcgggagcggttcagtgggccacagctgcggcaggagctggctcgcctgcagcggagactggacagcgtggagctgctgagccccgacatcatcatgaacttgctgctctcctaccgcgatgtgcaggactactcggccatcattgagctggtggagacgctgcaggccttgcccacctgtgatgtggccgagcagcataatgtctgcttccactacacttttgccctcaaccggaggaacaggcctggggaccgggcgaaggccctgtctgtgctgctgccgctggtacagcttgagggctctgtggcgcccgatctgtactgcatgtgtggccgtatctacaaggacatgttcttcagctcgggtttccaggatgctgggcaccgggagcaggcctatcactggtatcgcaaggcttttgacgtagagcccagccttcactcaggcatcaatgcagctgtgctcctcattgctgccgggcagcactttgaggattccaaagagctccggctaataggcatgaagctgggctgcctgctggcccgcaaaggctgcgtggagaagatgcagtattactgggatgtgggtttctacctgggagcccagatcctcgccaatgaccccacccaggtggtgctggctgcagagcagctgtataagctcaatgcccccatatggtacctggtgtccgtgatggagaccttcctgctctaccagcacttcaggcccacgccagagccccctggagggccaccacgccgtgcccacttctggctccacttcttgctacagtcctgccaaccattcaagacagcctgtgcccagggcgaccagtgcttggtgctggtcctggagatgaacaaggtgctgctgcctgcaaagctcgaggttcggggtactgacccagtaagcacagtgaccctgagcctgctggagcctgagacccaggacattccctccagctggaccttcccagtcgcctccatatgcggagtcagcctcaaaagcgacgacctgtgtcctatatgactccc

SEQ ID NO: 36763 - DNA, 1138 bp, Homo sapiens
cctgcctctagttgaggctcagctgtctcagcggcgcctccctccccctgcaggtgaagcagatcctccgcaagcgccagatccgtccacactggatgttcgttctggactcactgctcagccgtgctgtgcgggcagccctgggtgtgctaggaccgggtaggaggggaatgccacgggcctcctgccagcgagggtgtggtgcttgctgggcgcggtgaacatcgaatggggccggtgggggccaggcgggacaggggcaggcaggcgccggtgggggcgtgactaaatggacatctcccataccggcaccgcctggggcctgcccagagccgggcaccctacccccgcactttggggtctggggttcccaaacgggcgttgtagccttgcctgagttcaccgcactgggctgcagaggtggagaaggaggcggtctcaccgaggtcagaggagctgagtaatgaaggggactcccagcagagcccaggccagcagagcccgcttccggtggagcccgagcagggccccgctcctctgatggtgcagctgagcctcttgagggcagagactgatcggctgcgcgaaatcctggcggggaaggaacgggagtaccaggccctggtgcagcgggctctacagcggctgaatgaggaagcccggacctatgtcctggccccagagcctccaactgctctttcaacggaccagggcctggtgcagtggctacaggaactgaatgtggattcaggcaccatccaaatgctgttgaaccatagcttcaccctccacactctgctcacctatgccactcgagatgacctcatctacacccgcatcaggggagggatggtatgccgcatctggagggccatcttggcacagcgagcaggatccacaccagtcacctctggaccctgagagctgaatgagggcatcataggccagacaggcccaaggatggatgaatggagaggacaaaggcagcttctgacacaccagccccaggacctggggcgactggaggaagccaggcgagtggggcccaggactggttccagtgagagaaaccaaccacaggcacccaagcactaccagacaaagcgtattaaacagaacacttttgaacctttaaaaa

SEQ ID NO: 36764 - DNA, 1300 bp, Homo sapiens
ctggagcactcgctgacaacccctctcttccttctcagggggcccgtctgggcagaaaccatgtggaagagctgctgcgctgcctcggggcacacatccacactcccaaccgccggcagctcgcccaggagctgcgggcgctgcaaggacggctgagggcccagggccttgggcctgcgcttctgcacagaccgctgtttgccttcccggatgcggtgaagcagatcctccgcaagcgccagatccgtccacactggatgttcgttctggactcactgctcagccgtgctgtgcgggcagccctgggtgtgctaggaccgggtaggaggggaatgccacgggcctcctgccagcgagggtgtggtgcttgctgggcgcggtgaacatcgaatggggccggtgggggccaggcgggacaggggcaggcaggcgccggtgggggcgtgactaaatggacatctcccataccggcaccgcctggggcctgcccagagccgggcaccctacccccgcactttggggtctggggttcccaaacgggcgttgtagccttgcctgagttcaccgcactgggctgcagaggtggagaaggaggcggtctcaccgaggtcagaggagctgagtaatgaaggggactcccagcagagcccaggccagcagagcccgcttccggtggagcccgagcagggccccgctcctctgatggtgcagctgagcctcttgagggcagagactgatcggctgcgcgaaatcctggcggggaaggaacgggagtaccaggccctggtgcagcgggctctacagcggctgaatgaggaagcccggacctatgtcctggccccagagcctccaactgctctttcaacggaccagggcctggtgcagtggctacaggaactgaatgtggattcaggcaccatccaaatgctgttgaaccatagcttcaccctccacactctgctcacctatgccactcgagatgacctcatctacacccgcatcaggggagggatggtatgccgcatctggagggccatcttggcacagcgagcaggatccacaccagtcacctctggaccctgagagctgaatgagggcatcataggccagacaggcccaaggatggatgaatggagaggacaaaggcagcttctgacacaccagccccaggacctggggcgactggaggaagccaggcgagtggggcccaggactggttccagtgagagaaaccaaccacaggcacccaagcactaccagacaaagcgtattaaacagaacacttttgaacctttaaaaa

SEQ ID NO: 36765 - DNA, 578 bp, Homo sapiens
ctttctgcgggtctttgaccacatccagctgttgaaccatagcttcaccctccacactctgctcacctatgccactcgagatgacctcatctacacccgcatcaggtacatcctgggccccccaagtgtgaaccatgcatatggcctcatcctggccaactgcaggcctgcctaggttccttcctggaaaccaaaggggcacctgggtcccctagggacagagggggcactgggcagacagtgtgtgcaagatagagtccagggccaccttctggctgagccacactgagtccattacccccaggggagggatggtatgccgcatctggagggccatcttggcacagcgagcaggatccacaccagtcacctctggaccctgagagctgaatgagggcatcataggccagacaggcccaaggatggatgaatggagaggacaaaggcagcttctgacacaccagccccaggacctggggcgactggaggaagccaggcgagtggggcccaggactggttccagtgagagaaaccaaccacaggcacccaagcactaccagacaaagcgtattaaacag

SEQ ID NO: 36766 - DNA, 1399 bp, Homo sapiens
gatcagaaagagctggcctcaccagtaagccctgagttgaggcaaaaggaggtacagatgaattttttgaaccagctgacctcagtttttaaccctagaactgtagcatcacaacctatcagtacacagactctggtggaaggagaaaatgatgagcagtcatctacagatcaagcctcagctatcaaaaccaagaatgtgttcatagctcagaacgtggctagtcttcaagagcttggtggctcggagaagctactgcgtgtatgtttgaacctgccatatttcctacgctatatcaatcggttccaagatgcagttttagctaattccttcttcataatgcctgcaacagtagcagatgccactgctgttcgtaatggctttcattcattggtgattgatgtaactatggcattggataccctttctctacctgtgttggaacctctcaatccttctcgtctacaagatgtgacagtcctcagcctaagttgtctgtatgcaggtgtgagtgtggcaacgtgcatggccatcctccatgtgggtagtgcccagcaagtgcggacagggtccacgagctccaaagaagatgactatgaaagtgacgcagctacaattgtccagaaatgtctcgaaatctatgacatgattggacaagcaatcagcagttctcgccgggctggtggtgagcactatcagaatttccaattgctgggtgcttggtgcttgttaaacagccttttcctcatactgaacctcagtcctactgcgttggctgataaggggaaagagaaggacccactggctgccctccgagtcagagacatcctttctcgtactaaagagggagtgggctcccctaaactggggcctggaaaagggcatcagggatttggggtactctcagtaatattggcaaaccatgccatcaaactgctaacgtctctctttcaagacctacaagtggaggcccttcacaagggttgggagacagatggcccccctgcagccttgagcattatggcccagagcacctccatacagaggattcaacggctgattgactctgtcccactgatgaacctgctcttgacgttactttcaacttcctacagaaaggcatgtgtcctgcagcggcagaggaagggctccatgagcagcgatgccagcgcctccaccgactccaatacttactatgaggacgatttcagtagcacggagggagggacagcagccaagacgatggacagtgagcctattttgggggcaatggttttgagggagactatttcttcccagttaaagaggaaagcaggcaccttccgcctcctcccccacctcctccactggaaagctctcctcgggttaaaagccccagtaagcaggcccctggtgagaa

SEQ ID NO: 36767 - DNA, 1301 bp, Homo sapiens
gatcagaaagagctggcctcaccagtaagccctgagttgaggcaaaaggaggtacagatgaattttttgaaccagctgacctcagtttttaaccctagaactgtagcatcacaacctatcagtacacagactctggtggaaggagaaaatgatgagcagtcatctacagatcaagcctcagctatcaaaaccaagaatgtgttcatagctcagaacgtggctagtcttcaagagcttggtggctcggagaagctactgcgtgtatgtttgaacctgccatatttcctacgctatatcaatcggttccaagatgcagttttagctaattccttcttcataatgcctgcaacagtagcagatgccactgctgttcgtaatggctttcattcattggtgattgatgtaactatggcattggataccctttctctacctgtgttggaacctctcaatccttctcgtctacaagatgtgacagtcctcagcctaagttgtctgtatgcaggtgtgagtgtggcaacgtgcatggccatcctccatgtgggtagtgcccagcaagtgcggacagggtccacgagctccaaagaagatgactatgaaagtgacgcagctacaattgtccagaaatgtctcgaaatctatgacatgattggacaagcaatcagcagttctcgccgggctggtggtgagcactatcagaatttccaattgctgggtgcttggtgcttgttaaacagccttttcctcatactgaacctcagtcctactgcgttggctgataaggggaaagagaaggacccactggctgccctccgagtcagagacatcctttctcgtactaaagagggagtgggctcccctaaactggggcctggaaaagggcatcagggatttggggtactctcagtaatattggcaaaccatgccatcaaactgctaacgtctctctttcaagacctacaagtggaggcccttcacaagggttgggagacagatggcccccctgcagccttgagcattatggcccagagcacctccatacagaggattcaacggctgattgactctgtcccactgatgaacctgctcttgacgttactttcaacttcctacagaaagggtcccttggtgtccccgcccatcgaagagacaggtggcggcgtgtgatgaggaggggtcggactcgagccaatggtagaccccccgttccctgtgatttgcaacaaagtggtaagacttgggttctggagacacatggctgaagtcctccccatggcccaccgactcatgccgctctgtga

SEQ ID NO: 36768 - DNA, 312 bp, Homo sapiens
gattggacaagcaatcagcagttctcgccgggctggtggtgaggtaagaagcgtatctgtctctgctgcatacttcctatcttgtcctctctgagatgtaaatatctctatgattatgttttttattttgtgcctttcacaacagcactatcagaatttccaattgctgggtgcttggtgcttgttaaacagccttttcctcatactgaacctcagtcctactgcgttggctgataaggggaaagagaaggacccactggctgccctccgagtcagagacatcctttctcgtactaaagagggagtgggctc

SEQ ID NO: 36769 - DNA, 461 bp, Homo sapiens
tgtgcgcacgtgtaagttttcagcttatttggataaatacctaggagtctggttactgaattgtatggtaaacctatttagtcttgctcttaatggcatttattttaagtagtcaaatcatggaattgcttgtgggtggggtgtgcttttgtgtttcagctttggtggattcttggatgcactccatggctgagacctgtgcatcttctttttcaggtgtgagtgtggcaacgtgcatggccatcctccatgtgggtagtgcccagcaagtgcggacagggtccacgagctccaaagaagatgactatgaaagtgacgcagctacaattgtccagaaatgtgtaagccaaagatctggggataagggaaccttgattgttcaaatgagggagtatggccagttccactttcttccatgatagaagaaagaacttagagtattctccacactactttccctg

SEQ ID NO: 36770 - DNA, 330 bp, Homo sapiens
accctttcttcaaccctcttctaaggaaagcagaagtcccctttgggtaccagctgtgtggcataaccatggctccttgtccctgacagatgacaccttcctttagaatccaccagcatcatccactctgcgtctagctgacaccctcagacagggatcagccaccctggggcgtgcaggtcaaatatgcagatggggactttgcagaccacttcagtgtcacgctggcacatcatttttgatcctttttcctttttaaacttcctgcaccttttcagataaaatcatattttactatgtatagctaataaatcgtagttttgttctctt

SEQ ID NO: 36771 - DNA, 413 bp, Homo sapiens
aatctgagaactcaacctggctttgaacacagaagaaggaaactttgaacacagaagaaggaatccaggaatgtgagcagcctcagaaagccaaaaaaggtccctggtagcaggaaccaggcttcacccttcattgcgtttaaagagaccatgtagaaaagtgattatggccagcgactctgaagccaaactgcctgggttcaaatctcagctttgccattgacttactagctctgtaaccttggacaatctacttagtttctctgtgctccagtttccccatgtgtaaaatagacaggatctggctctgttgtccaggctggagtgcagtggcgccatcatagctcactgtacccttgaactcctaagctcaagtgatcgtcctgcctctgccttctgagtagctggggcta

SEQ ID NO: 36772 - DNA, 673 bp, Homo sapiens
caggagaatcgcttgaatctgggaggcggaggttgcagtgagctgagatcgcaccactgcactccagcctgttgacagcgagattccatctcaaaaaaaaaaaaaaaaaaaagcagtatgttgtcttcagaaggcctgacactgggaccagaatgcaggcagccacttgttgagcctgcctgggctcttggccttgcttttcttattgcacaccagctgcttttctcacctttctggagtaatacaaatatcccaagaagatactacctcccatgtgcagtgccaaagtctgaccagcctctcctcaacctggtctttggcttccacccttgcgagagactcagttcagtttttatcagatccctgcctatggattatagagtactgcctcagttatgaataaagtggcatttgtttctcatttaggtagtgttttcctgttcatagctgttgggaccctgtgagtagagatgtgatgtgtggtaggacaggaattgggcatttcagggttcctctacagtactatgaccttcagaccctcatcttgatttctcattggtgtcagttccaccattatgggtggcctgagcagtgctgtggtgcagtcagccttagtgacaaggattccaaaatcacaagtaacagctccagatgctggtagcagagactcagc

SEQ ID NO: 36773 - DNA, 410 bp, Homo sapiens
caacatatgatctgatcctgatgcttttgctctctaaattggatatatcatccatactttgtaatatagaatatgtgactacgaaaactctggtaggctgggcgcagtggctcacacctgtaatcccagcactttaggaggccaaggtgggcggatcacttgaggccaggagtttgagaccagcctggccaacacggtgaaaccacgtctctactaaaaatacaaaaattagctgggcatggtggtgcacgcctgtaatcccagctacctgggaggctgaggccatagaatcacttgaaccctggaggtggaggttgcagtgagcagagatagtgccactgcactccagcctgtgtaacagagtgagattctgtctcaaaaaaaaaaaataaagaaagaaagaaagaaac

SEQ ID NO: 36774 - DNA, 393 bp, Homo sapiens
tgattcatttggagaagtttgaatttgaaaagtttttttccttgcttgttatggctttggtttactaaaaactagaatctcctgcttagaggttatgggcaaattaattggtgaagatagtagaaagacacttggatcacagttgctatctgttggcattttaaggaagactgccaatgatagacagtagacacacatcacatgtattgtgaattgccattccagcttaaaaatacctcttaaaatgtggttgaaacttaaaatagggtaggataactgcatgtggtggcccatgcctggaataccaatactttgggaggccaaggcaggaggatcgcttgagcccaggagtttgagaccatcctcagcaacatagtgagacacccatttcta

SEQ ID NO: 36775 - DNA, 402 bp, Homo sapiens
gatacatgccattatacatttttcaaaccccatagaaagtacaacaagagtgaaccctaatgtaagttatagactttgggtgataatgataccccaatgtagattcatcagtcctaacaaatatgccactctggtgtgggattttgatagcgggggaggctctgcatatttggggggtaaagtgttctatgggaaatttgtatactacactcagtttttctaacaacctctaaaactaagaagtaaaatctattttttaaaaggtacatgttcaaaaataaatcatcatgtggtagttatgtatttataatagtcctttcctccttttctctcttaattgctctttcacttctatccttcctccaacctcttatttttccactgtgcccttagtgctttgct

SEQ ID NO: 36776 - DNA, 369 bp, Homo sapiens
tttttttttgagacagagtctcactctgttgctcaggctacagtgcagtggcacgatcacagctcactgtatcctccaactactgggcccaagcaatcctcccacctcagccctgagtagctgggactataggtgtgtaccaccacacccaactattttttgctttttgtagagacggggtctccctgccttgtccaggctggtcttgaactcctgggctcaagcaatccttctgcctcagtctctcaaagtgctagggttacaggcacatatcaccgtgcccggccagatgccttctcttataattgatagaacaagtagacaaaatcagtaaggatataaaagggttgaacgttatcaatcaacttg

SEQ ID NO: 36777 - DNA, 3614 bp, Homo sapiens
atttaggctaggtacgatggctggtggtgatcggccgaggccgggtctcctggcggcggcggagtgaggctgacagcggggaacctgggagacccctccgccctccccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggcccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatgg

SEQ ID NO: 36778 - DNA, 3718 bp, Homo sapiens
cccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcggtggcagcggccgatccccggctccggcgcgagggacggccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggcccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatgg

SEQ ID NO: 36779 - DNA, 3674 bp, Homo sapiens
cccaagccgccattgttccgccgagggaggacagcggggcctggcgctggcgccgagacgccgcttagcggccgccactggagacactccctcccgcctcccgggtctcctggcggcggcggagtgaggctgacagcggggaacctgggagacccctccgccctccccgcgatgcgctcggcctgaggttacccggcccggcccttcctcgcttccctcgactattccactgcgtctccgcgccccggcgtcatcctgcgagtccctctgacgggagggaagatggctgcacggagctggcaggacgagctggcccagcaggccgaggagggctcggcccggctgcgggaaatgctctcggtcggcctaggctttctgcgcaccgagctgggcctcgacctggggctggagccgaaacggtaccccggctgggtgatcctggtgggcactggcgcgctcgggctgctgctgctgtttctgctgggctacggctgggccgcggcttgcgccggcgcccgcaaaaagcggaggagcccgccccgcaagcgggaggaggcggcggccgtgccggccgcggcccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatgg

SEQ ID NO: 36780 - DNA, 3126 bp, Homo sapiens
ccccgcaagcgaggaggcgcggctagccggccccgacgacctggccttgctgaagaatctccggagcgaggaacagaagaagaagaaccggaagaaactgtccgagaagcccaaaccaaatgggcggactgttgaagtggctgagggtgaagctgttcgaacacctcaaagtgtaacagcaaagcagccaccagagattgacaagaaaaatgaaaagtcaaagaaaaataagaagaaatcaaagtcagatgctaaagcagtgcaaaacagttcacgccatgatggaaaggaagttgatgaaggagcctgggaaactaaaattagtcacagagagaaacgacagcagcgtaaacgtgataaggtgctgactgattctggttcattggattcaactatccctgggatagaaaataccatcacagttaccaccgagcaacttacaaccgcatcatttcctgttggttccaagaagaataaaggtgattctcatctaaatgttcaagttagcaactttaaatctggaaaaggagattctacacttcaggtttcttcaggattgaatgaaaacctcactgtcaatggaggaggctggaatgaaaagtctgtaaaactctcctcacagatcagtgcaggtgaggagaagtggaactccgtttcacctgcttctgcaggaaagaggaaaactgagccatctgcctggagtcaagacactggagatgctaatacaaatggaaaagactggggaaggagttggagtgaccgttcaatattttctggcattgggtctactgctgagccagtttctcagtctaccacttctgattatcagtgggatgttagccgtaatcaaccctatatcgatgatgaatggtctgggttaaatggtctgtcttctgctgatcccaactctgattggaatgcaccagcagaagagtggggcaattgggtagacgaagaaagagcttcacttctaaagtcccaggaaccaattcctgatgatcaaaaggtctcagatgatgataaagaaaagggagagggagctcttccaactgggaaatccaaaaagaaaaaaaagaaaaagaagaagcaaggtgaagataactctactgcacaggacacagaagaattagaaaaagagattagagaagaccttccagtgaatacctctaaaacccgtccaaaacaggaaaaagctttttccttgaagaccataagcactagtgatccagccgaagtactcgtcaaaaatagccagcctatcaagactcttccacctgctacttctaccgagccatctgtaatcttatcaaaaagtgattctgacaagagctcttcccaagtgccgccaatactacaagagacagataaatccaagtcaaataccaagcaaaatagtgtgcctccttcacagaccaagtctgaaactagctgggaatctcccaaacaaataaaaaagaagaaaaaagccagacgagaaacgtgaaattttttttcctgaattggacatgtgtttgcaaacacttgtcttgaagattatgctgtttatgcaataatttgtgaacatgtacagagttttatataaatttaaaccaatttttaaaacaaaactgcggacaccaccataaaaatggaatcaaaagaaagttaatttatgaaattaagaggtcagcagaatatactcagtgatggaagacacttgggaaagtctttttaatagaacaagaacgatcttaatttaagaatattatcctggtttaacaacagtgccctgtttacaacagattgtgccctatctcatctgcagccgaggaataaaggattctgattagaaagagggttgcctacagattagtaagcaattccttggatcttatgcacagaacttgtaccatttgaatctgttttatgcttaaatcaaagtgctttgatcaaatgcataacctgccatatctttacatatttgttggtagcaatttgtattaaagaaatcacaagtgcaaataaaaagtcatttatcatttgtttaactaaactgtcatggtttagtttacaatttttaaaaagttcttaaaatactgaaaatgcagttgacacttgtgtatggcttatgaagttatttttgatagtcttacattacttgaattgttcaaagtacagtatattttaaattaagaaaagtgaactatatgtatttgttttatacatttaaggcttagactcataaataatgctattgtttatgatttgaaaactttcaggcaaaatccaatttacatttttcccttccctagcaattacttttttccagcttcaactcttcttagttactaatactttgttgactttaaaaatgaaatcattcacaaacttttggtatatgatggagaatgaaaaactagagtcagacagctttaattgacattgtcaacacctccagttatcaggaatacatttttttactgccttaacctgtagtgcgtagaatatgcatcaatttcttgaaggagattcatgtttttataagaattttcatgtaattattgcaattgtggtcaaataaggaacgtttcctgcttgaaattatattgatttaaatgatgtgtgagatgtttcaccattttcaggcactgtgtaattctattgtaataaactggcaggtatctttgtaactataaatagtgcatgctcagccatgtacactgtaaatagcctttaccaaacgtgtttgacaaggaccataattaacatcacttagtgaattgtgataaagaaaaaaaagccatgatttattcgatgtgattggcttgtttttatgtggcgccaagaacgaacctgtttaacagctgtaaccaatggtactgatctatccatccaatgttgtcattatatttgactgtggttcaacagtattgcgttgtcagactaggaaagctaaacgaacaaaatggttttagttttgctgaagactggccttattaatggacagctttcctaacaagagattattaacttttatcaggtgttaacatctgtttcaggaacatggcagtatgtttacatgtcagaagttttgtttaattctatggtatttctaaattgacttgtttaaataaattcagcaaatgg

SEQ ID NO: 36781 - DNA, 3247 bp, Homo sapiens
gaattccgggaagccagacggttaacacagacaaagtgctgccgtgacactcggccctccagtgttgcggagaggcaagagcagcgaccgcgcacctgtccgcccggagctgggacgcgcgcccgggcggccggacgaagcgaggagggaccgccgaggctgcccccaagtgtaactccagcactgtgaggtttcagggattggcagaggggaccaaggggacatgaaaatggacatggaggatgcggatatgactctgtggacagaggctgagtttgaagagaagtgtacatacattgtgaacgaccacccctgggattctggtgctgatggcggtacttcggttcaggcggaggcatccttaccaaggaatctgcttttcaagtatgccaccaacagtgaagaggttattggagtgatgagtaaagaatacataccaaagggcacacgttttggacccctaataggtgaaatctacaccaatgacacagttcctaagaacgccaacaggaaatatttttggaggatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcacacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtccacctgagagtgcacagtggagaacggcctttcaaatgtcagacttgcaacaagggctttactcagctcgcccacctgcagaaacactacctggtacacacgggagaaaagccacatgaatgccaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccaaaatatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaaaaaagtttacaatgactggaaagattccttgtaatttgagtataaatgtatttttgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtaca

SEQ ID NO: 36782 - DNA, 3193 bp, Homo sapiens
gaattccgggaagccagacggttaacacagacaaagtgctgccgtgacactcggccctccagtgttgcggagaggcaagagcagcgaccgcgcacctgtccgcccggagctgggacgcgcgcccgggcggccggacgaagcgaggagggaccgccgaggctgcccccaagtgtaactccagcactgtgaggtttcagggattggcagaggggaccaaggggacatgaaaatggacatggaggatgcggatatgactctgtggacagaggctgagtttgaagagaagtgtacatacattgtgaacgaccacccctgggattctggtgctgatggcggtacttcggttcaggcggaggcatccttaccaaggaatctgcttttcaagtatgccaccaacagtgaagaggttattggagtgatgagtaaagaatacataccaaagggcacacgttttggacccctaataggtgaaatctacaccaatgacacagttcctaagaacgccaacaggaaatatttttggaggatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcacacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtccacctgagagtgcacagtggagaacggcctttcaaatgtcagacttgcaacaagggctttactcagctcgcccacctgcagaaacactacctggtacacacgggagaaaagccacatgaatgccaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccaaaatatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaatgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtaca

SEQ ID NO: 36783 - DNA, 2902 bp, Homo sapiens
ctgtttccgccctgatttctgctgattcaagactattctggctaaactgattggattctttttctaactaggcagtaggggatcagaaatcacacacggtaccggctgtgtttattctgagaggtgctggggagctttgggtctgacttccttttacatgcctgtcttctcttttggacagatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctgccaaccaggaacttcttgtgtggtattgtcgggactttgcagaaaggcttcactacccttatcccggagagctgacaatgatgaatctcacacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgggtcgtttaccccatccgggcccctctgccagaagactttttgaaagcttccctggcctacgggatcgagagacccacgtacatcactcgctcccccattccatcctccaccactccaagcccctctgcaagaagcagccccgaccaaagcctcaagagctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtccacctgagagtgcacagtggagaacggcctttcaaatgtcagacttgcaacaagggctttactcagctcgcccacctgcagaaacactacctggtacacacgggagaaaagccacatgaatgccaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccaaaatatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaaaaaagtttacaatgactggaaagattccttgtaatttgagtataaatgtatttttgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtaca

SEQ ID NO: 36784 - DNA, 2774 bp, Homo sapiens
gaattccgggaagccagacggttaacacagacaaagtgctgccgtgacactcggccctccagtgttgcggagaggcaagagcagcgaccgcgcacctgtccgcccggagctgggacgcgcgcccgggcggccggacgaagcgaggagggaccgccgaggctgcccccaagtgtaactccagcactgtgaggtttcagggattggcagaggggaccaaggggacatgaaaatggacatggaggatgcggatatgactctgtggacagaggctgagtttgaagagaagtgtacatacattgtgaacgaccacccctgggattctggtgctgatggcggtacttcggttcaggcggaggcatccttaccaaggaatctgcttttcaagtatgccaccaacagtgaagaggttattggagtgatgagtaaagaatacataccaaagggcacacgttttggacccctaataggtgaaatctacaccaatgacacagttcctaagaacgccaacaggaaatatttttggaggatctattccagaggggagcttcaccacttcattgacggctttaatgaagagaaaagcaactggatgcgctatgtgaatccagcacactctccccgggagcaaaacctggctgcgtgtcagaacgggatgaacatctacttctacaccattaagcccatccctctccagccctcacagcagccctgggaatacggtgtcccctgtgggccccggctctcaagagcaccgggactcctacgcttacttgaacgcgtcctacggcacggaaggtttgggctcctaccctggctacgcacccctgccccacctcccgccagctttcatcccctcgtacaacgctcactaccccaagttcctcttgcccccctacggcatgaattgtaatggcctgagcgctgtgagcagcatgaatggcatcaacaactttggcctcttcccgaggctgtgccctgtctacagcaatctcctcggtgggggcagcctgccccaccccatgctcaaccccacttctctcccgagctcgctgccctcagatggagcccggaggttgctccagccggagcatcccagggaggtgcttgtcccggcgccccacagtgccttctcctttaccggggccgccgccagcatgaaggacaaggcctgtagccccacaagcgggtctcccacggcgggaacagccgccacggcagaacatgtggtgcagcccaaagctacctcagcagcgatggcagcccccagcagcgacgaagccatgaatctcattaaaaacaaaagaaacatgaccggctacaagacccttccctacccgctgaagaagcagaacggcaagatcaagtacgaatgcaacgtttgcgccaagactttcggccagctctccaatctgaaggtccacctgagagtgcacagtggagaacggcctttcaaatgtcagacttgcaacaagggctttactcagctcgcccacctgcagaaacactacctggtacacacgggagaaaagccacatgaatgccaggtctgccacaagagatttagcagcaccagcaatctcaagacccacctgcgactccattctggagagaaaccataccaatgcaaggtgtgccctgccaagttcacccagtttgtgcacctgaaactgcacaagcgtctgcacacccgggagcggccccacaagtgctcccagtgccacaagaactacatccatctctgtagcctcaaggttcacctgaaagggaactgcgctgcggccccggcgcctgggctgcccttggaagatctgacccgaatcaatgaagaaatcgagaagtttgacatcagtgacaatgctgaccggctcgaggacgtggaggatgacatcagtgtgatctctgtagtggagaaggaaattctggccgtggtcagaaaagagaaagaagaaactggcctgaaagtgtctttgcaaagaaacatggggaatggactcctctcctcagggtgcagcctttatgagtcatcagatctacccctcatgaagttgcctcccagcaacccactacctctggtacctgtaaaggtcaaacaagaaacagttgaaccaatggatccttaagattttcagaaaacacttattttgtttcttaagttatgacttggtgagtcagggtgcctgtaggaagtggcttgtacataatcccagctctgcaaagctctctcgacagcaaatggtttcccctcacctctggaattaaagaaggaactccaaagttactgaaatctcagggcatgaacaaggcaaaggccaaaatatatatatatatatatatatatctgtatacatattatatatacttatttacacctgtgtctatatatttgcccctgtgtattttgaatatttgtgtggacatgtttgcatagccttcccattactaagactattacctagtcataattattttttcaatgataatccttcataatttattatacaatttatcattcagaaagcaataattaaaaaagtttacaatgactggaaagattccttgtaatttgagtataaatgtatttttgtcttgtggccattctttgtagataatttctgcacatctgtataagtacctaagatttagttaaacaaatatatgacttcagtcaacctctctctctaataatggtttgaaaatgaggtttgggtaattgccaatgttggacagttgatgtgttcattcctgggatcctatcatttgaacagcattgtaca

SEQ ID NO: 36785 - DNA, 405 bp, Homo sapiens
tcctgtgttttttcctgtttaggttattggagtgatgagtaaagaatacataccaaagggcacacgttttggacccctaataggtgaaatctacaccaatgacacagttcctaagaacgccaacaggaaatatttttggagggtaagtaagggaaatttcttcagacccattaaatgttaggaaaaaatggagctaaaagagctgggtggctcacctttctcatcctgtgctgagaaatgctggggctcacccataagtatccagcatccccatggacacagggaattctgaacaaatgtgatgaaaccgatgaaatgtctggcctgtaggtggttagtgatggagatacgggctatatgtgaatcttgatttttgcaattcattagagctttgtaatgaaagga

SEQ ID NO: 36786 - DNA, 407 bp, Homo sapiens
gaactgcacttttgagtgagtggcccagagccttctagaatgagagtgcgttggaagccagatatgtggcgattgtgtcgccagctgttactcaggttttctcaagaaggaggagcaactttggcagttttgcttcagttctctctagccctctgtgtaatcgcccctttttctttatttcagcacaaacacagagcagtctaaagcaaccgagcactgagaaaaatgaactctgcccaaagaatgtcccaaagagagagtacagcgtgaaagaaatcctaaaattggactccaacccctccaaaggaaaggacctctaccgttctaacatttcacccctcacatcagaaaaggacctcgatgactttagaagacgtgggagccccgaaatgcccttctaccctcgg

SEQ ID NO: 36787 - DNA, 3368 bp, Homo sapiens
aacaaatatgaatattgttacatcacctctgactctctgactagtaagaaactatgcatttccatacccaatgaaacctcaattcctacagcaattctacttttattgcctcccaagaactatttcttcatggtcaatatcactctttaaaagctagcaaaatatgactttcttctgaggtttgggcaatctggatcaatatttatgtatctaaccacttgaaaggctgtctccttttttggccttttaaattaaaacttccataaaatgaagcaaaatatgaaaacagctagttgatttatcaataatgtgaaaccctccttctgaatttttttggtaaaaattaccacactgaaaccaaaacttaaccttggcttggactctcagataaattgcttttgtattctttgactacaaagtattctcaaaaagaagaaattatttctgatggtagatcaaactctagccaagaaggtctagataaactagaggactgtataattatctaaagtaattcagggggacttttagaaaaattctttaatttttgttcctgtgtaaaaattattattaatggatggcagcccaaattactattcttcttttaaaatttgtttcaagtgtgtcaccaggcactcataaaattcatttatttgttatataactcaatgacctgaaataataggtgctcattgctttttcatttgatccttaaaaacaattttattctgtctaaaaaaaattctcctgctaaaatccaaatgattacctggctataggaggagtcccattttatgaacatgtatgaaatatttagttggattcagatgaaatgcaacttagagaaaggaatggataccagtagagaagatggaaagagacacaaaaatcagactttgcttacatcaaaattaggtctgttgtctaatcctgttaacctagaggcaagctgaaaatagatggtaaggataaatagatttttaaacacagtatttatatttaacagaatgtcataaaaatgacagaatgccatgaaattcagcatgtcaaaactttgataaaacaaacaagaaatttaataaatatgctaattagagtgaatatttaaagggacaaaaataacttgtcacatcatagatgtctccccagtgcagaatttattatctgctgggaaaatttggttttatgtcttcaatcaatatttgctgcattatctaattaaacattagtatattttttgtgctaatgagaaaccatgcaagagtccaaatatcaagtgtggtgacagcttgaatcagttgagtttggtgttcatgaataaaattcttgatgaatgtgaaatgaatggtttatatacataagttttatgtgcagtaaattaattaggctttaaaacttgttagcatgcttagctcctcttttttccattgaattatcttcctatcttccttccttccttcctttccttcctttccttccctccctctttgctttatttctttctagctcttataagataaatgacaatagtactttactatttgggctggagcctccctttttcactttcacatgattgaacactttgtggatttgtgagaaaaggggaaagaagatgagcacgtagatgcagatcagttgaggatagaagtgactgagagaattgggaccttgacttccagagactgtcagtcaagagaaatgtgggtctataaaaatctatgtgtgttcattttcattgaatttaaacactttttcaagaagtatcagggtcaatctgtttggacaatctcctatttttacccccttacaaatgtcttaagttagaaaaacctcttattttcaagtagtcatttttttttatgtgagtaccacactgctaaagactgaaatagaaaaaaaaaatgctttttctgtttgtagggaaattgctttctgaaaactactcccaataagatgtatacatcaaatgcaacttgattttactggctctttatctagagataactgatgcactgtcttctttcttagatacccttctgtaattcagcttggcatagtatgatgttttgagttcttattgagggtttggaaacatttgtcatcaattttatgtctactctattgaaaaagcaatatacaatgtattccatatttcttagctctgtgtctttgaggttttaaacctatattcagatagctgtttttagctacaattttgagtattcaccagaatttacaaattgccattttattaaatacaaaaaaaaaaaagtacagcttggatcaagagatcaaacatttacaaatctcaatccaaagccattatttttcagggaaaattaaatcatttctagcagagtatttgactcctaagggaaaataagtcaaatatcttctttaagagtaagggcattcttccattgtaggtatttctaattgactttataataatttgaacaaatcttgaacaagatttaaagaatttataatctcccaaacttaaaattgtattctttctggttttttatttttatgtattaagattatattcaaaccacttaattatcttcatgacataagtttgtgttaatagaaaattatacagaaaaaaacatgatttgttcctctgtggaaagatatgcttcaatgagttaaatacccttgaattttggttctcatttcttatttggacttttctgttatgtacctcaggggtcttaaattctaacagatgaagtagtcaaaggggtataaaatacttgaaaaaaattaaaacttcaaaagggacgaatttctctgttaacttttgtttatcctatactgacttattttgaaattgtgaaaaaacaggcagctaccatataaattggtatctatgaaaatactgattactttcttcctgtgattttcactgttaagaaaacctttgtcttgaaatgatggacaatcttaatacttgttcagataaagaaatgtgactttcaatacctttaccatttgtatttctttagggaaatattttaataatgattgtaaaaatagaagaaatatggttgagaaaaatagaagaaattaagatgaaatttgaacagttgtaatccacagtcccatttttccctctattttattgccttctactaagttattgaaggcccagatctgcaaaatttacaagctactaattcattgtctcctttaagaatttggagcaaaaattattccgactatgcggaaatgaattcacatcatcatggcaggttttgactatgagggaattcaggttaggttcaaatagaataatggtccatggagaaaaatactttctgatttttcttcaagttggatggaaaggtttttctttattt

SEQ ID NO: 36788 - DNA, 2152 bp, Homo sapiens
aacaaatatgaatattgttacatcacctctgactctctgactagtaagaaactatgcatttccatacccaatgaaacctcaattcctacagcaattctacttttattgcctcccaagaactatttcttcatggtcaatatcactctttaaaagctagcaaaatatgactttcttctgaggtttgggcaatctggatcaatatttatgtatctaaccacttgaaaggctgtctccttttttggccttttaaattaaaacttccataaaatgaagcaaaatatgaaaacagctagttgatttatcaataatgtgaaaccctccttctgaatttttttggtaaaaattaccacactgaaaccaaaacttaaccttggcttggactctcagataaattgcttttgtattctttgactacaaagtattctcaaaaagaagaaattatttctgatggtagatcaaactctagccaagaaggtctagataaactagaggactgtataattatctaaagtaattcagggggacttttagaaaaattctttaatttttgttcctgtgtaaaaattattattaatggatggcagcccaaattactattcttcttttaaaatttgtttcaagtgtgtcaccaggcactcataaaattcatttatttgttatataactcaatgacctgaaataataggtgctcattgctttttcatttgatccttaaaaacaattttattctgtctaaaaaaaattctcctgctaaaatccaaatgattacctggctataggaggagtcccattttatgaacatgtatgaaatatttagttggattcagatgaaatgcaacttagagaaaggaatggataccagtagagaagatggaaagagacacaaaaatcagactttgcttacatcaaaattaggtctgttgtctaatcctgttaacctagaggcaagctgaaaatagatggtaaggataaatagatttttaaacacagtatttatatttaacagaatgtcataaaaatgacagaatgccatgaaattcagcatgtcaaaactttgataaaacaaacaagaaatttaataaatatgctaattagagtgaatatttaaagggacaaaaataacttgtcacatcatagatgtctccccagtgcagaatttattatctgctgggaaaatttggttttatgtcttcaatcaatatttgctgcattatctaattaaacattagtatattttttgtgctaatgagaaaccatgcaagagtccaaatatcaagtgtggtgacagcttgaatcagttgagtttggtgttcatgaataaaattcttgatgaatgtgaaatgaatggtttatatacataagttttatgtgcagtaaattaattaggctttaaaacttgttagcatgcttagctcctcttttttccattgaattatcttcctatcttccttccttccttcctttccttcctttccttccctccctctttgctttatttctttctagctcttataagataaatgacaatagtactttactatttgggctggagcctccctttttcactttcacatgattgaacactttgtggatttgtgagaaaaggggaaagaagatgagcacgtagatgcagatcagttgaggatagaagtgactgagagaattgggaccttgacttccagagactgtcagtcaagagaaatgtgggtctataaaaatctatgtgtgttcattttcattgaatttaaacactttttcaagaagtatcagggtcaatctgtttggacaatctcctatttttacccccttacaaatgtcttaagttagaaaaacctcttattttcaagtagtcatttttttttatgtgagtaccacactgctaaagactgaaatagaaaaaaaaaatgctttttctgtttgtagggaaattgctttctgaaaactactcccaataagatgtatacatcaaatgcaacttgattttactggctctttatctagagataactgatgcactgtcttctttcttagatacccttctgtaattcagcttggcatagtatgatgttttgagttcttattgagggtttggaaacatttgtcatcaattttatgtctttagcagtgtggtgtcgacgcggccggcaattta

SEQ ID NO: 36789 - DNA, 451 bp, Homo sapiens
ctagttacaaagcggtttcactttgtaaatgctctttggatggcaggaaccaagcagccatgaaaagaggagttacacctttaaaggagtcattccatcatgactctcaggactggaacatggaatacctgaatggcctctttggcacagataggccacccttgaaaggtgttccaagctaggaactcactaccactgttacatcgatgcaactctgtgagaagtttttatctggtgatggaaaatctcatctcttcaacacactgactactaccagtctcagaaccctgtaaacaagattcattcatctcaaattgggttaaagcagtcaccctgccttacattagtttggaataaggatgtggggatggtggtagaggaggggagtggatgatgatttttttattgttatttgattctaaagaaacttctatacattttgcatttaaaa

SEQ ID NO: 36790 - DNA, 373 bp, Homo sapiens
aagagaccttcactactacttccctgctttcacagcaggtgtcctggtggtacaaaccccaggtatgaagctgcaaggagggacccagttccaggacaccaagaacacccagctactcagcaatctccttccaccgtggacctcggcacatgaacacagcacaggcacccaacgattccgccaaggcctgcaggagtgttgtgcctggtccaacccagagtgtcaacaagcatgtctttcccaacattgttacaaagtgcaaggatagagtctcccaagtgtgcggctcctttcacctaccttgtctcctgggatcctcataacagccctgtgaggtgggaaagggggctattcttaaccccatttgagagat

SEQ ID NO: 36791 - DNA, 532 bp, Homo sapiens
tgtagctgcaattatgcttgtaaattttttgtctacttatgtaaacattttcacaggtttgtagctaatagaagaaaacaaagaatctgttcacctatttatgtaagtgaaagtgtaaatttaaaaatacatttagtcctgctgttaataacccttccattcttttttactttccctcagaccatatattgtgattatagtttctgctgaggaggatggaaactcaactccctttgaataatattagtaattctacttgatgttcagaaccggattgcaagagagtttaaagtgcccaacaccccttgtgggaaactttttagtatcttaagtgcatggaactactgctgcagccacaccgcctgaagcttcagccacactgaaacttcataacaaaacttaccctcttttttcctaatttctgtggtcattgcaatttgagcatgttactttgtttaacaaaaactcatttcttaaagattattttagtattgctgtacaaacagaataaaattatggcattattcagtga

SEQ ID NO: 36792 - DNA, 322 bp, Homo sapiens
gcctcccaaagcgctggtattacaggtgtgagccaccaagcccagcccaaggacttttttttttttggtaggtatgtctgcctgtttgttgggtatatcctattagggatgtacagtcagttaccctgttttaaagttgtgaaacaattctctagtggcgcatgcttgccaattggatatcactaagtttatttcattttgcattcaacctttaggcattagtgttgtttacctttttaatgtaagataattcgcatgattttaaggtcagatgtacaaaaccaggtataatcagaaatgtggggctttgacccgtcttctc

SEQ ID NO: 36793 - DNA, 439 bp, Homo sapiens
taatagataataatgatagcagtaatgtttgtcaagcattgtctataggccaggcactgttttattaactttacaagtattaattcacttaattcttataaagtcctctgaaacaggttctattattatctttattttacagatgaggaaactaaggcacagagagtttaagcaactcgctcagagtttgacagctaccaagcagcagagttgggacttgaacccaggccctgcagtctgactgcaaagccggtctcttctctgtcactatcttcacctatctctttgcctctctaggacccaacactgtgactcccaaaacattgcttaatctgggatatcatagactcaaaaattttaaaaacattttggagaattatatcaggttatcatttaaaaatttttgatgaataccccttattcttactatcctttcata

SEQ ID NO: 36794 - DNA, 403 bp, Homo sapiens
gtttgagggcaaccatggcattggaaagtgaggggggaattgtggaaagtagaaaacagaccccaaactctgggtgtcagctacctaaatctctgctaatggctgaatcacacgtgtggggcaggctccaggcagctaagctaaggatgaagtcattgtattgagatttgagctcccaccctagagtttatagtattaagtccaacttacactgtagataattaataattgccctctaaaaaaaaaaatcaacactctttagaggaatataatataatccagaattgccacagcataatgtatcctgtaatgtccaggatacagtttacaattgcttgacgttcaggaaaatgtgacctgttctcaattgaaaagatgatcagcggagactgactgtgagagg

SEQ ID NO: 36795 - DNA, 783 bp, Homo sapiens
cagctacattgtgtcagggcaaggtgaatgcctggccatgcctatagatgctacacagcctggagcagagttaaaggaaaccaacatggaaccttggcaatggagacagtaggactttccaattgatgatgactcatgttactctcacaaggtaaattgccaaaccacatcacccttatcagtcaaatgtatggggtctccaagaaatgaaaagccctatgcccacatcatccctccaggcacttggactttccctttacgtgggctaaaggggtcacttggatggaggccataaagctggtgaaatttagcaggacccttccaagtcacatcagcacctccagctatcagggaaagaaaatgaaaagtagatttctgtctgtggatcttatttgagagatgaggggcagacattctggcatcagaagagtaagagctctggatttcaagagttaaactcataatctcataccaggagactgtcctgagctcaaacctgtctcctgcaagcctcctcctttccccagagagttgtgatcaggattaaaggagagaattaaccaaaaaaaaaaaaaaaagatattttaggtaaatcattagcaatatgctgcttcttgctagagcctgcttccccaaattatatattcgatatgtgcttgggtagatgtcagtgccaatgcaggtgcagggaaggtgctccaacacacataaaaaagaaaagtcaccctttattccttcttattgcagactgtaaaatatttctcaactacacttgttataatg

SEQ ID NO: 36796 - DNA, 5612 bp, Homo sapiens
ggagtgggccaggccgccagccccgccagccccgccagccccgccagccccgcgatggcttgggccgcgctcctcggcctcctggccgcactgttgctgctgctgctactgagccgccgccgcacgcggcgacctggtgagcctcccctggacctgggcagcatcccctggttggggtatgccttggactttggaaaagatgctgccagcttcctcacgaggatgaaggagaagcacggtgacatctttactatactggttgggggcaggtatgtcaccgttctcctggacccacactcctacgacgcggtggtgtgggagcctcgcaccaggctcgacttccatgcctatgccatcttcctcatggagaggatttttgatgtgcagcttccacattacagccccagtgatgaaaaggccaggatgaaactgactcttctccacagagagctccaggcactcacagaagccatgtataccaacctccatgcagtgctgttgggcgatgctacagaagcaggcagtggctggcacgagatgggtctcctcgacttctcctacagcttcctgctcagagccggctacctgactctttacggaattgaggcgctgccacgcacccatgaaagccaggcccaggaccgcgtccactcagctgatgtcttccacacctttcgccagctcgaccggctgctccccaaactggcccgtggctccctgtcagtgggggacaaggaccacatgtgcagtgtcaaaagtcgcctgtggaagctgctatccccagccaggctggccaggcgggcccaccggagcaaatggctggagagttacctgctgcacctggaggagatgggtgtgtcagaggagatgcaggcacgggccctggtgctgcagctgtgggccacacaggggaatatgggtcccgctgccttctggctcctgctcttccttctcaagaatcctgaagccctggctgctgtccgcggagagctcgagagtatcctttggcaagcggagcagcctgtctcgcagacgaccactctcccacagaaggttctagacagcacacctgtgcttgatagcgtgctgagtgagagcctcaggcttacagctgcccccttcatcacccgcgaggttgtggtggacctggccatgcccatggcagacgggcgagaattcaacctgcgacgtggtgaccgcctcctcctcttccccttcctgagcccccagagagacccagaaatctacacagacccagaggtatttaaatacaaccgattcctgaaccctgacggatcagagaagaaagacttttacaaggatgggaaacggctgaagaattacaacatgccctggggggcggggcacaatcactgcctggggaggagttatgcggtcaacagcatcaaacaatttgtgttccttgtgctggtgcacttggacttggagctgatcaacgcagatgtggagatccctgagtttgacctcagcaggtacggcttcggtctgatgcagccggaacacgacgtgcccgtccgctaccgcatccgcccatgacacagggagcagatggatccacgtgctcgcctctgcccagcctgccccagcctgccccagcctcccagctttctgtgtgcacagttggcccgggtgcaggtgctagcattaccacttccctgcttttctcccagaaggctgggtccaggggagggaaaagctaagagggtgaacaaagaaaagacattgaaagctctatggattatccactgcaaagttttctttccaaaatcaggctttgtctgctcccaattcacctcgttactctcacctcgtgatatccacaaatgctattcagataaggcagaactaggagtcttcactgctctgcccccaactcccggaggtgtcaccttcctagttcttatgagctagcatggcccgggccttatccagtcaaagcggatgctggccacagaaaggccactcaggatgtcctttgtgtccattgatgtcattcagcagtcagtcccccaataatccttaaactagctaaaaccaaaggagtcccttagaagatctgcttccctggggccccatttgccagattgccccattgctcacactacttgagaaaatgcaggagagcttcccccaaggctgatgcattcccggtgcagaacaggggcaccctccaaacactgggctctgaggagtggagttctctgttctagagtgacaggcaccagatgggatgggctttctcagtgtcagcactcaggtagggagctaaggaagacacagcccagacaagatggctggaaggagccagccaggactccttagactgatcaagccaaaaaagaaggtgccgatttcatgcattctagtgcagaagccccaactgtgatcacgatccagtctgcagacgtgttttgtttggacttcacttaaaaaaatgccttagttgttatcatctttgggagagttcattcaaaatgtccagcttctcttgaaaacttggtatatctggccacactgggctcacattcccaagggtaactcttggccagagctgagtggcagccgcctcccttatgcaggacatgtgctctcggcttcaccagggttctgaccgggtctgcttctgcattcacagcgcctcctggacctgaaggcatctgagtgtgagaccctgttctaactcttagaagtgacattgtaagaggtggtggggaccagctaattggtccaacccagcctgagtgcaccaccctttgaacaaatgtatcagtgatgaaaatttgcctttgccccggcttgcctgtaatcccagcactttgggaggccgaggtgggcggatcacttgaggtcgggagttcaagaccagcctggccaacatggcgaaaccccgtctctactaaacataaaaaaattagtcaggtgtggcggtgcgtgcctgtaatcccagctattcaggaggctgaggcaccagaattgcttgaacccaggaggtggaggttgcagtgaactgagactgcgccacggcactccagcctgggcgacagagcaagactctgtctcaataaataaataattaattaaaataaaaaacagcttaaagagaaaaatggcctgcaaaccttttttatgatgctatttttattaatataaagtcctgtttattgagaccctttaaatgcctgcgagagaccctacagacagtatgtctactcctcacagcatctctatgaagagaaggagggttgtgcccacttcatagatgagaaaactgagaggtgaggtgacttgcctggggccacatagctcataagctgtagaactctgcaggcagatttactgtcccaggagcaaatgctggatgagcaactcctgttctttgggctcaaggggactggtgatgggacaattcttctcgacttcaggagctgacagagccagaggcacctaaacttgggtacatcttgtaagacacataatgaggtccctctagctttagctggagggagataaaagaaccccagacctctgaatgtcccagaggctagtctcttctcagagcagcactggggtttgggggcttccctgggcctcagcctccaggcacccccaggattcccagagagacgctgtgattggcaggaggcaggatatccccagggaaacccatcttcacgcctgggtgacccccactgccgcctccttcttaactctgcaggaaatcagagctggcagcctccagtgggaggacagagccggtttccgtggcaaccctcagctgcctcatcgtggctgggaagggaaggaagcaagccggcagaaatagctatggaaggtcttgcgcaggctgcaaccctggtgtgctgggcgaaaacccttatgactccccccttccaaatcaggctgggttgtcactgagactagattctcacctgccttcaaagaagggccaattccctttaaaggtcgcacctccttggaaccacagtcattagtgaattacactcaaggaaaagatgtgctcccaccaggcagctccagctgttacctgagatactgaagtgcagctcaggagacgattatttaaacctgcccttgttttaatcgttatttttctctttaaaaaaaatagaagctataaagaaaagagggagagatgagtgggttagctacctgctatgcgctagttaggaagttacctggatgccattgtatttcttcatcccttgcttaagaatcaaaattactggacatatgttaggaatactctttctttctttctttctttttaagctcagtggcaagaatgaaatactctttttttttttttttttttgagatggagtctcgctctgctgcccaggctagagtgcagtggcgtgatctcggctcactgcaagctctgcctcccgtgttcacaccattctcctgcctcagcctcctgagtagctgggactacaggcacccgccaccacacccggctaatttttggatttttagtagagatgggatttcaccgtattagccaggatggtcttgatctcctgagctcgtgatctgcccgcctcggcctcccaaagtgctgggattacaggtgtgagccaccgcgcccagccaagaataaaatactcttaagttgatctaatgaagtgtttccttaccattgtgattattgttactattatttgctatattttaatattgttgtttaccaaatattctcctttaaacagactcgctttttaaacttttttttttttttttggagacggagttccacgcttattgcccaggctggagtgcaatggcacgatctcagctcaccacaacctccacctccggggtttaagcaatgcttctgcctcagcttcccaagtagctgagattacaggcgcacaccaccacgcccaactgattttggtatttttagtagagacggggttcccccatgttggtcaggctggtctcgaactcctgaccctcgtgatttgcctgccttggcctcccaaagtgctaggattacaggcatgagccaccatgcccggcctaaactttgtttttaaaatgaactttttttccccccaattgctgccaatagtggataacatgtatcactcactgccaaaaatagaaagtgaccatgaaaaataaattcgctggggaagggggctccatgctggtgtggccaaggctgagagctctctcttctctgttacaaaacgagataagcaagtgttagaattgccttaaggccacactggcatctccctgaccttctccagggacagaagcaggagtaagtttctcatcccatgggcgaccagggccatctcctcccaccagtggcccccactcacagggagctggcaatgccctacctgcctgttctccagatggagaaacaggctctgagatttcacaggtcttgcccaaagtcattgattttgatgattaaaaagaataaacacagtgtttcctgagtagcagtgattgttatgccttgctattttaataaagattctattttcgtataacattgtcaagtggaaacatgctgaaatctattaaaccatctttgtttgtgaaaaaaaaaa

SEQ ID NO: 36797 - DNA, 3418 bp, Homo sapiens
ggagtgggccaggccgccagccccgccagccccgccagccccgccagccccgcgatggcttgggccgcgctcctcggcctcctggccgcactgttgctgctgctgctactgagccgccgccgcacgcggcgacctggtgagcctcccctggacctgggcagcatcccctggttggggtatgccttggactttggaaaagatgctgccagcttcctcacgaggatgaaggagaagcacggtgacatctttactatactggttgggggcaggtatgtcaccgttctcctggacccacactcctacgacgcggtggtgtgggagcctcgcaccaggctcgacttccatgcctatgccatcttcctcatggagaggatttttgatgtgcagcttccacattacagccccagtgatgaaaaggccaggatgaaactgactcttctccacagagagctccaggcactcacagaagccatgtataccaacctccatgcagtgctgttgggcgatgctacagaagcaggcagtggctggcacgagatgggtctcctcgacttctcctacagcttcctgctcagagccggctacctgactctttacggaattgaggcgctgccacgcacccatgaaagccaggcccaggaccgcgtccactcagctgatgtcttccacacctttcgccagctcgaccggctgctccccaaactggcccgtggctccctgtcagtgggggacaaggaccacatgtgcagtgtcaaaagtcgcctgtggaagctgctatccccagccaggctggccaggcgggcccaccggagcaaatggctggagagttacctgctgcacctggaggagatgggtgtgtcagaggagatgcaggcacgggccctggtgctgcagctgtgggccacacaggggaatatgggtcccgctgccttctggctcctgctcttccttctcaagaatcctgaagccctggctgctgtccgcggagagctcgagagtatcctttggcaagcggagcagcctgtctcgcagacgaccactctcccacagaaggttctagacagcacacctgtgcttgatagcgtgctgagtgagagcctcaggcttacagctgcccccttcatcacccgcgaggttgtggtggacctggccatgcccatggcagacgggcgagaattcaacctgcgacgtggtgaccgcctcctcctcttccccttcctgagcccccagagagacccagaaatctacacagacccagaggtatttaaatacaaccgattcctgaaccctgacggatcagagaagaaagacttttacaaggatgggaaacggctgaagaattacaacatgccctggggggcggggcacaatcactgcctggggaggagttatgcggtcaacagcatcaaacaatttgtgttccttgtgctggtgcacttggacttggagctgatcaacgcagatgtggagatccctgagtttgacctcagcaggtacggcttcggtctgatgcagccggaacacgacgtgcccgtccgctaccgcatccgcccatgacacagggagcagatggatccacgtgctcgcctctgcccagcctgccccagcctgccccagcctcccagctttctgtgtgcacagttggcccgggtgcaggtgctagcattaccacttccctgcttttctcccagaaggctgggtccaggggagggaaaagctaagagggtgaacaaagaaaagacattgaaagctctatggattatccactgcaaagttttctttccaaaatcaggctttgtctgctcccaattcacctcgttactctcacctcgtgatatccacaaatgctattcagataaggcagaactaggagtcttcactgctctgcccccaactcccggaggtgtcaccttcctagttcttatgagctagcatggcccgggccttatccagtcaaagcggatgctggccacagaaaggccactcaggatgtcctttgtgtccattgatgtcattcagcagtcagtcccccaataatccttaaactagctaaaaccaaaggagtcccttagaagatctgcttccctggggccccatttgccagattgccccattgctcacactacttgagaaaatgcaggagagcttcccccaaggctgatgcattcccggtgcagaacaggggcaccctccaaacactgggctctgaggagtggagttctctgttctagagtgacaggcaccagatgggatgggctttctcagtgtcagcactcaggtagggagctaaggaagacacagcccagacaagatggctggaaggagccagccaggactccttagactgatcaagccaaaaaagaaggtgccgatttcatgcattctagtgcagaagccccaactgtgatcacgatccagtctgcagacgtgttttgtttggacttcacttaaaaaaatgccttagttgttatcatctttgggagagttcattcaaaatgtccagcttctcttgaaaacttggtatatctggccacactgggctcacattcccaagggtaactcttggccagagctgagtggcagccgcctcccttatgcaggacatgtgctctcggcttcaccagggttctgaccgggtctgcttctgcattcacagcgcctcctggacctgaaggcatctgagtgtgagaccctgttctaactcttagaagtgacattgtaagaggtggtggggaccagctaattggtccaacccagcctgagtgcaccaccctttgaacaaatgtatcagtgatgaaaatttgcctttgccccggcttgcctgtactcccaaagtgctaggattacaggcatgagccaccatgcccggcctaaactttgtttttaaaatgaactttttttccccccaattgctgccaatagtggataacatgtatcactcactgccaaaaatagaaagtgaccatgaaaaataaattcgctggggaagggggctccatgctggtgtggccaaggctgagagctctctcttctctgttacaaaacgagataagcaagtgttagaattgccttaaggccacactggcatctccctgaccttctccagggacagaagcaggagtaagtttctcatcccatgggcgaccagggccatctcctcccaccagtggcccccactcacagggagctggcaatgccctacctgcctgttctccagatggagaaacaggctctgagatttcacaggtcttgcccaaagtcattgattttgatgattaaaaagaataaacacagtgtttcctgagtagcagtgattgttatgccttgctattttaataaagattctattttcgtataacattgtcaagtggaaacatgctgaaatctattaaaccatctttgtttgtgaaaaaaaaaa

SEQ ID NO: 36798 - DNA, 3503 bp, Homo sapiens
ggagtgggccaggccgccagccccgccagccccgccagccccgccagccccgcgatggcttgggccgcgctcctcggcctcctggccgcactgttgctgctgctgctactgagccgccgccgcacgcggcgacctggtgagcctcccctggacctgggcagcatcccctggttggggtatgccttggactttggaaaagatgctgccagcttcctcacgaggatgaaggagaagcacggtgacatctttactatactggttgggggcaggtatgtcaccgttctcctggacccacactcctacgacgcggtggtgtgggagcctcgcaccaggctcgacttccatgcctatgccatcttcctcatggagaggatttttgatgtgcagcttccacattacagccccagtgatgaaaaggccaggatgaaactgactcttctccacagagagctccaggcactcacagaagccatgtataccaacctccatgcagtgctgttgggcgatgctacagaagcaggcagtggctggcacgagatgggtctcctcgacttctcctacagcttcctgctcagagccggctacctgactctttacggaattgaggcgctgccacgcacccatgaaagccaggcccaggaccgcgtccactcagctgatgtcttccacacctttcgccagctcgaccggctgctccccaaactggcccgtggctccctgtcagtgggggacaaggaccacatgtgcagtgtcaaaagtcgcctgtggaagctgctatccccagccaggctggccaggcgggcccaccggagcaaatggctggagagttacctgctgcacctggaggagatgggtgtgtcagaggagatgcaggcacgggccctggtgctgcagctgtgggccacacaggggaatatgggtcccgctgccttctggctcctgctcttccttctcaagaatcctgaagccctggctgctgtccgcggagagctcgagagtatcctttggcaagcggagcagcctgtctcgcagacgaccactctcccacagaaggttctagacagcacacctgtgcttgatagcgtgctgagtgagagcctcaggcttacagctgcccccttcatcacccgcgaggttgtggtggacctggccatgcccatggcagacgggcgagaattcaacctgcgacgtggtgaccgcctcctcctcttccccttcctgagcccccagagagacccagaaatctacacagacccagaggtatttaaatacaaccgattcctgaaccctgacggatcagagaagaaagacttttacaaggatgggaaacggctgaagaattacaacatgccctggggggcggggcacaatcactgcctggggaggagttatgcggtcaacagcatcaaacaatttgtgttccttgtgctggtgcacttggacttggagctgatcaacgcagatgtggagatccctgagtttgacctcagcaggtacggcttcggtctgatgcagccggaacacgacgtgcccgtccgctaccgcatccgcccatgacacagggagcagatggatccacgtgctcgcctctgcccagcctgccccagcctgccccagcctcccagctttctgtgtgcacagttggcccgggtgcaggtgctagcattaccacttccctgcttttctcccagaaggctgggtccaggggagggaaaagctaagagggtgaacaaagaaaagacattgaaagctctatggattatccactgcaaagttttctttccaaaatcaggctttgtctgctcccaattcacctcgttactctcacctcgtgatatccacaaatgctattcagataaggcagaactaggagtcttcactgctctgcccccaactcccggaggtgtcaccttcctagttcttatgagctagcatggcccgggccttatccagtcaaagcggatgctggccacagaaaggccactcaggatgtcctttgtgtccattgatgtcattcagcagtcagtcccccaataatccttaaactagctaaaaccaaaggagtcccttagaagatctgcttccctggggccccatttgccagattgccccattgctcacactacttgagaaaatgcaggagagcttcccccaaggctgatgcattcccggtgcagaacaggggcaccctccaaacactgggctctgaggagtggagttctctgttctagagtgacaggcaccagatgggatgggctttctcagtgtcagcactcaggtagggagctaaggaagacacagcccagacaagatggctggaaggagccagccaggactccttagactgatcaagccaaaaaagaaggtgccgatttcatgcattctagtgcagaagccccaactgtgatcacgatccagtctgcagacgtgttttgtttggacttcacttaaaaaaatgccttagttgttatcatctttgggagagttcattcaaaatgtccagcttctcttgaaaacttggtatatctggccacactgggctcacattcccaagggtaactcttggccagagctgagtggcagccgcctcccttatgcaggacatgtgctctcggcttcaccagggttctgaccgggtctgcttctgcattcacagcgcctcctggacctgaaggcatctgagtgtgagaccctgttctaactcttagaagtgacattgtaagaggtggtggggaccagctaattggtccaacccagcctgagtgcaccaccctttgaacaaatgtatcagtgatgaaaatttgcctttgccccggcttgcctgtaatcccagcactttgggaggccgaggtgggcggatcacttgaggctggtctcgaactcctgaccctcgtgatttgcctgccttggcctcccaaagtgctaggattacaggcatgagccaccatgcccggcctaaactttgtttttaaaatgaactttttttccccccaattgctgccaatagtggataacatgtatcactcactgccaaaaatagaaagtgaccatgaaaaataaattcgctggggaagggggctccatgctggtgtggccaaggctgagagctctctcttctctgttacaaaacgagataagcaagtgttagaattgccttaaggccacactggcatctccctgaccttctccagggacagaagcaggagtaagtttctcatcccatgggcgaccagggccatctcctcccaccagtggcccccactcacagggagctggcaatgccctacctgcctgttctccagatggagaaacaggctctgagatttcacaggtcttgcccaaagtcattgattttgatgattaaaaagaataaacacagtgtttcctgagtagcagtgattgttatgccttgctattttaataaagattctattttcgtataacattgtcaagtggaaacatgctgaaatctattaaaccatctttgtttgtgaaaaaaaaaa

SEQ ID NO: 36799 - DNA, 1029 bp, Homo sapiens
cttataaaggtctttgcaaaaatgcttcatgtttacaatcaaactgtaattcattgaagtcattcctgcaacatctgagataatgtaaaccaactggtttgttttatgactacctaaattgattctgagaaaattgccctgaagaattgaaaagaataaatagttaaagcatcactttttatcacacctctctcttactaaagagcttacaatgattctccattacctgcaggcttataactaaatattccatagtaaaagagctgtacttctgagacttgtagagcattccctcataaactatttgtagcattagccataggtttacatattactaactttggttggcaagcatcttcatccatttctgctgctacaacaaaatatcttagactgggtcatttatatataatacaaatttatatctctcagttctggaggctgagaagtctaagatcaaggcactgctagacttgcttgctctctgcttccaagatagcgtcttgtttttgtgtcctgcagagaggatgaatgttgtgtcctcacatggcagaagtggcaaaaaagccactttcatgccttttgtaaggcactaatcccattcatgagggcagaactctcatgacttaatcatctcctaaaggccccacctcttattcccattgcactggaaactcagtttcagcatgaattttgaagagacaaaaacattcaaaccatagcagcaagtatctagaggatttgtgaaaggaggcatagaaagaggcttggttgaatgagactgagaaaggtgtgcatgccgtagagataatgtgtgatgctactggggtgttcctagtaccaggtgatacatgtttgcctgggaaagtaatgacaggactaaaaatgatgatagacattacagaacttctttcatttattcaaaaataggccaggcatcgtggctcacacctgtaatcccagcaatttgggaggctgagatgggaggatcacttgaggtcaggagttcaagaccagcctgactaacat

SEQ ID NO: 36800 - DNA, 332 bp, Homo sapiens
gttcaggtagccttctccaggagttccaccctcatccccaagccataagtaatcctttcctcctttgagttccagtagcactctttatacctctctttgtatttataaactgggccttgaaacataattatttgtatttcttttccctaataaaatacgagtacctaagcacaaactgataaacattcaggttaaactcaacggatatgttattgaatatctgctttgtccaaagcactgtgcctaaagctatgcaaacatgagtattacaccgctcttgtctttgtcacgttgttcctcatagtgcctggtctccctcttgacatttttct

SEQ ID NO: 36801 - DNA, 960 bp, Homo sapiens
aagttagcagtagtgctagcacctcagggcttgaaaaaacaaaaatacaaaaatattgagtgtctcctgcaacccaggcacagggttaaggactttaggcaagattattctccccatttcacagacgatgacatggagatttgcttataacagtctctggccagggacctcgctaagaaatattggcaatatgaggggaaattcctgtgaaactgtgatcctttcctctgaggggcctccttaacagctgtccagacggcgtcgccagctgcccaggcagttcctatccctttcggagctccagcctgcccctcctgacgctctcagagtctggccttctgctgggccccgggtctctcactggcagaatggagttctcggagctgatccatacgggctgagcccaagcagagtttctacggggcccggaggcgcccccgcttcgcggcacggtgtgagtcaccgtccaccacctgctcctgtcgccaggcccgcgtcctctccggacctgtggctgctgctgttgcgtagcgtcgactccttcgagaagcagtgagacgtggcggggtgggggagggtccccggggttggggagcgcgcggcttggcggagtagggggcacggccagcgcagtcagagctggcgccctcctgcgtaagcccaatccgggaaactcgttgcccctctcctgggaaaggaacgtccctccccagggttgcgagtgactcgggcaccatcaccctgtgctgtaaagacctgcgagtgctgcagctggaaatagagggcgcggaagcgacgctgggcatcgcccgctccatcgaggaccaacgcgtggcggctgagcgaggtgaacgaggacttcagcttgtgccccagatacccccgtgcggtgatcgtgccatacttggtggacgatgatgccctggcgcgcagcgcccgcttccgtcagggaggtcgctt

SEQ ID NO: 36802 - DNA, 488 bp, Homo sapiens
ctctgctcagcgtcctgacctgtcttcctcctcctcaggcctgtttctgcgctggacctgctcacctgagcctgcagaagctgcatgggggaagagtgtggcaaatagtgacaggaagggagaagacagaagcctctcagccaactgcttcagccgagcccctattctaagcactggctccttggatagcagctgagatgttcctgaaacctctgcaggccccttaggacctttacaccttggatgagggtgcctgcaacccaggttagccaaaagtactgagggtcttaagtttgaagtgtccaaagtatagggaggtctcaataataaaagtctccatgatcagtccgttcgcatgttaacatgcgaacggactgatctcaacacctcttcaaggacaacttcgcacctctcatgttcgtcacaaatattggactacctacctgggacactggggaactcacgatcagtccgttcgcaaattggtc

SEQ ID NO: 36803 - DNA, 2284 bp, Homo sapiens
aagttagcagtagtgctagcacctcagggcttgaaaaaacaaaaatacaaaaatattgagtgtctcctgcaacccaggcacagggttaaggactttaggcaagattattctccccatttcacagacgatgacatggagatttgcttataacagtctctggccagggacctcgctaagaaatattggcaatatgaggggaaattcctgtgaaactgtgatcctttcctctgaggggcctccttaacagctgtccagacggcgtcgccagctgcccaggcagttcctatccctttcggagctccagcctgcccctcctgacgctctcagagtctggccttctgctgggccccgggtctctcactggcagaatggagttctcggagctgatccatacgggctgagcccaagcagagtttctacggggcccggaggcgcccccgcttcgcggcacggtgtgagtcaccgtccaccacctgctcctgtcgccaggcccgcgtcctctccggacctgtggctgctgctgttgcgtagcgtcgactccttcgagaagcagtgagacgtggcggggtgggggagggtccccggggttggggagcgcgcggcttggcggagtagggggcacggccagcgcagtcagagctggcgccctcctgcgtaagcccaatccgggaaactcgttgcccctctcctgggaaaggaacgtccctccccagggttgcgagtgactcgggcaccatcaccctgtgctgtaaagacctgcgagtgctgcagctggaaatagagggcgcggaagcgacgctgggcatcgcccgctccatcgaggtgtgccgagggagctcccgagccctttaagctctccctgtctcgcgtagaggggaataaaaaggtgcttctgttcaaagaggctccgcagccgcagctaaatggcagggggatgcagggtggtccggggtacttggagaggccgaagctgaagctacaggactgaggggctggaaagggcgcgggcgagacaattccgaccctccccagagcccctgacttccttctccggacgctgtcctccctggaatcagtcatcacctccttccctttattctaccgtcccaagggcctgagattgggcgactcctggcacttcctcccgcccgaactctactgcaagagagtagctcgcgaagtgggcgcggtcgtaggggcccgggaaggtggaagcgccgggcctggaagaggcgcggggacagggcactccctgggtgccctagacctggcctctctcctccctgcgctgcagaccaacgcgtggcggctgagcgaggttctgctacgctccagccagcccctaactggtccccagaagcggcgctgctacagggaccaggagctgctgcgaactgcgctggcgggggctcgtccttgggcgcggggcttcatcatggacacgctctcggcccaggccgcgaaacaagcccgcgtgactggcggaggcacagagaccaaggccgcttaacctggctggttgcactggtccctggagagagggcgtcccctgcaggagagcttcatgcgcctggtggaggcctgtggggactcggagcaaagcatggacaactggctgagtcggctggacggctgccgctgactgtaacatgtaaagcaggcactgagcaccacctgcctggcagtccagggcatggagaggcctggtacatggggctgaaggcacagacagcaccctgcttgtgacttcactggcccaactcatcctggaccccttgagcaagaccatggctggattccaggaactggtggagtggaagtggatccaggaaaatgccgtgtgaagggaggactcagatgcactccctgtggtctgggctcaaccagccaaaagagcaacaaagactccagaacccactctacctcctcaatcccttggccatctgtggagccccagagcctgcggctgtggcaaggcctgtttctgcgctggacctgctcacctgagcctgcagaagctgcatgggggaagagtgtggcaaatagtgacaggaagggagaagacagaagcctctcagccaactgcttcagccgagcccctattctaagcactggctccttggatagcagctgagatgttcctgaaacctctgcaggccccttaggacctttacaccttggatgagggtgcctgcaacccaggttagccaaaagtactgagggtcttaagtttgaagtgtccaaagtatagggaggtctcaataataaaagtctccatgatcag

SEQ ID NO: 36804 - DNA, 1851 bp, Homo sapiens
aagttagcagtagtgctagcacctcagggcttgaaaaaacaaaaatacaaaaatattgagtgtctcctgcaacccaggcacagggttaaggactttaggcaagattattctccccatttcacagacgatgacatggagatttgcttataacagtctctggccagggacctcgctaagaaatattggcaatatgaggggaaattcctgtgaaactgtgatcctttcctctgaggggcctccttaacagctgtccagacggcgtcgccagctgcccaggcagttcctatccctttcggagctccagcctgcccctcctgacgctctcagagtctggccttctgctgggccccgggtctctcactggcagaatggagttctcggagctgatccatacgggctgagcccaagcagagtttctacggggcccggaggcgcccccgcttcgcggcacggtgtgagtcaccgtccaccacctgctcctgtcgccaggcccgcgtcctctccggacctgtggctgctgctgttgcgtagcgtcgactccttcgagaagcagaacgtccctccccagggttgcgagtgactcgggcaccatcaccctgtgctgtaaagacctgcgagtgctgcagctggaaatagagggcgcggaagcgacgctgggcatcgcccgctccatcgaggggcctgagattgggcgactcctggcacttcctcccgcccgaactctactgcaagagagtagctcgcgaagtgggcgcggtcgtaggggcccgggaaggtggaagcgccgggcctggaagaggcgcggggacagggcactccctgggtgccctagacctggcctctctcctccctgcgctgcagaccaacgcgtggcggctgagcgaggttctgctacgctccagccagcccctaactggtccccagaagcggcgctgctacagggaccaggagctgctgcgaactgcgctggcgggggctcgtccttgggcgcggggcttcatcatggacacgctctcggcccaggccgcgaaacaagcccgcgtgactggcggaggcacagagaccaaggccgcttaacctggctggttgcactggtccctggagagagggcgtcccctgcaggagagcttcatgcgcctggtggaggcctgtggggactcggagcaaagcatggacaactggctgagtcggctggacggctgccgctgactgtaacatgtaaagcaggcactgagcaccacctgcctggcagtccagggcatggagaggcctggtacatggggctgaaggcacagacagcaccctgcttgtgacttcactggcccaactcatcctggaccccttgagcaagaccatggctggattccaggaactggtggagtggaagtggatccaggaaaatgccgtgtgaagggaggactcagatgcactccctgtggtctgggctcaaccagccaaaagagcaacaaagactccagaacccactctacctcctcaatcccttggccatctgtggagccccagagcctgcggctgtggcaaggcctgtttctgcgctggacctgctcacctgagcctgcagaagctgcatgggggaagagtgtggcaaatagtgacaggaagggagaagacagaagcctctcagccaactgcttcagccgagcccctattctaagcactggctccttggatagcagctgagatgttcctgaaacctctgcaggccccttaggacctttacaccttggatgagggtgcctgcaacccaggttagccaaaagtactgagggtcttaagtttgaagtgtccaaagtatagggaggtctcaataataaaagtctccatgatcag

SEQ ID NO: 36805 - DNA, 1295 bp, Homo sapiens
caattcgcggcgtagccgctgccccaactcctgccccattctggtcccgcccctctcccgccttttcgctgggaagggtatcacctttctctggccccgcccctgacggttccgggccccgcgaagcttagtcccttctttgtcaagccaggacccgcccacggtctattcatagggtcccaaaccactttggccacaacacccccagactggtccgaagcctcgtgagttcgccctggtcgttgcactccagcctgtcgctgtgcagacctggcttagaggacccctaaggctgaggggtcacttccagaactgagtccggtccgcaggttctgctacgctccagccagcccctaactggtccccagaagcggcgctgctacagggaccaggagctgctgcgaactgcgctggcgggggctcgtccttgggcgcggggcttcatcatggacacgctctcggcccaggccgcgaaacaagcccgcgtgactggcggaggcacagagaccaaggccgcttaacctggctggttgcactggtccctggagagagggcgtcccctgcaggagagcttcatgcgcctggtggaggcctgtggggactcggagcaaagcatggacaactggctgagtcggctggacggctgccgctgactgtaacatgtaaagcaggcactgagcaccacctgcctggcagtccagggcatggagaggcctggtacatggggctgaaggcacagacagcaccctgcttgtgacttcactggcccaactcatcctggaccccttgagcaagaccatggctggattccaggaactggtggagtggaagtggatccaggaaaatgccgtgtgaagggaggactcagatgcactccctgtggtctgggctcaaccagccaaaagagcaacaaagactccagaacccactctacctcctcaatcccttggccatctgtggagccccagagcctgcggctgtggcaaggcctgtttctgcgctggacctgctcacctgagcctgcagaagctgcatgggggaagagtgtggcaaatagtgacaggaagggagaagacagaagcctctcagccaactgcttcagccgagcccctattctaagcactggctccttggatagcagctgagatgttcctgaaacctctgcaggccccttaggacctttacaccttggatgagggtgcctgcaacccaggttagccaaaagtactgagggtcttaagtttgaagtgtccaaagtatagggaggtctcaataataaaagtctccatgatcag

SEQ ID NO: 36806 - DNA, 1163 bp, Homo sapiens
caattcgcggcgtagccgctgccccaactcctgccccattctggtcccgcccctctcccgccttttcgctgggaagggtatcacctttctctggccccgcccctgacggttccgggccccgcgaagcttagtcccttctttgtcaagccaggacccgcccacggtctattcatagggtcccaaaccactttggccacaacacccccagactggtccgaagcctcgtgagttcgccctggtcgttgcactccagcctgtcgctgtgcagacctggcttagaggacccctaaggctgaggggtcacttccagaactgagtccggtccgcaggttctgctacgctccagccagcccctaactggtccccagaagcggcgctgctacagggaccaggagctgctgcgaactgcgctggcgggggctcgtccttgggcgcggggcttcatcatggacacgctctcggcccaggccgcgaaacaagcccgcgtgactggcggaggcacagagaccaaggccgcttaacctggctggttgcactggtccctggagagagggcgtcccctgcaggagagcttcatgcgcctggtggaggcctgtggggactcggagcaaagcatggacaactggctgagtcggctggacggctgccgctgactgtaacatgtaaagcaggcactgagcaccacctgcctggcagtccagggcatggagagatgccgtgtgaagggaggactcagatgcactccctgtggtctgggctcaaccagccaaaagagcaacaaagactccagaacccactctacctcctcaatcccttggccatctgtggagccccagagcctgcggctgtggcaaggcctgtttctgcgctggacctgctcacctgagcctgcagaagctgcatgggggaagagtgtggcaaatagtgacaggaagggagaagacagaagcctctcagccaactgcttcagccgagcccctattctaagcactggctccttggatagcagctgagatgttcctgaaacctctgcaggccccttaggacctttacaccttggatgagggtgcctgcaacccaggttagccaaaagtactgagggtcttaagtttgaagtgtccaaagtatagggaggtctcaataataaaagtctccatgatcag

SEQ ID NO: 36807 - DNA, 1431 bp, Homo sapiens
aagttagcagtagtgctagcacctcagggcttgaaaaaacaaaaatacaaaaatattgagtgtctcctgcaacccaggcacagggttaaggactttaggcaagattattctccccatttcacagacgatgacatggagatttgcttataacagtctctggccagggacctcgctaagaaatattggcaatatgaggggaaattcctgtgaaactgtgatcctttcctctgaggggcctccttaacagctgtccagacggcgtcgccagctgcccaggcagttcctatccctttcggagctccagcctgcccctcctgacgctctcagagtctggccttctgctgggccccgggtctctcactggcagaatggagttctcggagctgatccatacgggctgagcccaagcagagtttctacggggcccggaggcgcccccgcttcgcggcacggtgtgagtcaccgtccaccacctgctcctgtcgccaggcccgcgtcctctccggacctgtggctgctgctgttgcgtagcgtcgactccttcgagaagcagtgagacgtggcggggtgggggagggtccccggggttggggagcgcgcggcttggcggagtagggggcacggccagcgcagtcagagctggcgccctcctgcgtaagcccaatccgggaaactcgttgcccctctcctgggaaaggaacgtccctccccagggttgcgagtgactcgggcaccatcaccctgtgctgtaaagacctgcgagtgctgcagctggaaatagagggcgcggaagcgacgctgggcatcgcccgctccatcgaggtgtgccgagggagctcccgagccctttaagctctccctgtctcgcgtagaggggaataaaaaggtgcttctgttcaaagaggctccgcagccgcagctaaatggcagggggatgcagggtggtccggggtacttggagaggccgaagctgaagctacaggactgaggggctggaaagggcgcgggcgagacaattccgaccctccccagagcccctgacttccttctccggacgctgtcctccctggaatcagtcatcacctccttccctttattctaccgtcccaagggcctgagattgggcgactcctggcacttcctcccgcccgaactctactgcaagagagtagctcgcgaagtgggcgcggtcgtaggggcccgggaaggtggaagcgccgggcctggaagaggcgcggggacagggcactccctgggtgccctagacctggcctctctcctccctgcgctgcagaccaacgcgtggcggctgagcgaggtgaacgaggacttcagcttgtgccccagatacccccgtgcggtgatcgtgccatacttggtggacgatgatgccctggcgcgcagcgcccgcttccgtcagggaggtcgctt

SEQ ID NO: 36808 - DNA, 1706 bp, Homo sapiens
aagttagcagtagtgctagcacctcagggcttgaaaaaacaaaaatacaaaaatattgagtgtctcctgcaacccaggcacagggttaaggactttaggcaagattattctccccatttcacagacgatgacatggagatttgcttataacagtctctggccagggacctcgctaagaaatattggcaatatgaggggaaattcctgtgaaactgtgatcctttcctctgaggggcctccttaacagctgtccagacggcgtcgccagctgcccaggcagttcctatccctttcggagctccagcctgcccctcctgacgctctcagagtctggccttctgctgggccccgggtctctcactggcagaatggagttctcggagctgatccatacgggctgagcccaagcagagtttctacggggcccggaggcgcccccgcttcgcggcacggtgtgagtcaccgtccaccacctgctcctgtcgccaggcccgcgtcctctccggacctgtggctgctgctgttgcgtagcgtcgactccttcgagaagcagtgagacgtggcggggtgggggagggtccccggggttggggagcgcgcggcttggcggagtagggggcacggccagcgcagtcagagctggcgccctcctgcgtaagcccaatccgggaaactcgttgcccctctcctgggaaaggaacgtccctccccagggttgcgagtgactcgggcaccatcaccctgtgctgtaaagacctgcgagtgctgcagctggaaatagagggcgcggaagcgacgctgggcatcgcccgctccatcgaggtgtgccgagggagctcccgagccctttaagctctccctgtctcgcgtagaggggaataaaaaggtgcttctgttcaaagaggctccgcagccgcagctaaatggcagggggatgcagggtggtccggggtacttggagaggccgaagctgaagctacaggactgaggggctggaaagggcgcgggcgagacaattccgaccctccccagagcccctgacttccttctccggacgctgtcctccctggaatcagtcatcacctccttccctttattctaccgtcccaagggcctgagattgggcgactcctggcacttcctcccgcccgaactctactgcaagagagtagctcgcgaagtgggcgcggtcgtaggggcccgggaaggtggaagcgccgggcctggaagaggcgcggggacagggcactccctgggtgccctagacctggcctctctcctccctgcgctgcagaccaacgcgtggcggctgagcgaggttctgctacgctccagccagcccctaactggtccccagaagcggcgctgctacagggaccaggagctgctgcgaactgcgctggcgggggctcgtccttgggcgcggggcttcatcatggacacgctctcggcccaggccgcgaaacaagcccgcgtgactggcggaggcacagagaccaaggccgcttaacctggctggttgcactggtccctggagagcactgagcacaggggctgccacagtggccggctcagacatggcagagatcagcagagaatgggcaatcaggctcccctgagatgagcagcagcgcagaggaggtgcccctctcttactacaccaacttcagggcttgagctggaaaagatgaccagactcccaccgc

SEQ ID NO: 36809 - DNA, 1147 bp, Homo sapiens
aagttagcagtagtgctagcacctcagggcttgaaaaaacaaaaatacaaaaatattgagtgtctcctgcaacccaggcacagggttaaggactttaggcaagattattctccccatttcacagacgatgacatggagatttgcttataacagtctctggccagggacctcgctaagaaatattggcaatatgaggggaaattcctgtgaaactgtgatcctttcctctgaggggcctccttaacagctgtccagacggcgtcgccagctgcccaggcagttcctatccctttcggagctccagcctgcccctcctgacgctctcagagtctggccttctgctgggccccgggtctctcactggcagaatggagttctcggagctgatccatacgggctgagcccaagcagagtttctacggggcccggaggcgcccccgcttcgcggcacggtgtgagtcaccgtccaccacctgctcctgtcgccaggcccgcgtcctctccggacctgtggctgctgctgttgcgtagcgtcgactccttcgagaagcaggcctgagattgggcgactcctggcacttcctcccgcccgaactctactgcaagagagtagctcgcgaagtgggcgcggtcgtaggggcccgggaaggtggaagcgccgggcctggaagaggcgcggggacagggcactccctgggtgccctagacctggcctctctcctccctgcgctgcagaccaacgcgtggcggctgagcgaggttctgctacgctccagccagcccctaactggtccccagaagcggcgctgctacagggaccaggagctgctgcgaactgcgctggcgggggctcgtccttgggcgcggggcttcatcatggacacgctctcggcccaggccgcgaaacaagcccgcgtgactggcggaggcacagagaccaaggccgcttaacctggctggttgcactggtccctggagagcactgagcacaggggctgccacagtggccggctcagacatggcagagatcagcagagaatgggcaatcaggctcccctgagatgagcagcagcgcagaggaggtgcccctctcttactacaccaacttcagggcttgagctggaaaagatgaccagactcccaccgc

SEQ ID NO: 36810 - DNA, 174 bp, Homo sapiens
ggtcgacatcatcatcatcatggatttgctggtgcagtattttctgtgttttctttttaatttacagcctttcttattttgatatttttttaatgttgtggatgaatgccagctttcagacagagcccacttagcttgtccacatgtccccgtacatcgttagaagcttgaatt

SEQ ID NO: 36811 - DNA, 2139 bp, Homo sapiens
agcgtgtgggagcgagcgcgagaaatgcagaggctgcagcggcggcggcggcggcagtagcggcagcggcgacgacggcggcggcagcgctccaactggctcctcgctccgggctccgccgtcgagccgggagagagcctccgccagcggccaggcaccagccagacgacgccagcgaccccggcctctcggcggcaccgcgctaactcaggggctgcataggcacccagagccgaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgcagagcccgccgaggccaaggagggcaaggagaagcccgaccaggacgccgagggcaaggccgaggagaaggagggcgagaaggacgcggcggctgccaaggaggaggccccgaaggcggagcccgagaagacggagggcgcggcagaggccaaggctgagcccccgaaggcgcccgagcaggagcaggcggcccccggccccgctgcgggcggcgaggcccccaaagctgctgaggccgccgcggccccggccgagagcgcggcccctgccgccggggaggagcccagcaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctctgcagaagagcccaagccggtggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaaaaaggtctggcgtccattggcagtcccagtttctcttccattcctggtgtccacagacaccacaaccactcattgcaatgtggacaaaaaaaacaaaaaaaaaaacccacaaacaatctgttcccaggggctgtgccttggaacattttatttgtcacggggtataaaggggggccacccggctattcaaggtttcaaccacttcacacaggcaaaaacaaacaacaaacctctcccacaggcggcgggaatccgcgggccaataaggggggcgcgaagagacccctctccgaggggggggggcgcccggagacccacacgctttggtgctcccccttataaaaagagagcgggataaaattccagccaccctctggggggataacaccgcgggggcccaaaaccgtgcaccccgtgggttacacaatcgtgctaatccgggccaccaaaatttccaac

SEQ ID NO: 36812 - DNA, 1982 bp, Homo sapiens
agcgtgtgggagcgagcgcgagaaatgcagaggctgcagcggcggcggcggcggcagtagcggcagcggcgacgacggcggcggcagcgctccaactggctcctcgctccgggctccgccgtcgagccgggagagagcctccgccagcggccaggcaccagccagacgacgccagcgaccccggcctctcggcggcaccgcgctaactcaggggctgcataggcacccagagccgaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgcagagcccgccgaggccaaggagggcaaggagaagcccgaccaggacgccgagggcaaggccgaggagaaggagggcgagaaggacgcggcggctgccaaggaggaggccccgaaggcggagcccgagaagacggagggcgcggcagaggccaaggctgagcccccgaaggcgcccgagcaggagcaggcggcccccggccccgctgcgggcggcgaggcccccaaagctgctgaggccgccgcggccccggccgagagcgcggcccctgccgccggggaggagcccagcaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctctgcagaagagcccaagccggtggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaaaaatttttgggcggcctgggcccgagaaaaaagtttctaggaacaattccgtttggggcgcgcgggccccagtaagtgtaagtgtgaccatgggccaatagccgtgtttcccaaaggaagaactccgtggcacggaactaagcgtggttctgtggtttcccttcccccaaattaaaaaagcgccccgggggaacaccggagcgttttggaacacacatcccagaagggaagtccggagggcacagtaccggcgctctatcacaggggtcccaagcgagctcgattacaattagccgccagga

SEQ ID NO: 36813 - DNA, 2159 bp, Homo sapiens
  misc_feature (124)..(124): n is a, c, g, or t
tgtttggcatcccactgaccccacatctgtttcgctgctaatgctctgctgccagaactatccaagctgcctccctctgggcccagggactatcgctgaagagatgacatctctgtatgttacncaggctggactggaactctgggctcaagccatcctcctgcctcacctcctgaagtgttgggattacaggaaagggtcccaatccagaccccaagggaggattcttggatctcatgcaagaaagaattcaggaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgcagagcccgccgaggccaaggagggcaaggagaagcccgaccaggacgccgagggcaaggccgaggagaaggagggcgagaaggacgcggcggctgccaaggaggaggccccgaaggcggagcccgagaagacggagggcgcggcagaggccaaggctgagcccccgaaggcgcccgagcaggagcaggcggcccccggccccgctgcgggcggcgaggcccccaaagctgctgaggccgccgcggccccggccgagagcgcggcccctgccgccggggaggagcccagcaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctctgcagaagagcccaagccggtggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaaaaaggtctggcgtccattggcagtcccagtttctcttccattcctggtgtccacagacaccacaaccactcattgcaatgtggacaaaaaaaacaaaaaaaaaaacccacaaacaatctgttcccaggggctgtgccttggaacattttatttgtcacggggtataaaggggggccacccggctattcaaggtttcaaccacttcacacaggcaaaaacaaacaacaaacctctcccacaggcggcgggaatccgcgggccaataaggggggcgcgaagagacccctctccgaggggggggggcgcccggagacccacacgctttggtgctcccccttataaaaagagagcgggataaaattccagccaccctctggggggataacaccgcgggggcccaaaaccgtgcaccccgtgggttacacaatcgtgctaatccgggccaccaaaatttccaac

SEQ ID NO: 36814 - DNA, 2085 bp, Homo sapiens
agcgtgtgggagcgagcgcgagaaatgcagaggctgcagcggcggcggcggcggcagtagcggcagcggcgacgacggcggcggcagcgctccaactggctcctcgctccgggctccgccgtcgagccgggagagagcctccgccagcggccaggcaccagccagacgacgccagcgaccccggcctctcggcggcaccgcgctaactcaggggctgcataggcacccagagccgaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgcagagcccgccgaggccaaggagggcaaggagaagcccgaccaggacgccgagggcaaggccgaggagaaggagggcgagaaggacgcggcggctgccaaggaggaggccccgaaggcggagcccgagaagacggagggcgcggcagaggccaaggctgagcccccgaaggcgcccgagcaggagcaggcggcccccggccccgctgcgggcggcgaggcccccaaagctgctgaggccgccgcggccccggccgagagcgcggcccctgccgccggggaggagcccagcaaggaggaaggggaacccaaaaagactgaggcgcccgcagctcctgccgcccaggagaccaaaagtgacggggccccagcttcagactcggaagcgcctagttccacacccaaggcccagggccccgcagcctctgcagaagagcccaagccggtggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaaaaaggtctggcgtccattggcagtcccagtttctcttccattcctggtgtccacagacaccacaaccactcattgcaatgtggacaaaaaaaacaaaaaaaaaaacccacaaacaatctgttcccaggggctgtgccttggaacattttatttgtcacggggtataaaggggggccacccggctattcaaggtttcaaccacttcacacaggcaaaaacaaacaacaaacctctcccacaggcggcgggaatccgcgggccaataaggggggcgcgaagagacccctctccgaggggggggggcgcccggagacccacacgctttggtgctcccccttataaaaagagagcgggataaaattccagccaccctctggggggataacaccgcgggggcccaaaaccgtgcaccccgtgggttacacaatcgtgctaatccgggccaccaaaatttccaac

SEQ ID NO: 36815 - DNA, 2104 bp, Homo sapiens
cccaccccccccttccgcctggcctcggcgtcactctcgtttacctcgccacgcggcgcggcggcggcggcggcagtagcggcagcggcgacgacggcggcggcagcgctccaactggctcctcgctccgggctccgccgtcgagccgggagagagcctccgccagcggccaggcaccagccagacgacgccagcgaccccggcctctcggcggcaccgcgctaactcaggggctgcataggcacccagagccgaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgcagagcccgccgaggccaaggagggcaaggagaagcccgaccaggacgccgagggcaaggccgaggagaaggagggcgagaaggacgcggcggctgccaaggaggaggccccgaaggcggagcccgagaagacggagggcgcggcagaggccaaggctgagcccccgaaggcgcccgagcaggagcaggcggcccccggccccgctgcgggcggcgaggcccccaaagctgctgaggccgccgcggccccggccgagagcgcggcccctgccgccggggaggagcccagcaaggaggaaggggaacccaaaaagactgaggcgcccgcagctcctgccgcccaggagaccaaaagtgacggggccccagcttcagactcggaagcgcctagttccacacccaaggcccagggccccgcagcctctgcagaagagcccaagccggtggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaaaaaggtctggcgtccattggcagtcccagtttctcttccattcctggtgtccacagacaccacaaccactcattgcaatgtggacaaaaaaaacaaaaaaaaaaacccacaaacaatctgttcccaggggctgtgccttggaacattttatttgtcacggggtataaaggggggccacccggctattcaaggtttcaaccacttcacacaggcaaaaacaaacaacaaacctctcccacaggcggcgggaatccgcgggccaataaggggggcgcgaagagacccctctccgaggggggggggcgcccggagacccacacgctttggtgctcccccttataaaaagagagcgggataaaattccagccaccctctggggggataacaccgcgggggcccaaaaccgtgcaccccgtgggttacacaatcgtgctaatccgggccaccaaaatttccaac

SEQ ID NO: 36816 - DNA, 2055 bp, Homo sapiens
agcgtgtgggagcgagcgcgagaaatgcagaggctgcagcggcggcggcggcggcagtagcggcagcggcgacgacggcggcggcagcgctccaactggctcctcgctccgggctccgccgtcgagccgggagagagcctccgccagcggccaggcaccagccagacgacgccagcgaccccggcctctcggcggcaccgcgctaactcaggggctgcataggcacccagagccgaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgcagagcccgccgaggccaaggagggcaaggagaagcccgaccaggacgccgagggcaaggccgaggagaaggagggcgagaaggacgcggcggctgccaaggaggaggccccgaaggcggagcccgagaagacggcccccaaagctgctgaggccgccgcggccccggccgagagcgcggcccctgccgccggggaggagcccagcaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctctgcagaagagcccaagccggtggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaaaaaggtctggcgtccattggcagtcccagtttctcttccattcctggtgtccacagacaccacaaccactcattgcaatgtggacaaaaaaaacaaaaaaaaaaacccacaaacaatctgttcccaggggctgtgccttggaacattttatttgtcacggggtataaaggggggccacccggctattcaaggtttcaaccacttcacacaggcaaaaacaaacaacaaacctctcccacaggcggcgggaatccgcgggccaataaggggggcgcgaagagacccctctccgaggggggggggcgcccggagacccacacgctttggtgctcccccttataaaaagagagcgggataaaattccagccaccctctggggggataacaccgcgggggcccaaaaccgtgcaccccgtgggttacacaatcgtgctaatccgggccaccaaaatttccaac

SEQ ID NO: 36817 - DNA, 1989 bp, Homo sapiens
agcgtgtgggagcgagcgcgagaaatgcagaggctgcagcggcggcggcggcggcagtagcggcagcggcgacgacggcggcggcagcgctccaactggctcctcgctccgggctccgccgtcgagccgggagagagcctccgccagcggccaggcaccagccagacgacgccagcgaccccggcctctcggcggcaccgcgctaactcaggggctgcataggcacccagagccgaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgcagagcccgccgaggccaaggagggcaaggagaagcccgaccaggacgccgagggcaaggccgaggagaaggagggcgagaaggacgcggcggctgccaaggaggaggccccgaaggcggagcccgagaagacgcccagcaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctctgcagaagagcccaagccggtggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaaaaaggtctggcgtccattggcagtcccagtttctcttccattcctggtgtccacagacaccacaaccactcattgcaatgtggacaaaaaaaacaaaaaaaaaaacccacaaacaatctgttcccaggggctgtgccttggaacattttatttgtcacggggtataaaggggggccacccggctattcaaggtttcaaccacttcacacaggcaaaaacaaacaacaaacctctcccacaggcggcgggaatccgcgggccaataaggggggcgcgaagagacccctctccgaggggggggggcgcccggagacccacacgctttggtgctcccccttataaaaagagagcgggataaaattccagccaccctctggggggataacaccgcgggggcccaaaaccgtgcaccccgtgggttacacaatcgtgctaatccgggccaccaaaatttccaac

SEQ ID NO: 36818 - DNA, 1676 bp, Homo sapiens
agcgtgtgggagcgagcgcgagaaatgcagaggctgcagcggcggcggcggcggcagtagcggcagcggcgacgacggcggcggcagcgctccaactggctcctcgctccgggctccgccgtcgagccgggagagagcctccgccagcggccaggcaccagccagacgacgccagcgaccccggcctctcggcggcaccgcgctaactcaggggctgcataggcacccagagccgaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgcagagcccgccgaggccaaggagggcaaggagaagcccgaccaggacgccgagggcaaggccgaggagaaggagggcgagaaggacgcggcggctgccaaggaggaggccccgaaggcggagcccgagaagacggagggcgcggcagaggccaaggctgagcccccgaaggcgcccgagcaggagcaggcggcccccggccccgctgcgggcggcgaggcccccaaagctgctgaggccgccgcggccccggccgagagcgcggcccctgccgccggggaggagcccagcaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctctgcagaagagcccaagccggtggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattgggcggtgaacctcttctggtccaggtat

SEQ ID NO: 36819 - DNA, 1840 bp, Homo sapiens
aagcttgcggccgcagagcccgccgaggccaaggagggcaaggagaagcccgaccaggacgccgagggcaaggccgaggagaaggagggcgagaaggacgcggcggctgccaaggaggtggctcctcgctccgggctccgccgtcgagccgggagagagcctccgccagcggccaggcaccagccagacgacgccagcgaccccggcctctcggcggcaccgcgctaactcaggggctgcataggcacccagagccgaactccaagatgggaggcaagctcagcaagaagaagaagggctacaatgtgaacgacgagaaagccaaggagaaagacaagaaggccgagggcgcggcgacggaagagcccagcaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctctgcagaagagcccaagccggtggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaaaaaggtctggcgtccattggcagtcccagtttctcttccattcctggtgtccacagacaccacaaccactcattgcaatgtggacaaaaaaaacaaaaaaaaaaacccacaaacaatctgttcccaggggctgtgccttggaacattttatttgtcacggggtataaaggggggccacccggctattcaaggtttcaaccacttcacacaggcaaaaacaaacaacaaacctctcccacaggcggcgggaatccgcgggccaataaggggggcgcgaagagacccctctccgaggggggggggcgcccggagacccacacgctttggtgctcccccttataaaaagagagcgggataaaattccagccaccctctggggggataacaccgcgggggcccaaaaccgtgcaccccgtgggttacacaatcgtgctaatccgggccaccaaaatttccaac

SEQ ID NO: 36820 - DNA, 1511 bp, Homo sapiens
gaattcaagcttgattgctgcaggaattcggcaagacccagcaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctctgcagaagagcccaagccggtggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaaaaaggtctggcgtccattggcagtcccagtttctcttccattcctggtgtccacagacaccacaaccactcattgcaatgtggacaaaaaaaacaaaaaaaaaaacccacaaacaatctgttcccaggggctgtgccttggaacattttatttgtcacggggtataaaggggggccacccggctattcaaggtttcaaccacttcacacaggcaaaaacaaacaacaaacctctcccacaggcggcgggaatccgcgggccaataaggggggcgcgaagagacccctctccgaggggggggggcgcccggagacccacacgctttggtgctcccccttataaaaagagagcgggataaaattccagccaccctctggggggataacaccgcgggggcccaaaaccgtgcaccccgtgggttacacaatcgtgctaatccgggccaccaaaatttccaac

SEQ ID NO: 36821 - DNA, 1500 bp, Homo sapiens
gtcatctaaggatcccgtaagtgagcccagcaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctctgcagaagagcccaagccggtggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaaaaaggtctggcgtccattggcagtcccagtttctcttccattcctggtgtccacagacaccacaaccactcattgcaatgtggacaaaaaaaacaaaaaaaaaaacccacaaacaatctgttcccaggggctgtgccttggaacattttatttgtcacggggtataaaggggggccacccggctattcaaggtttcaaccacttcacacaggcaaaaacaaacaacaaacctctcccacaggcggcgggaatccgcgggccaataaggggggcgcgaagagacccctctccgaggggggggggcgcccggagacccacacgctttggtgctcccccttataaaaagagagcgggataaaattccagccaccctctggggggataacaccgcgggggcccaaaaccgtgcaccccgtgggttacacaatcgtgctaatccgggccaccaaaatttccaac

SEQ ID NO: 36822 - DNA, 1743 bp, Homo sapiens
agcgtgtgggagcgagcgcgagaaatgcagaggctgcagcggcggcggcggcggcagtagcggcagcggcgacgacggcggcggcagcgctccaactggctcctcgctccgggctccgccgtcgagccgggagagagcctccgccagcggccaggcaccagccagacgacgccagcgaccccggcctctcggcggcaccgcgctaactcaggggctgcataggcacccagagccgaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgcagagcccgccgaggccaaggagggcaaggagaagcccgaccaggacgccgagggcaaggccgaggagaaggagggcgagaaggacgcggcggctgccaaggaggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaaaaaggtctggcgtccattggcagtcccagtttctcttccattcctggtgtccacagacaccacaaccactcattgcaatgtggacaaaaaaaacaaaaaaaaaaacccacaaacaatctgttcccaggggctgtgccttggaacattttatttgtcacggggtataaaggggggccacccggctattcaaggtttcaaccacttcacacaggcaaaaacaaacaacaaacctctcccacaggcggcgggaatccgcgggccaataaggggggcgcgaagagacccctctccgaggggggggggcgcccggagacccacacgctttggtgctcccccttataaaaagagagcgggataaaattccagccaccctctggggggataacaccgcgggggcccaaaaccgtgcaccccgtgggttacacaatcgtgctaatccgggccaccaaaatttccaac

SEQ ID NO: 36823 - DNA, 1321 bp, Homo sapiens
  misc_feature (53)..(53): n is a, c, g, or t
cagagccgaactccaagatgggaggcaagcccagcaaggaggaaggggaaccnaaaaagactgaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaaaaaggtctggcgtccattggcagtcccagtttctcttccattcctggtgtccacagacaccacaaccactcattgcaatgtggacaaaaaaaacaaaaaaaaaaacccacaaacaatctgttcccaggggctgtgccttggaacattttatttgtcacggggtataaaggggggccacccggctattcaaggtttcaaccacttcacacaggcaaaaacaaacaacaaacctctcccacaggcggcgggaatccgcgggccaataaggggggcgcgaagagacccctctccgaggggggggggcgcccggagacccacacgctttggtgctcccccttataaaaagagagcgggataaaattccagccaccctctggggggataacaccgcgggggcccaaaaccgtgcaccccgtgggttacacaatcgtgctaatccgggccaccaaaatttccaac

SEQ ID NO: 36824 - DNA, 1249 bp, Homo sapiens
aggcatggtactggcccggagtgttgggataagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaaaaaggtctggcgtccattggcagtcccagtttctcttccattcctggtgtccacagacaccacaaccactcattgcaatgtggacaaaaaaaacaaaaaaaaaaacccacaaacaatctgttcccaggggctgtgccttggaacattttatttgtcacggggtataaaggggggccacccggctattcaaggtttcaaccacttcacacaggcaaaaacaaacaacaaacctctcccacaggcggcgggaatccgcgggccaataaggggggcgcgaagagacccctctccgaggggggggggcgcccggagacccacacgctttggtgctcccccttataaaaagagagcgggataaaattccagccaccctctggggggataacaccgcgggggcccaaaaccgtgcaccccgtgggttacacaatcgtgctaatccgggccaccaaaatttccaac

SEQ ID NO: 36825 - DNA, 1045 bp, Homo sapiens
gcacgagctcgtgccgctcgtgccgtgtcccatcaagggagggagggggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaaaaaggtctggcgtccattggcagtcccagtttctcttccattcctggtgtccacagacaccacaaccactcattgcaatgtggacaaaaaaaacaaaaaaaaaaacccacaaacaatctgttcccaggggctgtgccttggaacattttatttgtcacggggtataaaggggggccacccggctattcaaggtttcaaccacttcacacaggcaaaaacaaacaacaaacctctcccacaggcggcgggaatccgcgggccaataaggggggcgcgaagagacccctctccgaggggggggggcgcccggagacccacacgctttggtgctcccccttataaaaagagagcgggataaaattccagccaccctctggggggataacaccgcgggggcccaaaaccgtgcaccccgtgggttacacaatcgtgctaatccgggccaccaaaatttccaac

SEQ ID NO: 36826 - DNA, 1029 bp, Homo sapiens
gcagtttaagatcattttattgaagagcaagggtgggagaatccaaatagtatttttgtggggaaatatctaatataccttcagtcaactttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaaaaaggtctggcgtccattggcagtcccagtttctcttccattcctggtgtccacagacaccacaaccactcattgcaatgtggacaaaaaaaacaaaaaaaaaaacccacaaacaatctgttcccaggggctgtgccttggaacattttatttgtcacggggtataaaggggggccacccggctattcaaggtttcaaccacttcacacaggcaaaaacaaacaacaaacctctcccacaggcggcgggaatccgcgggccaataaggggggcgcgaagagacccctctccgaggggggggggcgcccggagacccacacgctttggtgctcccccttataaaaagagagcgggataaaattccagccaccctctggggggataacaccgcgggggcccaaaaccgtgcaccccgtgggttacacaatcgtgctaatccgggccaccaaaatttccaac

SEQ ID NO: 36827 - DNA, 1168 bp, Homo sapiens
agcgtgtgggagcgagcgcgagaaatgcagaggctgcagcggcggcggcggcggcagtagcggcagcggcgacgacggcggcggcagcgctccaactggctcctcgctccgggctccgccgtcgagccgggagagagcctccgccagcggccaggcaccagccagacgacgccagcgaccccggcctctcggcggcaccgcgctaactcaggggctgcataggcacccagagccgaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgcagagcccgccgaggccaaggagggcaaggagaagcccgaccaggacgccgagggcaaggccgaggagaaggagggcgagaaggacgcggcggctgccaaggaggaggccccgaaggcggagcccgagaagacggagggcgcggcagaggccaaggctgagcccccgaaggcgcccgagcaggagcaggcggcccccggccccgctgcgggcggcgaggcccccaaagctgctgaggccgccgcggccccggccgagagcgcggcccctgccgccggggaggagcccagcaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctctgcagaagagcccaagccggtggaggccccggcagctaattccgaccaaaccgtaaccgtgaaagagtgacaaggacagcctataggaaaaacaataccacttaaaacaatctcctctctctctctctctctctctctctatctctctctctatctcctctctctctctcctctcctatctctcctctctctctctcctatactaacttgtttcaaattggaagtaatgatatgtattgcccaaggaaaaatacaggatgttgtcccatcaagggagggaggtatgctctgattaagatcctgagagtca

SEQ ID NO: 36828 - DNA, 998 bp, Homo sapiens
cgtttatttcatcagcgtgactggggtttcatttaaatttaatgtaccgtggccgcaatttaccaagaagtcctggatttccaagatccgcgtctgaaagtgcagtacatcgtttgtacctgaaactgccgccacatgcactcctccaccgctgagagttgaatagcttttcttctgcaatgggagttgggagtgatgcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgtagttctgtttattggtcagtggaaatgaaaaaaaaaaaaaaaaaaaaaaggtctggcgtccattggcagtcccagtttctcttccattcctggtgtccacagacaccacaaccactcattgcaatgtggacaaaaaaaacaaaaaaaaaaacccacaaacaatctgttcccaggggctgtgccttggaacattttatttgtcacggggtataaaggggggccacccggctattcaaggtttcaaccacttcacacaggcaaaaacaaacaacaaacctctcccacaggcggcgggaatccgcgggccaataaggggggcgcgaagagacccctctccgaggggggggggcgcccggagacccacacgctttggtgctcccccttataaaaagagagcgggataaaattccagccaccctctggggggataacaccgcgggggcccaaaaccgtgcaccccgtgggttacacaatcgtgctaatccgggccaccaaaatttccaac

SEQ ID NO: 36829 - DNA, 943 bp, Homo sapiens
agcgtgtgggagcgagcgcgagaaatgcagaggctgcagcggcggcggcggcggcagtagcggcagcggcgacgacggcggcggcagcgctccaactggctcctcgctccgggctccgccgtcgagccgggagagagcctccgccagcggccaggcaccagccagacgacgccagcgaccccggcctctcggcggcaccgcgctaactcaggggctgcataggcacccagagccgaactccaagatgggaggcaagctcagcaagaagaagaagggctacaatgtgaacgacgagaaagccaaggagaaagacaagaaggccgagggcgcggcgacggaagaggaggggaccccgaaggagagtgagccccaggcggccgcagagcccgccgaggccaaggagggcaaggagaagcccgaccaggacgccgagggcaaggccgaggagaaggagggcgagaaggacgcggcggctgccaaggaggaggccccgaaggcggagcccgagaagacggagggcgcggcagaggccaaggctgagcccccgaaggcgcccgagcaggagcaggcggcccccggccccgctgcgggcggcgaggcccccaaagctgctgaggccgccgcggccccggccgagagcgcggcccctgccgccggggaggagcccagcaaggaggaaggggaacccaaaaagactgaggcgcccgcagctcctgccgcccaggagaccaaaagtgacggggccccagcttcagactcaaaacccggcagctcggaggctgccccctcttccaaggagacccccgcagccacggaagcgcctagttccacacccaaggcccagggccccgcagcctctgcagaagagcccaagccggtggaggccccggcagctaattccgacctacccaccgcctttccccccgacattccccccgtccta

SEQ ID NO: 36830 - DNA, 910 bp, Homo sapiens
agcgtgtgggagcgagcgcgagaaatgcagaggctgcagcggcggcggcggcggcagtagcggcagcggcgacgacggcggcggcagcgctccaactggctcctcgctccgggctccgccgtcgagccgggagagagcctccgccagcggccaggcaccagccagacgacgccagcgaccccggcctctcggcggcaccgcgctaactcaggggctgcataggcacccagagccgaactccaagatgggaggcaagctcagcaagaagaagaagggctacaatgtgaacgacgagaaagccaaggagaaagacaagaaggccgagggcgcggcgacggaagaggaggggaccccgaaggagagtgagccccatgtgctgtgcctgcatgatgccctgcctgatgtgccaatggatgtgtgcaatggatgaatgccctgaccatgtgactgcctgatgtgtgcaatggcctgagtgaggaactgtgaggggctgatgaatgtgactgctgtgctgtgcttgcccaaattgggaatggggatgtgcccccctgtatatgggctgtgatgccccctggagaaatgactgtgatgtgtgctgcctgtgctatgaatgtgcccaaattgtggcctttggaaaggcccccctctggaaaatggtggctggccccctggaatgccatgtggatgcctatgttgctggtggccccccccctggtgacccccccctgggcttgcctggtgtggcttgtggctggattgtggcccctccccaaaatggcttgccttagattgtggcctggcctggctgtggccccccttgggccccggaaggatgcctggcttgtgctccccctttggcccttgctctggggtgtggaatgtgggaggcccccttatggctaaatgggcg

SEQ ID NO: 36831 - DNA, 3059 bp, Homo sapiens
cccagattttaattttggggttggctcaaactagtgaaaactatgactcaatggccaattgctttatcaaatttgataactaaaacttaaaatgaatatggaaaatcagaaagcaactctattttagagctattttgtaagagttgtgctttctttaacaccatctgtagtcttaagtttgtctctagctagaactgaacaaagctctataatttttaccaagcacttattattaatacttcttataagtagtaagcatctttactaacacaactgagaattaagtcataaaacataactaatacagcacattactgcctgacaaaattaaagagtactgtgtgtatgtataactactacaggttaacacttcacccaaatgatagcgtttttcctcagtagattattgtcaaataggaatttctaagcacattgagtcaaagcattttttccaagttaataaagtgttatttactatctttgttagaggtgacatgtcaaacactacagtgagctctgtggggtttttttttttttttttttgcccgtgagttttttaccatgctgctctgaccagtttgagtggcaattaccaatagatttgttttctttattctatggagatgtttttaccactgacactgttttctgattatagtctgcttcatagaaaatagcctgcataatcaaacaaggagttactttgaaattaaagtatgcctggctattaaaaatgcagattttaggtgggtaaacatcaggtaggtctgggtgggtcatgttctaggcctagaaaaatacactattagacaagttctaaagaaggcaaggagataaaggcatcaggtggtaacttctaattgaatattatatgttgatcatacataatatatactatgcctggaaattatgactgaaaagcacctattcggttagtgctcctattcatgagaacatatctccaatactaaatgagataagcctgttctaaaatcttatagccagtattttaagaaacttgattatacttaccaaaggaacattgttgttttctcttgttttaaatatggagaggtttaatcctttacataacaaaggaattaattttagcaaaatgattcattccaaccttcttataagaaatatctaggagagtcaagtaagaaaaataacgaatctaagtgataaacattcaagaaattctctaaataagagatttatttataattttaatatctcagggttctttttaggtttccaggggaaaagagcaggataacagtgtggagactgctaagttgagaatttaaaacaaatgagaacataagatttttaaaattgcattgtgaatgtaaaatttttatcaatcctttgctctcttttagacatattgagaaaatgttaaatagaaaaaattaagtaattttaataagatgtttcagatctttgagtatgaaaaacataacaaaaaagcctaatttcaaaaaactatttgagatcaagggacaatggtgtgaccaatatgaagggtcaagactgaaatgtattgtctttactatcaagaactctactttcagttgtttctcagacagttaatttcagcttcatagagatttctgagcaaattaagaaacactgttttcctgggtttgttttgggtatatgtcattatagttatgttatttcttgttgaaatttataattgtaggttttttgtattgttttagtatttaatggtgtataatgtgttattacattatatgtagttataccaaaatattgcctgaagataaatcatgacaaggtcccctgtttattcctgtgttacagacgcatggaattgctcctgtagatttgaatttttgtttcatttttttctgtcccacccttcactctctctgtttcagaacatttttggtagaagtgctatccagaagtgaacttgtcaaaaggcaagtagcatgaaagaagacagaagaagcaaaaggctaatacagtggataatttctgagcacttgaagtttcttcaaatgtgcaagactgtgtgtcttcctattagatgtataaattggatatttcatgcctaattaaatgttgcgttggattgcagtgcctatcatacagtgattggagtaaattgaggcctaatcctgaacacatatagagcatattgttagatatttttcctgtgacatttgaagttattattctcccatttcctttttctttttttgtttataatcatatgtccctaagattgttttccttttttggaccaaaaaaaagaaaaaaaaaatcttagcttttcatcctcccagtgtattctgcattgtccttaccctagatcagccccttctgtgttaacagtttttctcacaatgtagcaacttttatccacccttcaggaccttcactgggactagttcattcattttcaaatagctatttcaacctttaacatctactgtcttagtcttttacacagaagccagagtgactggtcttggcaagactctgttgtgtatcaccactctaaccttactgatttgtttcagcaaatttgctttagttaaattgctttactcagattcccccaaactttatatgtgtattgtcatctttgtgcatattatttctcatgcatgaaatactcaatttttattcttttatctaacgcttactcttacatttctttaaagctctggccaagtattttatttcgtccctaaacattctaactatccaccaaactggtaagttggcttttctttttcctccccctgtcattcatttagctgttatatttcattttaatgttttgggtggtgcctcttatactatgttgtattcctagacaaggaaatgtatatcaaaatatgttagatgattgattgttttatctccttgatgatagcacctcttatactgctttacagaatcaggaaaaagtaaactgcattttacatagtggttttaaatattgattgattgatattctaaacctggtttcctatataaagttgtaagttcaagataaagagaccacattctttactcat

SEQ ID NO: 36832 - DNA, 3035 bp, Homo sapiens
cccagattttaattttggggttggctcaaactagtgaaaactatgactcaatggccaattgctttatcaaatttgataactaaaacttaaaatgaatatggaaaatcagaaagcaactctattttagagctattttgtaagagttgtgctttctttaacaccatctgtagtcttaagtttgtctctagctagaactgaacaaagctctataatttttaccaagcacttattattaatacttcttataagtagtaagcatctttactaacacaactgagaattaagtcataaaacataactaatacagcacattactgcctgacaaaattaaagagtactgtgtgtatgtataactactacaggttaacacttcacccaaatgatagcgtttttcctcagtagattattgtcaaataggaatttctaagcacattgagtcaaagcattttttccaagttaataaagtgttatttactatctttgttagaggtgacatgtcaaacactacagtgagctctgtggggtttttttttttttttttttgcccgtgagttttttaccatgctgctctgaccagtttgagtggcaattaccaatagatttgttttctttattctatggagatgtttttaccactgacactgttttctgattatagtctgcttcatagaaaatagcctgcataatcaaacaaggagttactttgaaattaaagtatgcctggctattaaaaatgcagattttaggtgggtaaacatcaggtaggtctgggtgggtcatgttctaggcctagaaaaatacactattagacaagttctaaagaaggcaaggagataaaggcatcaggtggtaacttctaattgaatattatatgttgatcatacataatatatactatgcctggaaattatgactgaaaagcacctattcggttagtgctcctattcatgagaacatatctccaatactaaatgagataagcctgttctaaaatcttatagccagtattttaagaaacttgattatacttaccaaaggaacattgttgttttctcttgttttaaatatggagaggtttaatcctttacataacaaaggaattaattttagcaaaatgattcattccaaccttcttataagaaatatctaggagagtcaagtaagaaaaataacgaatctaagtgataaacattcaagaaattctctaaataagagatttatttataattttaatatctcagggttctttttaggtttccaggggaaaagagcaggataacagtgtggagactgctaagttgagaatttaaaacaaatgagaacataagatttttaaaattgcattgtgaatgtaaaatttttatcaatcctttgctctcttttagacatattgagaaaatgttaaatagaaaaaattaagtaattttaataagatgtttcagatctttgagtatgaaaaacataacaaaaaagcctaatttcaaaaaactatttgagatcaagggacaatggtgtgaccaatatgaagggtcaagactgaaatgtattgtctttactatcaagaactctactttcagttgtttctcagacagttaatttcagcttcatagagatttctgagcaaattaagaaacactgttttcctgggtttgttttgggtatatgtcattatagttatgttatttcttgttgaaatttataattgtaggttttttgtattgttttagtatttaatggtgtataatgtgttattacattatatgtagttataccaaaatattgcctgaagataaatcatgacaaggtcccctgtttattcctgtgttacagacgcatggaattgctcctgtagatttgaatttttgtttcatttttttctgtcccacccttcactctctctgtttcagaacatttttggtagaagtgctatccagaagtgaacttgtcaaaaggcaagtagcatgaaagaagacagaagaagcaaaaggctaatacagtggataatttctgagcacttgaagtttcttcaaatgtgcaagactgtgtgtcttcctattagatgtataaattggatatttcatgcctaattaaatgttgcgttggattgcagtgcctatcatacagtgattggagtaaattgaggcctaatcctgaacacatatagagcatattgttagatatttttcctgtgacatttgaagttattattctcccatttcctttttctttttttgtttataatcatatgtccctaagattgttttccttttttggaccaaaaaaaagaaaaaaaaaatcttagcttttcatcctcccagtgtattctgcattgtccttaccctagatcagccccttctgtgttaacagtttttctcacaatgtagcaacttttatccacccttcaggaccttcactgggactagttcattcattttcaaatagctatttcaacctttaacatctactgtcttagtcttttacacagaagccagagtgactggtcttggcaagactctgttgtgtatcaccactctaaccttactgatttgtttcagcaaatttgctttagttaaattgctttactcagattcccccaaactttatatgtgtattgtcatctttgtgcatattatttctcatgcatgaaatactcaatttttattcttttatctaacgcttactcttacatttctttaaagctctggccaagtattttatttcgtccctaaacattctaactatccaccaaactggggccctctgatccatccaaaaagcccggcatcaggaaagacaatttcaaaactgaagtttgattttgggaagcctattaaatatgttagaagttcaaaccacttgatattatgaaatagaatttcatattaccataagttatttattttgtcaaaatgatgactccaaaattttaaagaagcaaaaacctttttataaccctttacaaattttgctaaagatgtgcttttattttaatgctcaatttacagaaaaaatatataataccttttttgaattta

SEQ ID NO: 36833 - DNA, 2688 bp, Homo sapiens
aacgatgcgcactgctggagacgggcgaccttcgctggccggtcggtgggttcctggttttctgctgccgagtaaacaaacgttccctttcctaacttagcagtcacagagctatttccaagagttgttcttaatttcctgtgcgatattcccattggctatttaacactgaacattctgtttttgaatcaaagttagttaaaatttgttgtcaataagtttaacattctgttcttccgcgtgatggattttcttttggagattcgaactgaagcctgtacggaggaaatgttgtttttaagggaaatgaatagaaacaatccactttgaagaagccatggcgaaatcaaagacaaaacatagactttgttctcaggaatcttcagtatctgccctgctggcaagctgcaccctgagtggtagtaattcctctaattctgatggctcgtttcactataaagataagctgtacagatctgcttctcaagctctacaggcttatattgatgattttgatttaggccaaatatatcctggtgcaagcactggaaaaattaacattgatgaggattttactaatatgtcacagttctgcaactatatttacaaaccaaacaatgcttttgaaaaccttgatcacaaaaagcactcaaacttcatatcctgtagaagacacaccgttaatgacatagactccatgagcctaacaactgatgatctattaagactcccagcagatggatcattttcttatacttatgttggaccgagtcacccaacgagcaagaaaaacaagaaatgccgtggaagactgggttcattggacattgagaagaatccacattttcaaggaccctacacttccatgggcaaggataactttgttactcctgttatacgctcaaatataaatggaaagcaatgtggtgacaaaattgaattgcttatcttgaaggccaagagaaatctagagcagtgtactgaagaattaccaaagtccatgaaaaaggatgacagtccttgctcattagataaacttgaagcagacagatcatgggaaaatattcctgttactttcaaatctcctgttcccgttaactctgatgatagtcctcaacaaacttcaagggcaaagagtgctaaaggggttcttgaagactttctaaataatgataatcagagctgtactctctctggaggcaaacatcatggtcctgttgaagccctgaaacaaatgttatttaaccttcaagcagtacaagaacgttttaatcaaaataagaccacagatccaaaagaagagattaaacaagtttcagaagatgatttctctaaattacagttgaaggaaagtatgattcctattactaggtcacttcagaaggctttgcaccatttatctcgcctgagagacctggttgatgatacgaatggagaacggtcaccgaaaatgtgaagaggaaaatgaaactgtcaccacaatgaatagtcaccacagaacaaataggcattttttctattacttaaactgacaaaaacatttttggtagaagtgctatccagaagtgaacttgtcaaaaggcaagtagcatgaaagaagacagaagaagcaaaaggctaatacagtggataatttctgagcacttgaagtttcttcaaatgtgcaagactgtgtgtcttcctattagatgtataaattggatatttcatgcctaattaaatgttgcgttggattgcagtgcctatcatacagtgattggagtaaattgaggcctaatcctgaacacatatagagcatattgttagatatttttcctgtgacatttgaagttattattctcccatttcctttttctttttttgtttataatcatatgtccctaagattgttttccttttttggaccaaaaaaaagaaaaaaaaaatcttagcttttcatcctcccagtgtattctgcattgtccttaccctagatcagccccttctgtgttaacagtttttctcacaatgtagcaacttttatccacccttcaggaccttcactgggactagttcattcattttcaaatagctatttcaacctttaacatctactgtcttagtcttttacacagaagccagagtgactggtcttggcaagactctgttgtgtatcaccactctaaccttactgatttgtttcagcaaatttgctttagttaaattgctttactcagattcccccaaactttatatgtgtattgtcatctttgtgcatattatttctcatgcatgaaatactcaatttttattcttttatctaacgcttactcttacatttctttaaagctctggccaagtattttatttcgtccctaaacattctaactatccaccaaactggtaagttggcttttctttttcctccccctgtcattcatttagctgttatatttcattttaatgttttgggtggtgcctcttatactatgttgtattcctagacaaggaaatgtatatcaaaatatgttagatgattgattgttttatctccttgatgatagcacctcttatactgctttacagaatcaggaaaaagtaaactgcattttacatagtggttttaaatattgattgattgatattctaaacctggtttcctatataaagttgtaagttcaagataaagagaccacattctttactcat

SEQ ID NO: 36834 - DNA, 1917 bp, Homo sapiens
aacgatgcgcactgctggagacgggcgaccttcgctggccggtcggtgggttcctggttttctgctgccgagtaaacaaacgttccctttcctaacttagcagtcacagagctatttccaagagttgttcttaatttcctgtgcgatattcccattggctatttaacactgaacattctgtttttgaatcaaagttagttaaaatttgttgtcaataagtttaacattctgttcttccgcgtgatggattttcttttggagattcgaactgaagcctgtacggaggaaatgttgtttttaagggaaatgaatagaaacaatccactttgaagaagccatggcgaaatcaaagacaaaacatagactttgttctcaggaatcttcagtatctgccctgctggcaagctgcaccctgagtggtagtaattcctctaattctgatggctcgtttcactataaagataagctgtacagatctgcttctcaagctctacaggcttatattgatgattttgatttaggccaaatatatcctggtgcaagcactggaaaaattaacattgatgaggattttactaatatgtcacagttctgcaactatatttacaaaccaaacaatgcttttgaaaaccttgatcacaaaaagcactcaaacttcatatcctgtagaagacacaccgttaatgacatagactccatgagcctaacaactgatgatctattaagactcccagcagatggatcattttcttatacttatgttggaccgagtcacccaacgagcaagaaaaacaagaaatgccgtggaagactgggttcattggacattgagaagaatccacattttcaaggaccctacacttccatgggcaaggataactttgttactcctgttatacgctcaaatataaatggaaagcaatgtggtgacaaaattgaattgcttatcttgaaggccaagagaaatctagagcagtgtactgaagaattaccaaagtccatgaaaaaggatgacagtccttgctcattagataaacttgaagcagacagatcatgggaaaatattcctgttactttcaaatctcctgttcccgttaactctgatgatagtcctcaacaaacttcaagggcaaagagtgctaaaggggttcttgaagactttctaaataatgataatcagagctgtactctctctggaggcaaacatcatggtcctgttgaagccctgaaacaaatgttatttaaccttcaagcagtacaagaacgttttaatcaaaataagaccacagatccaaaagaagagattaaacaagtttcagaagatgatttctctaaattacagttgaaggaaagtatgattcctattactaggtcacttcagaaggctttgcaccatttatctcgcctgagagacctggttgatgatacgaatggagaacggtcaccgaaaatgtgaagaggaaaatgaaactgtcaccacaatgaatagtcaccacagaacaaataggcattttttctattacttaaactgacaaaaacatttttggtagaagtgctatccagaagtgaacttgtcaaaagctctggccaagtattttatttcgtccctaaacattctaactatccaccaaactggggccctctgatccatccaaaaagcccggcatcaggaaagacaatttcaaaactgaagtttgattttgggaagcctattaaatatgttagaagttcaaaccacttgatattatgaaatagaatttcatattaccataagttatttattttgtcaaaatgatgactccaaaattttaaagaagcaaaaacctttttataaccctttacaaattttgctaaagatgtgcttttattttaatgctcaatttacagaaaaaatatataataccttttttgaattta

SEQ ID NO: 36835 - DNA, 383 bp, Homo sapiens
tgtacagatctgcttctcaagctctacaggcttatattgatgattttgatttaggccaaatatatcctggtgcaagcactggaaaaattaacattgatgaggattttactaatatgtcacagttctgcaactatatttacaaaccaaacaatggtatgcttttattctttgttttctttgtgttcagatgttttgaagcatttgggagatgtactgtagtattgtaaagtttgacattatttttgttactttggagtaaaaataacataatattgagatctgggtgtttttgtaaaatgattatataattctctgtggaacagtaatattcacaagatgttaagagtttgtccataataaagcttccttgaagacaagtttgg

SEQ ID NO: 36836 - DNA, 457 bp, Homo sapiens
gtcccttatctttctgctttgaagagttcaagtgcaaaagcagataattttattacaaaaatggaaattataaccaaacacaatgatccactatggccgttttgttaatagtcttgttaaaaatatgtaatagtgtactcgggaggctgaggcaggaaaatggcgtgaacctggaaggcagagcttgcggtgagccgagatcacgccactgcactcctgcctgggaaacagaacaagactccattccaaaaaaaaaaaaaaaaaaaaaaaatttactggaaactttaaacataaaaaaactatttttttaggtcttctgctataataatactatatctaaaaaataacaattcaaattattctgctatattaacctataattcaatcttatctggacagtttggcatataggaagcactcaactatagaacaaatgagtaggacatggcaaaaacag

SEQ ID NO: 36837 - DNA, 1813 bp, Homo sapiens
ggcaatagcgtttatggcagcatttagcggacacagaagcacatctgaaagtggagagagacgcgtttccccattgctggccgagtcccaccactttgctcagctatgaacacctgacatctcgtttcattttcatgcaaaatctggagataattattatccacaattctaaggccttaggcccctccgcatgagcctgccattaccacttcattcccttgcacctgaaagactccagagccccttgaaagaacaggtcctccaagaggagcatcgccagccagcccctgaatctcctgaggaaactctcatgcacatatcttgacctgagcacagaccggacgccagcggagggcaggagcaagcaggacacactgtggctgaggaggggaccctgggcttgtgggcctcggagaggcagagcaggggaggcagatgagactgcacacagctttttgtttgacatatcctaagccccctgcacacgccactcaaggtcttctctgtgccccatctggtgcaggaggcctgtctgtctgtgaaattgcttttagcaatagctgtggatcaccactgagagggtgaatatacaaatgaacaatgggcagaccgtctatgatggcaaaacttggacctccaaccttgaggccaaagcacatcatgtgcggcctctggcgggactcaggtctgggaagcgactgcagcttccctattttctagctctgcttccaactaagaaagtcagatattctccccaaaccaaccccataggatgcccgctgccaggtggcccacccccagcttccccctgacaacagcctccacccagggcatacccaaccagagccttcccatcttctaatgggaagcttcccctccccaccccaccttcaaggctctgccacgcgcagggacagtgtagccttcttggctacagcttcgagtgagcagcctctgccatcctcgctgatgtccccggttaccgtgaaggctcctccaggacactgtctgcactgcctgtcgtccagaccccacctctgcccaggcaccctggccttaatgctgcagcccacagggcacccagctggtgactgaggcctgttctgagcccctcgctggcacattcctggacttctcagtttggtgccagggcctcattcctgcttcccatttgctctgttacaggggaattagtcccttcctttactcttttgtgctgtgctttctaaacgtggtgtttgtcataataagaagcatgaggggcacatggatcagcctcacagacaggtgagtctgtagctcttaccagacccttgttcacatccatgaacttggctgtggatcaccagggaaactgggtgaggttctgccatccaggggttttgtcctgagaacttggcttttagaacattctctctggttttttgcttgggggtgggggtctggtgcagggtgctgggtctgtgtttggaggaggccagcccgtaggctgggggcctgagacactgtgcactggcgtgatgcgtctgccgcccatcaccagcttgcaggggcatccacggctgaatcctctgctcttccaggaaagacttatgcttctcatggtcctagttctcatgctgatctttctacttggcaaaattcaccaagggtgacttgggtttttggtggcaactctgggaacatttggcttgaaaaattgttcatttaagagattctttagagaagaaaatgagtaagattccctaggcctaaatgcagaggcctccaaatgaatttctgaataaaaaagtatttcgctaagaaaaaaatt

SEQ ID NO: 36838 - DNA, 383 bp, Homo sapiens
agtactgtaagttatcccatctctagttttagttccaaacttctgatgattgcacatttaccattatttgacaaaaactaaaaagtgttctgcccagattcttctagtgtctcatctttaacaggctcccccttggagaatatggagatatttattttcttccaatgttggcagtttttcaaacctgcaattgttcatttcctgttgaccaaagaattaaccttgtcagccgataattagtgagatggaagagaggcgtagtgatttggacccccagtggttggcagagtgggtttacaggggaagaaaccaacagttgggctgtttcattcattgtttggttgggagccccattgtggaagagatgggtggttacatgtgat

SEQ ID NO: 36839 - DNA, 324 bp, Homo sapiens
aacaaaagtgctgttcttagataagcatttgtgattttatctttttatggagactttggaaagatttgctctgatttccaacctcgaatactcttggaaaatatctgtattatttttactctattggattttaatgtgtgttttagaaaacaacatctgcagatagatggtgttgcacaacaatgtgaatatccttaataccacaaaactgcacttaaaaatggttacaatggtaacttttatgttatgtgtgttttacagcaattaaaaaataagacaataacagaactgtggtttgtattaaagatctagtaactctaatta

SEQ ID NO: 36840 - DNA, 352 bp, Homo sapiens
gaacagcaaaagcattaagctaagtgaacaaagctggacacaaataattatagaattccatttttatgacatactagagagtatgggacaaaagtcagatcagtggttgctcagggctgggagctggaggatgggattgcaaagggtggaaagaaactttttgtaaatatgtaaatatcttgtatcttgattttggtggaagttaacaactctggatattgttaaaactcatcaatgtacgttttaaaagggtgaattttactgtatataactcatacctcaataaacttgaataaaaaatacagtaatttttccttgtaattctagcagacttgtagtaaaaataaccttt

SEQ ID NO: 36841 - DNA, 168 bp, Homo sapiens
tggacagtgctgttgtgagcccccaagaggcagaaacagacacatggcccctccaaagggggaacaccaatgacctctccttccactgatgtgggggaagagactgaaggggagaaggtgtcaggttaggcccagcggcttttggccaacgtgtgtccactgtctttc

SEQ ID NO: 36842 - DNA, 882 bp, Homo sapiens
gatgatgaagtaaatcttatgtcagggagccacctgaagaagtcacatgagaactcagctattgtcactctgcctgtgtagctctgtttttctcagtctctgctttcaccatgaggctttctacaaatatcctggttgcactataccgtatggggcattaccaaggaagtacatgctctcactatcaattttatggaatagggaaaattcttaccatcatctaaattcaaggaacatttagccttacagagctggatcgagaaaaatgcacacatattctttattttaatagcttctattcatgacagtgtagtgattactggtggctttggtaccagacagagcctgggtttgaattacaattccagcacttactagatatgggttcttggacaaatgacttcacctccctcagtctcagtttcctcctctaaagggacatttgaaggctctgaaatatccagcatgcagtaactatgtggccttgagtaaatcatcaaatttttctgtgcttcagcttttgcatctgttaaatgaaagcaataacaatacctacctcatagggttgttgtgggaattaaatgagataatgcagtctgggcacagtggctcacgcctgtaatcccagcactttgagagactgatgcaggagaattgcttgaggctaggagttcaataccagcctggggaacatagagagatcctgtctctacaaaaaaaatgtaaaaattagctgggcatggtggtgcacatctgtagtcctagctacttgggaggctgaggtgggaggattgcttgagcccaggagtttgaggttacagtgagctgtgattgcaccactgtactctagcctgagtgacagagcaagaccctgactcaaaa

SEQ ID NO: 36843 - DNA, 330 bp, Homo sapiens
cccaccctggaggttcaggggtgggactgaaaattcaaagtttcttattaaggcttggcctttccggcaactagccctcatcctgaagctatctagaggcccaccaagagtcatctcattgaaacaaaagacactcccgtcaccctcagtactcagaaaattcttagggaattaggagctctgtgccaagaatggggacaaagaccaaatatctttctgtgataccacatacatacacttacacacagttatttcattatgtacggaaaagtatataaatgataaacagctcagtaaaacattgcaaagtgaatatatctatgagatgac

SEQ ID NO: 36844 - DNA, 392 bp, Homo sapiens
gcaatatggtgtgtatgtatacacacacacacaaaatggaataatagccacagaaaaaggaagtactgacatttgcaacaacatggatgaacctggaggatattatattaaatgaaataagccagacacagaaagacaaatattatataacctcatatttgcaatctaaaacaagtgaaactcctagaaacagaggtagaacggtggttaccaggggcttgagtgggagaaatggggagatgttggtcaaagggtgcaaattctcagttatataatgaacaagttctagaaatctaatgttcagtatgggcagtaatggatttgttaatttggttgcaataataatcatacaatgtatatgtgtattaaattatcatgatgtatgccatgca

SEQ ID NO: 36845 - DNA, 490 bp, Homo sapiens
tcaccccttcttcatttccctaaattcttatattccaaagccaattattctgggtatctaaagaatatatacctagcctcaaagtcccaaaaaatttggttgcatcaatggttgaaagagcatttttgaaatgctaatttcaaagcctacccaaagaatctcttttgcaaaatctctctgaggtgattctcacatgcatctgggtctgtcaccactagcccagttactagccttcattttacacatgagaaagctgagcccctatcccgtcaaaaaggggaagtaatttaatcaaaacaaaaagtgagttagggctgtgaaatcctaagattaatttcatttcaagatgtgacctggtcctctttctaaaaccccactgaaatgacagaattttataaaagagagtaagtcagctgcagcagcagcaaaacaacaaatacaaaaagaatacccttagtgaaccaaaactataaggacatgctagaagata

SEQ ID NO: 36846 - DNA, 420 bp, Homo sapiens
gtaataatagtgcaatatagcttcaaactgctgtgctcaagctatcctcctgcctcagcctcctgagtagctggaaatacaggtacagaccaccatgcctggctaatttttatatttttagtagagacagggtttcaccatgttggccaggctggtcttgaactcctgacctcaggtgatccacccaccttggcctcccaaagtgctgggattacaggcatgagccaccatgcccagccactcccttctgcatttttgatgctctggagagcgtcggcttcatactcaccattatggctgctgggttgcctcagtctcccaagctcccagcactgctgcagcaacggggagctgcatggcccacctggccaccatccgcgatgcttcccgccgccctggcggaggtgcggcctcagccct

SEQ ID NO: 36847 - DNA, 323 bp, Homo sapiens
cactttgtaactacaattgtcattatctgaactaaggtaagggctggaggcagagccagagcttcaagaaggaattggctaacacaaaagcaagaacatggattcttctgagaagtaaagaaagatgtttcccaaaagcaagcactttgtaggtggcgatgtgttgatgtgctgggtctgataaaaagtgatcccaacagaaagttcctctcatctccagcctaggaaatctttaggccttcactcagatcttcactcaggccttcccggaccaccctctcaaaaattttcaaccgctttctcctgcacacttgaactctccc

SEQ ID NO: 36848 - DNA, 2182 bp, Homo sapiens
accctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagacacagtgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttttgtgggtgtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagagtacccctttaaacacacacacacacacatgcacatacacacacacacacacacacacacacacagtgtgcaactagccccagttttgacagaataattcttggtcttccccaaagagacaatttgttgtacccatgactgttgcctgcaaaaataaaagggaaaaaaaagaaaaaagaaacaaaaaggaacttcttatagttgtcttttgtgaactttaaggttttgaaagaatcttcaattaaagcatggcagattcacctgtaaatatttagccttgaggggccattgatgtaaaacaattgtattgatggttgtttaacttttttgtttaatttttacagttacatccagctgttagatatgcaggaaaagatagtttgctggctagctctattcatttatgttagcattaatgcacatttttaaaaaaaga

SEQ ID NO: 36849 - DNA, 2147 bp, Homo sapiens
accctctgagccagtagtgccagcagtgatgatggccacccatgagcccagtgctgacctggcacccaagaaaaagcccaggaagtcaagcatgcctgtgaagattgagaaggaaattattgataccgccgatgagtttgatgatgaagatgatgaccccaatgatggtggagctgtggtcaatgacatgagccatgacaatcattgtcactcccaagaggagatgagcccaggcatgtctgtgaaggacttttctaagcataacaggacccggtgcatttcaaggactgaaataaggagggccgacagcatgacttctgaagaccaagaacctgagcgggactatgagaacgagtctgagtcttcggagcccaaactgggcgaggaatccatggaaggggatgagcacattcacagcgaagtgagtgaaaaagtcctgatgaatagtgagaggcctgatgagaaccacagtgagccctctcaccaggacgtcatcaaggtgaaggaagaatttacagaccccacttacgacatgttttacatgagccagtatggactgtacaatggtgggggtgccagcatggccgccttgcatgagagctttacatcgtctctgaattatggcagccctcaaaagttctccccagaaggtgacctatgttctagcccagaccccaaaatctgttatgtgtgcaagaagagtttcaaaagctcctacagtgtgaaacttcactacaggaacgttcacttgaaagagatgcacgtctgcacagtggctggttgcaatgctgcattcccctctcgccgaagccgagacagacacagtgccaacataaacctacatcgtaaactgttgaccaaagaactcgatgacatgggcctggactcgtcgcagccctcccttagcaaggacctccgcgatgaatttttggtgaagatatatggtgcccagcaccccatggggctcgatgtcagggaagacgcctcctctcccgcagggactgaagactcccacctgaacgggtatgggagaggcatggcagaggactacatggtccttgacttgagcaccacctccagcctccagtccagcagcagtatccattcctccagagaatccgacgcaggcagcgatgaggggattcttctcgatgacattgacggggcgagtgacagtggggagtcggcacacaaggccgaggcccctgccctccctggcagcctaggggctgaagtttcaggatctcttatgttcagcagcttgtctgggagcaatggtgggatcatgtgcaacatttgccacaaaatgtacagcaacaaggggaccctgagagtgcactacaaaactgtgcatttgagagaaatgcacaagtgcaaagtcccaggttgcaatatgatgttttcctctgtacgaagccgaaatcggcacagtcagaaccctaatctccacaaaaacattcccttcacttcagtagattagtctcagaatggacactacaaatgccagctctcaccagatggcctacgtgtttgaactgccatagtcagtgtgcgcttatgtacttttgtgggtgtgtgtgtgtgtgtgtgtgtgtgtgtgcatttatgtatgctctgtggctacatatacacacacgtatttccttgagataaacaagataaacactaggtgcttttgaatttttttcacttccctttatagttttgggaaaggagtgggatctttgatttcagggtgaaaacagagtaccccacacacacacacacacacacacagtgtgcaactagccccagttttgacagaataattcttggtcttccccaaagagacaatttgttgtacccatgactgttgcctgcaaaaataaaagggaaaaaaaagaaaaaagaaacaaaaaggaacttcttatagttgtcttttgtgaactttaaggttttgaaagaatcttcaattaaagcatggcagattcacctgtaaatatttagccttgaggggccattgatgtaaaacaattgtattgatggttgtttaacttttttgtttaatttttacagttacatccagctgttagatatgcaggaaaagatagtttgctggctagctctattcatttatgttagcattaatgcacatttttaaaaaaaga

SEQ ID NO: 36850 - DNA, 484 bp, Homo sapiens
aaaaataaagaaagaattgagtgtttgataagagtagcattaggtattagtgggaaatgattggatttttcatttaagcattgttgggacaacttgttaaccatttggaaataaagcctaacctttgtcatcttaaaccattgtaaatgaaacctgactataagtagatttacaggaacatatataggagtatatgatgtgcagggagagaagggaagaattaactttgagagctacttatttaatctggttaaaggcaaagactggtttctccttttagaataagtcattgatagcttcctcaaggagttaaaaattcagtgcatcctatagtgaaataaagggatctggaagtgtagaataaaatttatttttgataataaatgatgattgaagccctgaaagttattcaaatgtttttgaaatgattggataaaaagcacattgaatgatctgaaaaatataagaaagtacaggttaagta

SEQ ID NO: 36851 - DNA, 368 bp, Homo sapiens
atgaaggatatataatacatagtaagaacttttaatgtacatataattggagtctcagaaagataggagagacagttaggcaggggcaatatttgacaagataaagatcaagaaattttgaaaactattgaaagatctcagctcaaagattaaagaaatttaatgaaacccaagcagaataactacaaagaagactacacacatgcatgttgatatagtttggatatttgtcctctggaaatctcatgttgaaatgcgatccccaatgttggaggtgtgacctagtgggagatgtttgggtcatgggagtggatccctcatgaatggcttggtgccatccccttcatgattagtgagtttttgctcta

SEQ ID NO: 36852 - DNA, 417 bp, Homo sapiens
ttttaaaacatttatttatttttatttttgtaaagatggggtcttgctatgttggagactaactatttttacttcacacctctgatactatgttggctggtttttaaaaaaatctctgggctgggcacagtggcacacccctgtaatcccagcattatggaaggctgaggcgggtggatcacttgatgtcaggagttcaagaccaacctggccaacatagcaaaaccctgtctctactaaaaatataaaaattagccaggcatgatggcgcagtcccagatagctgtagtcccagctactagagaggctgaggcaggagaatcgcttgaacctggaaggcggaggttgcagtgagccaagatcacgccactgtactccagcctgggtgacagagcgagactccacctcaaaaaaatt

SEQ ID NO: 36853 - DNA, 596 bp, Homo sapiens
agaatcgcttgaacctgagaggtggagattgcagtgagccaggatcgcgccactgcactccaacctgggtgacagagcgagactccatctcaaaaaacaaacaaaaacacatacagttcactctcttaaccatttttatgtgtacagtacagtagtgttaactatatgtacattgttgtatgacagatctctaaaactttttcatgtagcaaaactgaaactctgtacctattggataacagctcccagagagagcttttaaacattcatcatttcatgtcattcacttgcttaaatggctccaaagccttccttcttctctttcaataaaatccatgctacttacacaggcttcttagatcccatatgatctaatccccacctaccttctgaccttagcttattccactttctctatgccctacggtgcatcaggatctttgtactagctgttcttctgcctatagtgttctttcctggctttgcgcatggctggctcctggtcattcaggcctcaggtttaaccccctcaggtaggcctttgactacagatttaaaatacctgcctctatgtcattttcgggtcctcaagtcag

SEQ ID NO: 36854 - DNA, 380 bp, Homo sapiens
tttttccttcataaactacatcaacaaatccttgaagtcatctctatcatgtcttctgcataaataaatccagcccaagttatcatccttcacctagataattgtaataattcctttccagctcgttttcctgatctaggttcttcctcctccagttatctactacactgttcacagaagaaagttctgaaacacaaatctgatagtgccaacaccttgcttataaacttttaatggctgctgattacatataggacaaggagtatgtttttctttcattaattcctctcacctatccaaatgccacagtccagcagaaattgaggctgatactctggagaggggataacagctaaagccagaatctgaagtaagtgaac

SEQ ID NO: 36855 - DNA, 334 bp, Homo sapiens
cttctggtcagcagctactggttgttccttctttttccttctcctccctcattttccccattagaatgtaagcttcttgaaggaaaagggcttgtttattgctgtataactagaaaggatagtgccaggcacattcaacaatatttgttgaaagaatgaaaaactgaatgaaaaagtatttggcagctctctgaaaaccagctacttctgacacctagaaacccaggtaatctattgtgtatctgatgtttattgattgccctgatcttaccactgccatgtaacaggaaaatcctgccttctactagggagttgctgagaccccctaaacagg

SEQ ID NO: 36856 - DNA, 226 bp, Homo sapiens
gcatggggctcagctctgattctactggcttctacatagttggcttgttattctaccatttactaaagactctgtccttctttaatgtacttaaatttgagcagtttttatgttcaaacttttttttttttttttaaacagaaattatatttctggctgtatggcccaaggtgggttctgaaactctgtggttctcaagttaatccaccgcgacttcggacctccc

SEQ ID NO: 36857 - DNA, 530 bp, Homo sapiens
gcatggggctcagctctgattctactggcttctacatagttggcttgttattctaccatttactaaagactctgtccttctttaatgtacttaaatttgagcagtttttatgttcaaacttttttttttttttttaaacagaaattatgtcttgctgttttgcccaggctggtcttgaattcctggcctcaaacgaccctcctgcctcggcctcccaaaatgttaggattagaggcgtgagccactgcacctggccaattgagcaatttttatatacaactttttcttagttttgacgtctgcaaaaattcagaaagctactataagaaaatgacaatcaaccatctgcataaaaaaagaattagccacttaacacaactggtcctttttccattggaaaaatcgatcggaaattggatttctaattacatttgggctttccacggaaaccgcagagcagccggtcatctatatattcattaaatcctacaaactggagagttttttttttttttttttgagatggagtc

SEQ ID NO: 36858 - DNA, 253 bp, Homo sapiens
gcagttattggctatagtattgtagcctttaggtcatcattaagtcaagtttattaatcatgttttcaaattttctctgtcgatttttatgtgcttgttatatcagttattaagataagtgggttaaaacttatcttttatttccacttttatatgccttttctaagatgtgtatttttaaggtagcatatagacggacttcagccttgaatttcataataaacattaacatggaaaaaatgtacaaaggaaa

SEQ ID NO: 36859 - DNA, 729 bp, Homo sapiens
cccaaggagtaaattcaggagggagccacaaaggaagcacttttaagtttgtaagattagaaaatacatttgcacaatttatttcagttcaccattcagttcccaaattggtacagcttgttcacaaatgtgttgaaattttccttcctgcagcatgttgagtaatcgtagatgagtttttcttttacacttgatcttagccaaaaggccaagaagtgatgagtttttattttaataagttcttgtcatacagctttttgacagtgagctgtagtgtaagtacctggttgtcagttttttccagtgttctcagtaaaaaatcagaactgcctggccctctataaaggcatccgttgacttctttgatgggttatgtagtgacctaaaacccagaatcctgcaagagcagccactacaagctcaacactgaattagccatcatctcaactgtaaagatttgaaggagatagtctgtgatagatcccctacatgtgtatgcagatttcgtgtgaatgtgctttctttctggagtagtagttccatagctgcattcagtttctaataagaagctactacagccaggcacggtggctcatgcctgtaatcccagctactcgggaggctgaggcaggagaatcacttgaacctgggagacagaggtggcagtgagctgaaaatcgtgccactgcactccagccttagtgacagagtgggagtccgtctcaaaaa

SEQ ID NO: 36860 - DNA, 200 bp, Homo sapiens
tgcactgccccgaggagagacaggggagaaggggcatggccatgcgttcctgggagggtacttgctacatttctatgaggtgctcttgagaatgagatatgtgtggacctcactccccaccccacagctttgtgctcactctacttgcctgagtggtagcctgccctctctggtctcggcccaaggtgcatactgagagt

SEQ ID NO: 36861 - DNA, 327 bp, Homo sapiens
gcctcagcctcccaaagtgctgggattataggcatcagccaccatgcccggcctcattagaaaattctgccaagtattttaaaaagactgaaccaaatcctctataatatcttccagataataaaaacagaaagagcagcaagtggaatttattctaggaatgtatgactggtttaacatttaaaaagtaatcactctaaggctgggcatagtggctcacgcctgttatcccagcactttgggagcctgaggcaggtggattacctgaggttggagtttgagaccagcctggccaacatggtgaaaccctgtctctactaaaaatac

SEQ ID NO: 36862 - DNA, 385 bp, Homo sapiens
ggggactgaaggacagtatgataatgaggtgatcttgagtggatggctagagatgtgattaaaggtcaacatgaaaacataagcaacttcttcatgacctcttaagggaagggattatgcagcagaacaactgctggttccagagtcccacttccagctctgccactaactctatgtgactttgacaaagtgacttaacctctctggagtaaattccattaactataaaagactagagtaaaatgaaatgttctctaacttccttctaattctaatactccttgggtttacaaatcttctcttttggatacatgcacaatcaccaaaaatcagccatggctcaatcattctttggacattttcaccatcgatgcatttcctatgc

SEQ ID NO: 36863 - DNA, 493 bp, Homo sapiens
tcaaggttaaggttaagattccaggtgaaaatacataacggaaggacaccatttcagaaaccagaccactgatgagggctgcttaaagaatttttagaaagaagagataacttctgatgtcctttggtgtttaatgtttttaaaagaccatgggtctctgctctgatgaagaactacattgcaagtaatttgaatgtagtgactagaccacccttggcatctagtcttatatctagtacctatcaggcacttaaaatgactattgtaatgcacagactcatttgccagataaaacctggaactcagaagggtctccctgaaattcttaagaacatgacggtagaatggatgcatataaagaacaaatgagaaaagattaaaaaaaaaaccctcataactaaaactacaatataggaaaatttgaagtgtaaaattttgctcgaactgtttatgaaatggaggtaagaaatggggatgggacaaaggctttact

SEQ ID NO: 36864 - DNA, 911 bp, Homo sapiens
cgtatttatcactctattgattggttttatagttcattgaaaatcctcaaataaaatataattattactgaaatatgtttaatatttaaggggaaaagagactaatttcagttatacttttaagcttagaatgtatgttcatttccaaattttgtatcataagagttttcaacatagagaaaagctgaaaaaatgcaaagaataaccacatactttccatctaccttcctttgttaacgggttgtttatcatataataatttgttttgtcatatttgctttcactgtctattatctgtttaagtctcataactctatttttagtttgctgaagacttgaaagtgaatcgcatatatcatgacacttcttggagtgtcattaatgggcaggcttttctgttgaagagtggattccgtatgttcttcatagagagtgtttttcagattcttcattgggatattaaaatattagccaaatttctctctgttttatatatgtctgtttatttcagtttgtggtttctgcaaatttgtaactgcctctgttttaggagtataagtattacttccttgtggtctattgtgaagtaaaaagtagacccttgcatatactattcttgtttgtgttcatcttaatgtttttgtacagctaaatcaaatgtaatttatagagttagtttcatcaacctaatgaatgctagttaaatttgaattccttggaatttatcgtatattgtattcactgagattatgaagggacaaatgttaatcttttgtttccagaaaaagttgggctttcccaagcagttctattacccggttcagaattgcttcatccaaaaatcatctgatggtatagatggatcctagtccttttcattacctgatggtagaaataaaataattgatttt

SEQ ID NO: 36865 - DNA, 542 bp, Homo sapiens
caaatgaagaatctgaaaaacactctctatgaagaacatacggaatccactcttcaacagaaagtgtttttcagattcttcattgggatattaaaatattagccaaatttctctctgttttatatatgtctgtttatttcagtttgtggtttctgcaaatttgtaactgcctctgttttaggagtataagtattacttccttgtggtctattgtgaagtaaaaagtagacccttgcatatactattcttgtttgtgttcatcttaatgtttttgtacagctaaatcaaatgtaatttatagagttagtttcatcaacctaatgaatgctagttaaatttgaattccttggaatttatcgtatattgtattcactgagattatgaagggacaaatgttaatcttttgtttccagaaaaagttgggctttcccaagcagttctattacccggttcagaattgcttcatccaaaaatcatctgatggtatagatggatcctagtccttttcattacctgatggtagaaataaaataattgatttt

SEQ ID NO: 36866 - DNA, 1510 bp, Homo sapiens
cgtatttatcactctattgattggttttatagttcattgaaaatcctcaaataaaatataattattactgaaatatgtttaatatttaaggggaaaagagactaatttcagttatacttttaagcttagaatgtatgttcatttccaaattttgtatcataagagttttcaacatagagaaaagctgaaaaaatgcaaagaataaccacatactttccatctaccttcctttgttaacgggttgtttatcatataataatttgttttgtcatatttgctttcactgtctattatctgtttaagtctcataactctatttttagtttgctgaagacttgaaagtgaatcgcatatatcatgacacttcttggagtgtcattaatgggcaggcttttctgttgaagagtggattccgtatgttcttcatagagagtgtttttcagattcttcattgggatattaaaatattagccaaatttctctctgttttatatatgtctgtttatttcagtttgtggtttctgcaaatttgtaactgcctctgttttaggagtataagtattacttccttgtggtctattgtgaagtaaaaagtagacccttgcatatactattcttgtttgtgttcatcttaatgtttttgtacagctaaatcaaatgtaatttatagagttagtttcatcaacctaatgaatgctagttaaatttgaattccttggaatttatcgtatattgtattcactgagattatgaagggacaaatgttaatcttttgtttccagaaaaagttgggctttcccaagcagttctattacccggttcagaattgcttcatccaaaaatcatctgatggtatagatggatcctagtccttttcattacctgatggtagaaataaaataattgatttttaaaaaaaaaaaaaaaaaaaacaaaaaaaacaaaaaaaaaaaaaaaaaaaaaaaaaaaacagaaaaacacaaaacaaaaaaaaaccaaacaaaaaaaacaaaaaaaaaaaaaacaaaaaaaaaaaaaaaagaaaaaaaaaacaagcagaggggggcggcgcggccgccctcctccccccgcggggcgcccccccccctcgcccccccttccggagatggccgggccggctccatatgtgggtgacgtatatactcttaatcaaaagaaccgcgggccgggggcgagcacacatacactaaacttacagagacggctcgctgtggagcgcaagacaacacggaccggaattcggatgacaatatattgggtagaagaagaaaaaccatacttgtttagcgtctgtggactcaaataatgtcgtgtcaacaacacaaccaaatccgaatatatacagagttgcatcgaccgagaataaataatatacaagtgacgttgattattgtagtgaaaacacaacaccccaaggactagtttctcgcacggacgcaatagttgtccgtgcaggattctatgatcttcgcagaaaaaattatccgca

SEQ ID NO: 36867 - DNA, 480 bp, Homo sapiens
cgtatttatcactctattgattggttttatagttcattgaaaatcctcaaataaaatataattattactgaaatatgtttaatatttaaggggaaaagagactaatttcagttatacttttaagcttagaatgtatgttcatttccaaattttgtatcataagagttttcaacatagagaaaagctgaaaaaatgcaaagaataaccacatactttccatctaccttcctttgttaacgggttgtttatcatataataatttgttttgtcatatttgctttcactgtctattatctgtttaagtctcataactctatttttagtttgctgaagacttgaaagtgaatcgcatatatcatgacacttcttggagtgtcattaatgggcaggcttttctgttgaagagtggattccgtatgttcttcatagagagtgtttttcagattcttcattgggatattaaaatattagccaaatttc

SEQ ID NO: 36868 - DNA, 2775 bp, Homo sapiens
agcaggtacacccctcaaatgtgttcttgggagaagtgatacactcggcctcattatgtgaaacctgtgggtggggttggggtggagaagtagagagagggcaacagcttccacaactgcttcatctctgccaacactaatttttcccacactgtctttgtacatttcagagctttggtctcctgagtgggcctccttttcccactgtgccaggaaggtaggtttctctggctgactgagtactgtgagtgaggcaacactgatgccagcatgggtcttacttgactggggagtaggctgagtgaggggtagggtggggtaggtggggagtagtgtggccaggaactggaatccctggtggatttctgattcctgtggtgagaaggaaagctacaggacctggagaaggggatgcagaggcaggcctgctgaccaacttgttgcaatcacaaaggtgggggtcctggtgcaggcagtgaacaggcttctaatgtggggttcagtagtgccagcaagtgggggaaactttcagtattgcgctaggtcaacacttcctgctgcatttccttccctttgcacagcttgaagaaatagagtagacagaatcacacatcatgtggtgggcagatggaaataagtacctgtggtgaacaagtttctactgtagttggagatcattagaattgaattcagtttctcttagaatataatcaggtataaacctaagttaaactttttcccaaacaaggagcatccaaagacacagtgacttgagctatagatagtaaaaatcatacgagagttgaactgagtcaggtttaggaagcaagtttggttgcatcaattaagcaggctcttttcaattgactgatgctggggccttcagttttattctcagtatagattgccagtattgttaagagtatccaaaggcctttctagatggagacagaataactgacttgaacatacagtgtgcctgtaagtgtccaggctcagagctggtgaaaacccttctgttgggcgtgtgcagggttaaactcctgaagtaacttgtgaggacttcagtgcttgctggtgtcctgggcagcaccatgaatgcctttaccaagacatgccaagttggatcccccgaatgaagcagatgtggctgtggtgtgacccttgctccctgctacacagagcatcgcagggctggcctgtgtggtttccagatgagggtctgggtcccggaagcttgtgttgagagctcagtggacccaccccgcttgctgaaccctcacagttcttggggttgtccagcctggacttgtagcacacatgtcctgaagcaaagctccggtgactgcatgagccacctggccacagtcctcccatggagggcctgccgtgacgctcagtggagagggcagggcctgtgtctccacttaggccacacagtgatgaggaaaccacagatggagcttcttgccgataatactgactctagcccatgattgccttgcccaagccaaagaggaaggttaggttggcttgtcgagcccttgagcgttgggagatggggtgggaaggaggtgagcccctgcagagagttgggtagtgtccttcaggaatgaaaggaggggcaaaggagtcaccagaggtcctgcatttccatcagggtttccacagtcatcagggcttctctcttgagttgctgataggagatgtgagttatgcccagagatgtcttatcgtgaggaaaaagaaacttccttttgttcacattcaggactctcagtgccatatgaagtagcaaaaggcagtatcggccagatcagtgttacattgattctaaaattacagtgtccccattagacaactattttaggtgctggagtatgtttgaagagtgtgctgggaaaaaggaagcatttcttcattgatttaaatcagtatgaatattatatgcctaaataaaaaatttgcacaggtaaattctctcacttgtgaatgggagaagctgccccaggaatctgtgaggatggtattccctggagtctggctttgaaagatttcattgttggtagaaataacaggttgagaaagagggagttagcatcacctaaaacctgcacgtgaacaagggttgacatgatacactatggccttagaaaagggccaggtgaaaccccaagctaatcactgcggtctttcagagccggacagacaggtgccagcagagcccggggctcactctcctttcagtcattcctcagcccttcgaagggaagcccaaacactttgcacgctgtgctgcagacattctggcctggtgtgtctgaaagttgcatcagtcctcacggtgcaaacacagttgatttaggaagtcacacaatgacactgaaatcctacagaccaaaatccacttgtcagcaggagcagcagcccaggcccagcaccagcggtcttccggctcctctgagggctgccacgttgggcgaggggagccatgccaagggtccaggctgctttaggccatctgtgccccactcatctggggacagatggtttttctttattgtaaaattgtggacttttaaaacctgttgactaaacagtaattaatttatatttgtgaaaaatgccactgtcctagtgatttctgatgtaaataatgttgtttatatagtatgtattaaattttcctacattgtaaaactgctgtacttttgattcttgtatattaaaaagtgttactgagcatttttagaattgggctaacaaaaaaaaaaa

SEQ ID NO: 36869 - DNA, 2721 bp, Homo sapiens
agcaggtacacccctcaaatgtgttcttgggagaagtgatacactcggcctcattatgtgaaacctgtgggtggggttggggtggagaagtagagagagggcaacagcttccacaactgcttcatctctgccaacactaatttttcccacactgtctttgtacatttcagagctttggtctcctgagtgggcctccttttcccactgtgccaggaaggtaggtttctctggctgactgagtactgtgagtgaggcaacactgatgccagcatgggtcttacttgactggggagtaggctgagtgaggggtagggtggggtaggtggggagtagtgtggccaggaactggaatccctggtggatttctgattcctgtggtgagaaggaaagctacaggacctggagaaggggatgcagaggcaggcctgctgaccaacttgttgcaatcacaaaggtgggggtcctggtgcaggcagtgaacaggcttctaatgtggggttcagtagtgccagcaagtgggggaaactttcagtattgcgctaggtcaacacttcctgctgcatttccttccctttgcacagcttgaagaaatagagtagacagaatcacacatcatgtggtgggcagatggaaataagtacctgtggtgaacaagtttctactgtagttggagatcattagaattgaattcagtttctcttagaatataatcaggtataaacctaagttaaactttttcccaaacaaggagcatccaaagacacagtgacttgagctatagatagtaaaaatcatacgagagttgaactgagtcaggtttaggaagcaagtttggttgcatcaattaagcaggctcttttcaattgactgatgctggggccttcagttttattctcagtatagattgccagtattgttaagagtatccaaaggcctttctagatggagacagaataactgacttgaacatacagtgtgcctgtaagtgtccaggctcagagctggtgacttcagtgcttgctggtgtcctgggcagcaccatgaatgcctttaccaagacatgccaagttggatcccccgaatgaagcagatgtggctgtggtgtgacccttgctccctgctacacagagcatcgcagggctggcctgtgtggtttccagatgagggtctgggtcccggaagcttgtgttgagagctcagtggacccaccccgcttgctgaaccctcacagttcttggggttgtccagcctggacttgtagcacacatgtcctgaagcaaagctccggtgactgcatgagccacctggccacagtcctcccatggagggcctgccgtgacgctcagtggagagggcagggcctgtgtctccacttaggccacacagtgatgaggaaaccacagatggagcttcttgccgataatactgactctagcccatgattgccttgcccaagccaaagaggaaggttaggttggcttgtcgagcccttgagcgttgggagatggggtgggaaggaggtgagcccctgcagagagttgggtagtgtccttcaggaatgaaaggaggggcaaaggagtcaccagaggtcctgcatttccatcagggtttccacagtcatcagggcttctctcttgagttgctgataggagatgtgagttatgcccagagatgtcttatcgtgaggaaaaagaaacttccttttgttcacattcaggactctcagtgccatatgaagtagcaaaaggcagtatcggccagatcagtgttacattgattctaaaattacagtgtccccattagacaactattttaggtgctggagtatgtttgaagagtgtgctgggaaaaaggaagcatttcttcattgatttaaatcagtatgaatattatatgcctaaataaaaaatttgcacaggtaaattctctcacttgtgaatgggagaagctgccccaggaatctgtgaggatggtattccctggagtctggctttgaaagatttcattgttggtagaaataacaggttgagaaagagggagttagcatcacctaaaacctgcacgtgaacaagggttgacatgatacactatggccttagaaaagggccaggtgaaaccccaagctaatcactgcggtctttcagagccggacagacaggtgccagcagagcccggggctcactctcctttcagtcattcctcagcccttcgaagggaagcccaaacactttgcacgctgtgctgcagacattctggcctggtgtgtctgaaagttgcatcagtcctcacggtgcaaacacagttgatttaggaagtcacacaatgacactgaaatcctacagaccaaaatccacttgtcagcaggagcagcagcccaggcccagcaccagcggtcttccggctcctctgagggctgccacgttgggcgaggggagccatgccaagggtccaggctgctttaggccatctgtgccccactcatctggggacagatggtttttctttattgtaaaattgtggacttttaaaacctgttgactaaacagtaattaatttatatttgtgaaaaatgccactgtcctagtgatttctgatgtaaataatgttgtttatatagtatgtattaaattttcctacattgtaaaactgctgtacttttgattcttgtatattaaaaagtgttactgagcatttttagaattgggctaacaaaaaaaaaaa

SEQ ID NO: 36870 - DNA, 1765 bp, Homo sapiens
gcatcttgttctgctgctccaggaaccgtaccttgtctagagagcaccaccacttcagtgcttgctggtgtcctgggcagcaccatgaatgcctttaccaagacatgccaagttggatcccccgaatgaagcagatgtggctgtggtgtgacccttgctccctgctacacagagcatcgcagggctggcctgtgtggtttccagatgagggtctgggtcccggaagcttgtgttgagagctcagtggacccaccccgcttgctgaaccctcacagttcttggggttgtccagcctggacttgtagcacacatgtcctgaagcaaagctccggtgactgcatgagccacctggccacagtcctcccatggagggcctgccgtgacgctcagtggagagggcagggcctgtgtctccacttaggccacacagtgatgaggaaaccacagatggagcttcttgccgataatactgactctagcccatgattgccttgcccaagccaaagaggaaggttaggttggcttgtcgagcccttgagcgttgggagatggggtgggaaggaggtgagcccctgcagagagttgggtagtgtccttcaggaatgaaaggaggggcaaaggagtcaccagaggtcctgcatttccatcagggtttccacagtcatcagggcttctctcttgagttgctgataggagatgtgagttatgcccagagatgtcttatcgtgaggaaaaagaaacttccttttgttcacattcaggactctcagtgccatatgaagtagcaaaaggcagtatcggccagatcagtgttacattgattctaaaattacagtgtccccattagacaactattttaggtgctggagtatgtttgaagagtgtgctgggaaaaaggaagcatttcttcattgatttaaatcagtatgaatattatatgcctaaataaaaaatttgcacaggtaaattctctcacttgtgaatgggagaagctgccccaggaatctgtgaggatggtattccctggagtctggctttgaaagatttcattgttggtagaaataacaggttgagaaagagggagttagcatcacctaaaacctgcacgtgaacaagggttgacatgatacactatggccttagaaaagggccaggtgaaaccccaagctaatcactgcggtctttcagagccggacagacaggtgccagcagagcccggggctcactctcctttcagtcattcctcagcccttcgaagggaagcccaaacactttgcacgctgtgctgcagacattctggcctggtgtgtctgaaagttgcatcagtcctcacggtgcaaacacagttgatttaggaagtcacacaatgacactgaaatcctacagaccaaaatccacttgtcagcaggagcagcagcccaggcccagcaccagcggtcttccggctcctctgagggctgccacgttgggcgaggggagccatgccaagggtccaggctgctttaggccatctgtgccccactcatctggggacagatggtttttctttattgtaaaattgtggacttttaaaacctgttgactaaacagtaattaatttatatttgtgaaaaatgccactgtcctagtgatttctgatgtaaataatgttgtttatatagtatgtattaaattttcctacattgtaaaactgctgtacttttgattcttgtatattaaaaagtgttactgagcatttttagaattgggctaacaaaaaaaaaaa

SEQ ID NO: 36871 - DNA, 1323 bp, Homo sapiens
cgactagtcccaaccataccttcctctttggcttgggcaaggcaatcatgggctagagtcagtattatcggcaagaagctccatctgtggtttcctcatcactgtgtggcctaagtggagacacaggcccctgcagagagttgggtagtgtccttcaggaatgaaaggaggggcaaaggagtcaccagaggtcctgcatttccatcagggtttccacagtcatcagggcttctctcttgagttgctgataggagatgtgagttatgcccagagatgtcttatcgtgaggaaaaagaaacttccttttgttcacattcaggactctcagtgccatatgaagtagcaaaaggcagtatcggccagatcagtgttacattgattctaaaattacagtgtccccattagacaactattttaggtgctggagtatgtttgaagagtgtgctgggaaaaaggaagcatttcttcattgatttaaatcagtatgaatattatatgcctaaataaaaaatttgcacaggtaaattctctcacttgtgaatgggagaagctgccccaggaatctgtgaggatggtattccctggagtctggctttgaaagatttcattgttggtagaaataacaggttgagaaagagggagttagcatcacctaaaacctgcacgtgaacaagggttgacatgatacactatggccttagaaaagggccaggtgaaaccccaagctaatcactgcggtctttcagagccggacagacaggtgccagcagagcccggggctcactctcctttcagtcattcctcagcccttcgaagggaagcccaaacactttgcacgctgtgctgcagacattctggcctggtgtgtctgaaagttgcatcagtcctcacggtgcaaacacagttgatttaggaagtcacacaatgacactgaaatcctacagaccaaaatccacttgtcagcaggagcagcagcccaggcccagcaccagcggtcttccggctcctctgagggctgccacgttgggcgaggggagccatgccaagggtccaggctgctttaggccatctgtgccccactcatctggggacagatggtttttctttattgtaaaattgtggacttttaaaacctgttgactaaacagtaattaatttatatttgtgaaaaatgccactgtcctagtgatttctgatgtaaataatgttgtttatatagtatgtattaaattttcctacattgtaaaactgctgtacttttgattcttgtatattaaaaagtgttactgagcatttttagaattgggctaacaaaaaaaaaaa

SEQ ID NO: 36872 - DNA, 2697 bp, Homo sapiens
agcaggtacacccctcaaatgtgttcttgggagaagtgatacactcggcctcattatgtgaaacctgtgggtggggttggggtggagaagtagagagagggcaacagcttccacaactgcttcatctctgccaacactaatttttcccacactgtctttgtacatttcagagctttggtctcctgagtgggcctccttttcccactgtgccaggaaggtaggtttctctggctgactgagtactgtgagtgaggcaacactgatgccagcatgggtcttacttgactggggagtaggctgagtgaggggtagggtggggtaggtggggagtagtgtggccaggaactggaatccctggtggatttctgattcctgtggtgagaaggaaagctacaggacctggagaaggggatgcagaggcaggcctgctgaccaacttgttgcaatcacaaaggtgggggtcctggtgcaggcagtgaacaggcttctaatgtggggttcagtagtgccagcaagtgggggaaactttcagtattgcgctaggtcaacacttcctgctgcatttccttccctttgcacagcttgaagaaatagagtagacagaatcacacatcatgtggtgggcagatggaaataagtacctgtggtgaacaagtttctactgtagttggagatcattagaattgaattcagtttctcttagaatataatcaggtataaacctaagttaaactttttcccaaacaaggagcatccaaagacacagtgacttgagctatagatagtaaaaatcatacgagagttgaactgagtcaggtttaggaagcaagtttggttgcatcaattaagcaggctcttttcaattgactgatgctggggccttcagttttattctcagtatagattgccagtattgttaagagtatccaaaggcctttctagatggagacagaataactgacttgaacatacagtgtgcctgtaagtgtccaggctcagagctggtgaaaacccttctgttgggcgtgtgcagggttaaactcctgaagtaacttgtgaggacttcagtgcttgctggtgtcctgggcagcaccatgaatgcctttaccaagacatgccaagttggatcccccgaatgaagcagatgtggctgtggtgtgacccttgctccctgctacacagagcatcgcagggctggcctgtgtggtttccagatgagggtctgggtcccggaagcttgtgttgagagctcagtggacccaccccgcttgctgaaccctcacagttcttggggttgtccagcctggacttgtagcacacatgtcctgaagcaaagctccggtgactgcatgagccacctggccacagtcctcccatggagggcctgccgtgacgctcagtggagagggcagggcctgtgtctccacttaggccacacagtgatgaggaaaccacagatggagcttcttgccgataatactgactctagcccatgattgccttgcccaagccaaagaggaaggttaggttggcttgtcgagcccttgagcgttgggagatggggtgggaaggaggtgagcccctgcagagagttgggtagtgtccttcaggaatgaaaggaggggcaaaggagtcaccagaggtcctgcatttccatcagggtttccacagtcatcagggcttctctcttgagttgctgataggagatgtgagttatgcccagagatgtcttatcgtgaggaaaaagaaacttccttttgttcacattcaggactctcagtgccatatgaagtagcaaaaggcagtatcggccagatcagtgttacattgattctaaaattacagtgtccccattagacaactattttaggtgctggagtatgtttgaagagtgtgctgggaaaaaggaagcatttcttcattgatttaaatcagtatgaatattatatgcctaaataaaaaatttgcacaggtaaattctctcacttgtgaatgggagaagctgccccaggaatctgtgaggatggtattccctggagtctggctttgaaagatttcattgttggtagaaataacaggttgagaaagagggagttagcatcacctaaaacctgcacgtgaacaagggttgacatgatacactatggccttagaaaagggccaggtgaaaccccaagctaatcactgcggtctttcagagccggacagacaggtgccagcagagcccggggctcactctcctttcagtcattcctcagcccttcgaagggaagcccaaacactttgcacgctgtgctgcagacattctggcctggtgtgtctgaaagttgcatcagtcctcacggtgcaaacacagttgatttaggaagtcacacaatgacactgaaatcctacagaccaaaatccacttgtcagcaggagcagcagcccaggcccagcaccagcggtcttccggctcctctgagggctgccacgttgggcgaggggagccatgccaagggtccaggctgctttaggccatctgtgccccactcatctggggacagatggtttttctttattgtaaaattgtggacttttaaaacctgttgactaaacagtaattaatttatatttgtgaaaaatgccactgtcctagtgatttctgatgtaaataatgttgtttatatagtatgtattaaattttcctacattgta

SEQ ID NO: 36873 - DNA, 3037 bp, Homo sapiens
agcaggtacacccctcaaatgtgttcttgggagaagtgatacactcggcctcattatgtgaaacctgtgggtggggttggggtggagaagtagagagagggcaacagcttccacaactgcttcatctctgccaacactaatttttcccacactgtctttgtacatttcagagctttggtctcctgagtgggcctccttttcccactgtgccaggaaggtaggtttctctggctgactgagtactgtgagtgaggcaacactgatgccagcatgggtcttacttgactggggagtaggctgagtgaggggtagggtggggtaggtggggagtagtgtggccaggaactggaatccctggtggatttctgattcctgtggtgagaaggaaagctacaggacctggagaaggggatgcagaggcaggcctgctgaccaacttgttgcaatcacaaaggtgggggtcctggtgcaggcagtgaacaggcttctaatgtggggttcagtagtgccagcaagtgggggaaactttcagtattgcgctaggtcaacacttcctgctgcatttccttccctttgcacagcttgaagaaatagagtagacagaatcacacatcatgtggtgggcagatggaaataagtacctgtggtgaacaagtttctactgtagttggagatcattagaattgaattcagtttctcttagaatataatcaggtataaacctaagttaaactttttcccaaacaaggagcatccaaagacacagtgacttgagctatagatagtaaaaatcatacgagagttgaactgagtcaggtttaggaagcaagtttggttgcatcaattaagcaggctcttttcaattgactgatgctggggccttcagttttattctcagtatagattgccagtattgttaagagtatccaaaggcctttctagatggagacagaataactgacttgaacatacagtgtgcctgtaagtgtccaggctcagagctggtgaaaacccttctgttgggcgtgtgcagggttaaactcctgaagtaacttgtgaggacttcagtgcttgctggtgtcctgggcagcaccatgaatgcctttaccaagacatgccaagttggatcccccgaatgaagcagatgtggctgtggtgtgacccttgctccctgctacacagagcatcgcagggctggcctgtgtggtttccagatgagggtctgggtcccggaagcttgtgttgagagctcagtggacccaccccgcttgctgaaccctcacagttcttggggttgtccagcctggacttgtagcacacatgtcctgaagcaaagctccggtgactgcatgagccacctggccacagtcctcccatggagggcctgccgtgacgctcagtggagagggcagggcctgtgtctccacttaggccacacagtgatgaggaaaccacagatggagcttcttgccgataatactgactctagcccatgattgccttgcccaagccaaagaggaaggttaggttggcttgtcgagcccttgagcgttgggagatggggtgggaaggaggtgagcccctgcagagagttgggtagtgtccttcaggaatgaaaggaggggcaaaggagtcaccagaggtcctgcatttccatcagggtttccacagtcatcagggcttctctcttgagttgctgataggagatgtgagttatgcccagagatgtcttatcgtgaggaaaaagaaacttccttttgttcacattcaggactctcagtgccatatgaagtagcaaaaggcagtatcggccagatcagtgttacattgattctaaaattacagtgtccccattagacaactattttaggtgctggagtatgtttgaagagtgtgctgggaaaaaggaagcatttcttcattgatttaaatcagtatgaatattatatgcctaaataaaaaatttgcacaggtaaattctctcacttgtgaatgggagaagctgccccaggaatctgtgaggatggtattccctggagtctggctttgaaagatttcattgttggtagaaataacaggttgagaaagagggagttagcatcacctaaaacctgcacgtgaacaagggttgacatgatacactatggccttagaaaagggccaggtgaaaccccaagctaatcactgcggtctttcagagccggacagacaggtgccagcagagcccggggctcactctcctttcagtcattcctcagcccttcgaagggaagcccaaacactttgcacgctgtgctgcagacattctggcctggtgtgtctgaaagttgcatcagtcctcacggtgcaaacacagttgatttaggaagtcacacaatgacactgaaatcctacagaccaaaatccacttgtcagcaggagcagcagcccaggcccagcaccagcggtcttccggctcctctgagggctgccacgttgggcgaggggagccatgccaagggtccaggctgctttaggccatctgtgccccactcatctggggacagatggtttttctttattgtaaaattgtggacttttaaaacctgttgactaaacagtaattaatttatatttgtgaaaaatgccactgtcctagtgatttctgatgtaaataatgttgtttatatagtatgtattaaattttcctacattgtaaaactgctgtacttttgattcttgtatatttttttttttttttttttatggggcaggtatggagtttcactcttgtcacccaggctggagtgccgtggcgcgatctcggctcactgcaacctcagtctccagggttcaagcgattctcctgtctcagcctcccatgtagctgggattataggcgcatgccaccatgcccagctaatttttatatttttagtaaagacggggttttcatcatattggacaggctggtctggaacacctgacctcaggtgatccgcctgaggcctcccaaagtgctgggattccaggtgggagccacagcgcccggcctctc

SEQ ID NO: 36874 - DNA, 733 bp, Homo sapiens
tccgagctcgttggacgatactgatggccgaacacggttgagaaagagggagttagcatcacctaaaacctgcacgtgaacaagggttgacatgatacactatggccttagaaaagggccaggtgaaaccccaagctaatcactgcggtctttcagagccggacagacaggtgccagcagagcccggggctcactctcctttcagtcattcctcagcccttcgaagggaagcccaaacactttgcacgctgtgctgcagacattctggcctggtgtgtctgaaagttgcatcagtcctcacggtgcaaacacagttgatttaggaagtcacacaatgacactgaaatcctacagaccaaaatccacttgtcagcaggagcagcagcccaggcccagcaccagcggtcttccggctcctctgagggctgccacgttgggcgaggggagccatgccaagggtccaggctgctttaggccatctgtgccccactcatctggggacagatggtttttctttattgtaaaattgtggacttttaaaacctgttgactaaacagtaattaatttatatttgtgaaaaatgccactgtcctagtgatttctgatgtaaataatgttgtttatatagtatgtattaaattttcctacattgtaaaactgctgtacttttgattcttgtatattaaaaagtgttactgagcatttttagaattgggctaacaaaaaaaaaaa

SEQ ID NO: 36875 - DNA, 1682 bp, Homo sapiens
agcaggtacacccctcaaatgtgttcttgggagaagtgatacactcggcctcattatgtgaaacctgtgggtggggttggggtggagaagtagagagagggcaacagcttccacaactgcttcatctctgccaacactaatttttcccacactgtctttgtacatttcagagctttggtctcctgagtgggcctccttttcccactgtgccaggaaggtaggtttctctggctgactgagtactgtgagtgaggcaacactgatgccagcatgggtcttacttgactggggagtaggctgagtgaggggtagggtggggtaggtggggagtagtgtggccaggaactggaatccctggtggatttctgattcctgtggtgagaaggaaagctacaggacctggagaaggggatgcagaggcaggcctgctgaccaacttgttgcaatcacaaaggtgggggtcctggtgcaggcagtgaacaggcttctaatgtggggttcagtagtgccagcaagtgggggaaactttcagtattgcgctaggtcaacacttcctgctgcatttccttccctttgcacagcttgaagaaatagagtagacagaatcacacatcatgtggtgggcagatggaaataagtacctgtggtgaacaagtttctactgtagttggagatcattagaattgaattcagtttctcttagaatataatcaggtataaacctaagttaaactttttcccaaacaaggagcatccaaagacacagtgacttgagctatagatagtaaaaatcatacgagagttgaactgagtcaggtttaggaagcaagtttggttgcatcaattaagcaggctcttttcaattgactgatgctggggccttcagttttattctcagtatagattgccagtattgttaagagtatccaaaggcctttctagatggagacagaataactgacttgaacatacagtgtgcctgtaagtgtccaggctcagagctggtgaaaacccttctgttgggcgtgtgcagggttaaactcctgaagtaacttgtgaggacttcagtgcttgctggtgtcctgggcagcaccatgaatgcctttaccaagacatgccaagttggatcccccgaatgaagcagatgtggctgtggtgtgacccttgctccctgctacacagagcatcgcagggctggcctgtgtggtttccagatgagggtctgggtcccggaagcttgtgttgagagctcagtggacccaccccgcttgctgaaccctcacagttcttggggttgtccagcctggacttgtagcacacatgtcctgaagcaaagctccggtgactgcatgagccacctggccacagtcctcccatggagggcctcgccaacagaaaggtcacttattgaaacccaagtccctgcagtttgccagaccagagtcggctccagattccaacctgtggcttttaaaggcgcaggaccagctctgatgtgaggcgttgccttaactgaagccccctgcaccagtcctttctgtcatatctcatgggacccatttggtctcccagcccacctcaaatctgttctgatcagtgagcgggtggggaggagaaggtgcagctggattcagtgaaagttccatcctgcagaaacctgggcactaattgaggagctgttc

SEQ ID NO: 36876 - DNA, 475 bp, Homo sapiens
ccaaccagtctggttctgctacaaagcttgtctccatgttccatcttccacattttgttggtttttaatagtagaaggatgaacccatggtggtgtgcagagctggtcatgccatacctcatggagtgtgagatgtgtcatcttgtatttgtgagaacccaatgcccgactgttcattgcaattctggtagatatctaagaggttattttgttattttattttttttatttattatatgtgtttgttagagatagggtcttgctctgttgcccaggctggagtgcaatggctattcacaggcacaatcatagcacactacaacctcaaactcttggcttcaagcagttctctcgcctcaaccttttgtgtagctgggactacaggtgcatgccaccacacccaactctaggaagtcattttgaattgagattgctcttgaggtattttggagcatgtcatttgttatatgctttt

SEQ ID NO: 36877 - DNA, 708 bp, Homo sapiens
ctactcatgggcacttatctacccaagctctgcccccgatgcctaccttctcacacgtctgcctgcgcatttggggaagttgacagcttttctgtgcaggtggatgtggaggacggacaaacccaagactgaggctccacttaccaaacacataagatgctgccacacgtcaaagacacactggcatttgctctggtctctcagccccttctggcattcctctggggtgacattgctggaggcagtgactcccaaggtcagactggactgggtctgctgaccactctagaggccaccaggttggggaaatgctaacgatacttaagagctcactgcctagtcaaagagatctgaaacaagcagagaatgtcataaaacaccaagtccagctggcaaacgttgctgctgggaaagtaagcgccatggcatggcctcatccctgaagtgtcataggtctgaggggtgtgtaggaatgagacagagaagggacaggtgaggttattcctgacaccatgaccagctggaaattgaagaggtggagatgaggtagggcaaagagaaaagggaacccatgcttacccatgcaccagccatctgctttccacacgccattatgttaaacccaccgggactctgtttccctgttttacatgtgaagacgtcacatgtttggtcacagctccagtaggtagcagagcctgcctttgg

SEQ ID NO: 36878 - DNA, 386 bp, Homo sapiens
gtggggattgatcagaggaaagtgtgccaagtgggaagaggggttatcaatccggtccgtggatttacccaacacttgtagcttggctttcaggctttaaactgtctttggtttgcaggtggggtttcactggggccctgcccctatctgcctagggatttgtctgcctcctgccgctatcacatagactatcatatacttaatatttttgtttgaatccaatcattcttttacataaaataaactttattttgctatttcaaatataacgtagccataagataccttctgttgatggtaaacaaaattgttggtgcctgcagaagagcccaaaccctgctatttgttcaaaatcaagattaaaagcatttctacaacactacaac

SEQ ID NO: 36879 - DNA, 406 bp, Homo sapiens
ttgaggccaggagtttgaggccggcctgggcaatatagtgagaccccctctctaccaaaaactaacagatgtgttaatttttagccctagctacattgggaggctgaggtggaaggatcgcttgaggccaggagttcaaggctgcagtgagctatgatcatgccactgtattccagcctgagtgacagagtgagaccctgtctctaaaattaaaaaaagaggagtcacttgaatatctcttaatgaaaattgtaaagtgcagtttctagtgatgtccccgcaactgccaaagcagaaattaagtcgaattgacatatttgccaggtgcacttggcctgctcatgtgttttaaatagtatctatactaacctataactgcaagagaagagatagaccaaaaagacag

SEQ ID NO: 36880 - DNA, 837 bp, Homo sapiens
gacatttccatccacccaggttgctaagctctgaacccttgagtcatcaggaacgcctccctccccttcatctctccctagcttggacaccctgcccccaactaaagcctgggtccacctcctaaagcgcccgcatgtctgcttctccctacccccatgcctctcacctggattgttgttgtggcttcctaactgacctttaccctgcacactgccaccagcatgatttcttgaaaacataaatttcagtgggtcacttcctgaactcatagacaatagaaaattgtctatgagttccccaaaggcatcgcagtctagtaatgaagattcacactgcccaggttcaaggcctcgtgatgcttcttaccacctctggcttgggaatgtttttaacggctgtgtctcagtttactcatctctgaaacgggtgtgataatagcacttacctcacagataagttatgaaatgtaaatgagttaataggtgtgaagcactcataaccatgccggccacacagaaatcctcagtgaacattattcttgatctctctttcctttgtagaacaagctcatctttcttgtggctctccacaatagctcctacctccacctttctcagtgccaggcaaagcttgatcagcagacagacctctttgttagcaatctgcagctagataagtccatatttggtaatttttatagcaatttgaccatcattttacatctgttgaatctgattaggaactggacttgtattttgtcccatttttggcagttccttttcgctgaatttttatgaaagaattagtccatattgaattggaagtaaaaaaaaaaa

SEQ ID NO: 36881 - DNA, 816 bp, Homo sapiens
tgcaaataagaatttgcagggaaatctgctttttgttcagaaataagctgtaatgagtgtggcattttgcatacacactgtgttatttttgaagggaggaaagtttagggttttggaactgttctccctacccccatgcctctcacctggattgttgttgtggcttcctaactgacctttaccctgcacactgccaccagcatgatttcttgaaaacataaatttcagtgggtcacttcctgaactcatagacaatagaaaattgtctatgagttccccaaaggcatcgcagtctagtaatgaagattcacactgcccaggttcaaggcctcgtgatgcttcttaccacctctggcttgggaatgtttttaacggctgtgtctcagtttactcatctctgaaacgggtgtgataatagcacttacctcacagataagttatgaaatgtaaatgagttaataggtgtgaagcactcataaccatgccggccacacagaaatcctcagtgaacattattcttgatctctctttcctttgtagaacaagctcatctttcttgtggctctccacaatagctcctacctccacctttctcagtgccaggcaaagcttgatcagcagacagacctctttgttagcaatctgcagctagataagtccatatttggtaatttttatagcaatttgaccatcattttacatctgttgaatctgattaggaactggacttgtattttgtcccatttttggcagttccttttcgctgaatttttatgaaagaattagtccatattgaattggaagtaaaaaaaaaaa

SEQ ID NO: 36882 - DNA, 814 bp, Homo sapiens
actgtcagcgaggccattcctagcacactgcatttggagacctgaagtgcagtgccatctcctccccttgtaacatgtttgccctgcatacagaatttcctctcctagctcacaggcacccagggtcatacctgccgagagtcaagggcgaaattctggatccccgttcaaaacatctttgttttcaccagtccccatttagagggccctgctaaatacgagcagtccctgtgaactcctaaggaggactttccacccacatcattttctgcttattttcaaaagggaaacaaaaaatcgatgtgttatcaccatcagctacccagagctgggtccatgtccagcactcctgtttcctctccttttcgtacaaccctgacagcttggtcggtgccagccacaggcctatgacattctctgccaccaccaccaaaatctgataggacagagtggagccagcttaggagttgggtctgccatgaaaattcaaaattgctgttttcagcccagaataccttggcgcacatgaacgcccttactgttttcaactttaacaaattacttggtgcactgttaggtaattgttccactgcttagaaactgtcgaaacaaaagcaaatctgtggattaccacctctttcagaccaaactaatacctgcttttcctcgtgttccatttttcatcccatattaaatatcttgcacataaaacatatgaaaaaatggccaattaatctcctggagctggcaactgactccggggaaccgctttttgctgaaaggctcattccctagtgtatcacttgaggaaatc

SEQ ID NO: 36883 - DNA, 384 bp, Homo sapiens
tctaggcttgcttagccaccagaggctgaggatgcaagcaggggagagttcagctccaataggctggggaagaaaggttggatggggagggtgtagtggccctgagacttgagcagaaatagtgaaaggaaccacttcctgcagctgagaggcaggagccatcatgttctgttgtgggcattttctagaatgttccagccaggaccagcagctcaaatggctcttccctggtggtgggtagggcaataggagataggagggaccttcaatgtggcaactgtgaggtttggccaatcaacttacccatgctgagcttcggtttctcttcagtgaaatggggataattaatgatcgtatcagcttacatgacggttgtgagaatta

SEQ ID NO: 36884 - DNA, 438 bp, Homo sapiens
gtgcattttcataccaccaaaatgtctgacttctgcacaatggtagagatatttttacccacgcttttttcaactggacttttccaggccagtgcctggaaagtatgagtgaaattattggagtaatttctcttccatgcatatgtgtctctgtggatgcagtgggttaaaatgccagctgattaggcaacgggaaagggaagtgctgctcagaccggaaggggaggggccgcatcctcgaatctctctcagtgtaaagcaatagaaggttcaaggtcataatacaattcctgcctcaaagttcgcatcaggggtcagaaaagcttcacatgggatatgttctgtaaaagagaacagtgtttcctctcatttcccacccaactaagggacctgagctcaagtaggaaattttataattgttttaaccgtcctactcaa

SEQ ID NO: 36885 - DNA, 962 bp, Homo sapiens
acaaaagaccacctcatctgttctttaaattatttgagctcaactttggttagacggtaacctgaacacagccaggcgctgtggctcacacctgtaatcccagcactttggggatatgaaactgaaaaaccgttttccatactaaagacctacggaaacatggctatactgttaatttgtttttgttaaaaagtaagtcatcagataagaactcaggcaggcactcagctttgaactggcctcccgccttgtcctcctacatagctgggactgtaagcattagccaccacactcggctcaggagtttaatattagtttttcttggtaggaggagaggtacacagggtctcactctgccactcaggctagagtgcaatgacacaatcataggtcactgtaatctcgaactcctgggctccagcaatccttctgcctcagtcatgagtagctgggactacaggcttgcacagccatacccagcttttttttgttttttgtagagatggggatttgctacattgcccaggctgctaccacatccagcccagatttactttttaaaaatatatgttacatccttatgtaatttataattttttaatgtttttatttaacatcagatttatatctttttcttcagagaatctttttaataaaagtactccttgaggccgggcacggtggctcacgcctgtcatcccagcactttgggaggctgaggtgggcggatcacaaggtcaagagatcaagaccatcctggccaacatgatgaaaccctgtctctactaaaaatacaaaaattagctgggcgtggtggtgggtgcctgtagtcccacctacttgggggggcggtgctgaggcaggagaaccgcttgaaccgggaagcggaggttgcagtaagccgagttcactccactgcactccagcctgatgacagagtgagactccatctcaaaaaaaaa

SEQ ID NO: 36886 - DNA, 560 bp, Homo sapiens
gatctcctgacctcgtgatgtacccgcctcggcctctcaaagtgctaggattacggtgtgagccactgcatttggccactaccttgggtttcttaatgatagggcaccacaggcttggtagctcatacctataatcccagcatttagggaggccagggtgggaggatcacttgagtccaggagtttgagatcagcctgggtgacgtggagagaccctccccgccactgctctacaaaaaattaaaataaaaattagccaccatagggaccgggcatagtcgtcacgcctgtaatcttagcactttgggaggctgaggtgggcagatcacttgatgtcaggagtttgagaccagcctggccaacatggagaaaccccatctctactaaaaaatgcaaaaattagccaggcatggtgacgagcgcctgtaatctcagctactcaggaggctgagacatgagaatcgcctgaacccggggtggggggtgcagggctgaggttgcagtgagcagagatcacaccattgcacttcagcctgcacaaaagaatgagacattgtctc

SEQ ID NO: 36887 - DNA, 1294 bp, Homo sapiens
gaaatagttcagtcctcggtaatttgtcaacctcgtgctggctttaaaattctcctcccaccttctagtcctgactgagggggcccaaaagcaaactccccgggggcttaaacgctcggattcctgagaaacggcaagtgagaaaggagttgcagttgtacgaagaaggagcgaggaaaaggtgtttgtggagggagccccggatctgtcttcctacctgttagccgagaacaaaagggggctggcgtttcccgaagcgaaagggcgcagacagccactttctctgctaaacaaactgcagtcctgggcataacaagaaaattactcacgcagggggagcaaggggagcacagagaaacagaacctagattatgcggaaggcatcttaatttaattaactccttgggaaggcagaggcgctctgaaggggcaggaacttcgcagccgtttctctattcacctgatacagtctggccctaacaatctgtcctttaacaattttttttctttttaatgatcttctttgatctacttagtctatagctctctaatttatataaaattctgctgtggtttgggctgaaattcagtgagcctacctatccgaccatcagtcatttatctcatataccagtgcacaggttttagcagatgaaccctgactgtatattatttttagataattcagtgtaatattaccattaccaaagagcgaaactccttatcaagttacttcttaatttttttctccaatgttttgaaagcttcactgaactgaaataagtgtgtacacatcttccttggtgacagccagtcaagtaaattttacaaaatttctccacatgcctggaaattcctgtgaagaagactgatgaaagaaaagtagcctcagctccaccaacatatttatgacttttcattggtttaagtttctttccttgcaagattaaaagtaaccagtggtctgaaacgggacggtggagaaatgacagcagatgatgatcgctgttatttcctgaaagggagtgtgggaactacaaggctcagctctagacaaaacgaaagtactttaggatctctgcattcacttaaaatacttcttttgacatacatttccagcaactcaatgggagtgtggaaatttaaccttcctaattatttgtggcaagagccattggtggatatttaaggttgttctgtttgtaaaagggtttcaaaaggaccaatggtttgctcttcctctatgaagaaactatctgccctacaaattaaaacaaacaggtactatgaaata

SEQ ID NO: 36888 - DNA, 510 bp, Homo sapiens
aaccaggtgtggggagacaggaggacgatagtgagagacaggaggtgaagtggacagaggtgactgggtcagacagtggggagtctattgaaacttgcaggggagttcacaaattcggattcaccacttcaggtctcagtgatataaactaaggctggaacagaagggtttgcttatatgcagtgagaagtctagttttataactatcattactttaaaaaatgtttcattccagctgggcgtggtggctcacgcctgtaatcccaggactttcagaggccgaggtaggtagattgtttgagttcaggagttcaagaccagactgggcaacctagtgagaccctgtctctacccctaatacaaaaagttagtcgggcatggtggtgcacatctgtggtcccagctatactcgggaggccgaggtgggaggatcacttgagtccaggaggcagaggttgcagtgagccaagatcgtgccactgccctccctagtgagtccccgtctcaaaa

SEQ ID NO: 36889 - DNA, 463 bp, Homo sapiens
aagatctgtgaaaggagaaaaatagcaactggatggaaacatcttcatgcttaaagtaatggcactctaaggttaaagaattgttggattgattttaccccctggattattttaggaatcttggagaatgacattgatttcagatttcaaaaaaagttagcagaggttgtagtgagccgaaatcaagccactgcactccagcctgggcaacagagcgcgagactccatctcagaaaaaaaaatagtatgtaatcaaaatcatagtttgatataaggcaaattaccttgtataattgcatttgtggttcagtagttattaggaactgacctagatatgtatcatatatgaagtgaattacctatcccaagttctcttccttacaccaccccctccaaaaaaaaaaggaaagttagaaagctaatcaaatccactaaattcacaaagcattgtaagaaaaaaaaa

SEQ ID NO: 36890 - DNA, 635 bp, Homo sapiens
gatggggtttcaccatgttgtctagtctggtcttgaactcctggtctcaagcaatccacccgcctcagcttcccaaaatgttggggttacagatgtgagccactgcgcccagcctgttgctgtttttttcaaaacaactctttgctgacccttctaaatccatccagggcagccccagaggcccagattggctggattcgtgtaacccttctcaactctgtaactagaatcatgaagggtggcactcgctttttatagaagaggaaaccgagtcccagacagggaagaggccgcttgattgacagaaaggggccccagaggctgttgaaaatttcccttcagccgtcagtgggtggggctggtagggtctcaccttgctcccaagactgttgccattagcaaccaacttcccctgttggttctgggggccctggaggggaagagggaagaaggtgaagcaatgctgtcaggtggcagctgagtgtctgtgccaggaggttatgcgggtgacaccaggaagaggcccaggcacacagagtcaccgcgtgcacagcccgttggtttgctcttcatcattcccagccatggggaaattatataaagacattgcattttttacaaaaacatctccccct

SEQ ID NO: 36891 - DNA, 232 bp, Homo sapiens
agagcgagattccatcttaaataaataaataaaaatataatacagaggcaggaaagtacaattactggtcagctttcctcgaactagatccctcccaatgccaggtgaccattggacaaagtggagaggggatttattaatattctactgcttatttcccaagatgaggattagctcttagccactgctgtcttccaaatgcagttacatcagcatctttagtaaaaaaacg

SEQ ID NO: 36892 - DNA, 875 bp, Homo sapiens
  misc_feature (40)..(40): n is a, c, g, or t
  misc_feature (43)..(43): n is a, c, g, or t
  misc_feature (45)..(46): n is a, c, g, or t
  misc_feature (96)..(96): n is a, c, g, or t
  misc_feature (99)..(99): n is a, c, g, or t
  misc_feature (203)..(203): n is a, c, g, or t
ttgactctagcaggatcctgattatccccaacacaaatantcncnnagtacacaaacataaactggtcctggtatttccataaacagtgcagctanganacagtttagagaaaatttaacaggattcagattatatccattctgtcctctcggccctgagaggtaataattcccatatgggtcctagtcctccccaatggttntcccatctctgatggaagagtccttttacaaagtggtgttgggcgatacccaacacatatatactccacaaggattttgcatggaccccagtttaagaagcaacaatttagtggtcagtagcattggcgctttggcttctgacacactcagaccttgggcctgtttctcaactttttctgaacctcagtgtttttgtgtattcaacagggataatattaattgaataattaggaggaacaaatgcaataatgtacataaagcatgcatagtagtgtttataaatagcagccaccactgctttgattagaaataataacagctaacatttgaggatttactgtgtgccttgaacgctgctaagctcttgtatatacattacatattgagtggtagaatcaggattcaaatccagatctgactccaaagcgcatgcttttataaaacataatttaaatatagaatatcaatgtaaattgcttatttagaaagtttattttcttatattttctcaaaaatatttattgtcaaatcagtgattctgtagaggggtaaatagctaaatttccttttaaaaattgtatgatgtgctgatttcaaattgatgtgatatacagatttcatttaaaggcagtcatgccagattgtgctacagtaaaggaatattcagacca

SEQ ID NO: 36893 - DNA, 647 bp, Homo sapiens
  misc_feature (14)..(14): n is a, c, g, or t
  misc_feature (18)..(18): n is a, c, g, or t
tcgctctacaggancttntatcgcccaacacatatatactccacaaggattttgcatggaccccagtttaagaagcaacaatttagtggtcagtagcattggcgctttggcttctgacacactcagaccttgggcctgtttctcaactttttctgaacctcagtgtttttgtgtattcaacagggataatattaattgaataattaggaggaacaaatgcaataatgtacataaagcatgcatagtagtgtttataaatagcagccaccactgctttgattagaaataataacagctaacatttgaggatttactgtgtgccttgaacgctgctaagctcttgtatatacattacatattgagtggtagaatcaggattcaaatccagatctgactccaaagcgcatgcttttataaaacataatttaaatatagaatatcaatgtaaattgcttatttagaaagtttattttcttatattttctcaaaaatatttattgtcaaatcagtgattctgtagaggggtaaatagctaaatttccttttaaaaattgtatgatgtgctgatttcaaattgatgtgatatacagatttcatttaaaggcagtcatgccagattgtgctacagtaaaggaatattcagacca

SEQ ID NO: 36894 - DNA, 355 bp, Homo sapiens
ccagacaggtcagatggtgacagttttctggggatggagctcttcttcagagttccaaacctcctcatccccttttcatgatggttaggctgctaattttcacaaccactgtgaatacaaggctgctagttttcaaggttgccacagagttggctagagaggaatgagaatagggtgagttaaaacaacacaaagctcactcttcttaccaatattcagccattttcttcttaaataagcatgccttagtttgttgaaagcttcaggctaatttctagaattctgaaaaagttgtttttaacaattttttccagtgttctcatagtttcgtggaagagcagacttttggaagtgc

SEQ ID NO: 36895 - DNA, 386 bp, Homo sapiens
tctttgagacagagtttccctcgctcttgtcacccaggctgttgtgcaatggcatgatctcagcacactgcaacctccacctcctgggttcaagcgattctcctgcctcagcctcccgagtagctgggattacaggcgcccaccatcatgctcagctaatttttttgtatttttagtagagacagggtttcaccatgttggccaggctggtgtggaactcctaacctcaggtgatccacccgcctcggcctcccaaagtgctggaattacaggtgtgagtcattgtgcctagccaaatttatataacttttcttttgggacttccaggattgtgtcatacttcaaaaggccttcctctcctgaagattattaaaacaaataaaacc

SEQ ID NO: 36896 - DNA, 481 bp, Homo sapiens
aattggacaagagtttcttcttggcttccatatgacatcaggtctttcctaaataaaagcaatcaatgcaggaaaaaaaaaaattcaaagataggatgccactctctttcacaacgattagtagttttatatttccttccagtcttgttgatgtggatttaactagtacatatttttaaatgctaaaaattgtatgtatttctttttatacctcacattatatcataaacatatatgtttctatataacctttatatgactaattacatcataaacatatttgcatgtttctatataacctttacgaatttaacaactgtataatattccttcaagttgatataccccagtttcttaaactatttctcttctgttaagtgtttgtagtgtttccctaatataagtaatgttttgttttcacctaggtcttagaaaaaaaaataagtactgttaataaacttttttggtgtataaacccttt

SEQ ID NO: 36897 - DNA, 374 bp, Homo sapiens
tacaagacaagacaccgaacagagaccagccatcatcctcagccttgttatgatagctgcctcatgtgctgcccgtgcctggattcccgagtctgacatcgccctcgtaggtgccggacgggcagcctctcacgccgtgacccctgctcctagcacaccatttctaaaaggtggatcaccgccgagcagttagaatgatatggaactgctttgtctttttcttatgcatttaaaaatactttcaggccaggcgtggttgctcacgcctataatcctaacagtttgggaggccaaggcagaaggatcgcttgggccaagtagttcaagactgggcaacatggtgaaaccccatctctacaaatacagaaagaata

SEQ ID NO: 36898 - DNA, 98 bp, Homo sapiens
gaattttgcatgtaggtgaaaatgacttatgacttattttatgttttcatttggggcttcttaataccgtctcttgattccctttcatcatctttttc

SEQ ID NO: 36899 - DNA, 296 bp, Homo sapiens
ccgaaaggatcttgaggacccctgggtttccctggaccacacttcgtgaattgctgctgtagggctttgtcggcttcggtagaaattttgaacttcaataagcaaatagagagttatgagcagcatcccctgggctcatgttccttcctgaaaaatgccctcttgggccactgctgcatggagcaagggttattggggcaggatggggagctgggagacctgtcgggccaccttgggtgtctccccaggcaagagaggatgacgctcgaatggacatggtggccactgaggtggag

SEQ ID NO: 36900 - DNA, 1318 bp, Homo sapiens
taatttttaaaggcaatttagtatacatgatgagctagctttgaaatacagatttaaatgtttaaaaattaatttgagggcaagatttggtaccaaagtttcaaaaattttatttcactgcttataaaatactttatcagaacacttattttaaaaaataacatcttatttgaaaaactccaaatttgatgggatagttacaccatcatacaattttaaaggtagaattagctttctaatactttaaaatattttctgaaatgaacatttcacttggtttaggaccgtgtctgtaagtaaaagacaccaatgctaatagatatgacttacaaaaatgccacatatcgaaattgattgaggattgaaatatatatactttggcattgagaagagaggaagagaaaaaaataaaaaaagtgtgacattgtaatatttattgtatttaataaatcttgaagaaagaactcttgagcaatgaaccagtgacaggatataaaagcctgttttatttgatgacatcattaactgagttttctcatctatacattcatacatcgagaaggaactgtccttaaaaaccagtgtttctttttttttttaagttctagcgtacatgtgcagaatgtgcaggtttgttatataggtatacacgtgccatggtggtttgctgcacccatcaacctgtcatctacattaggtatttctcctaatgctatccctccccagtgatatttgttaatatgcttttttaaaaaagtgtctgccttgaaactggtaattaaaaaatatctcctagggcatttaattatttttcccaataaacaactcatagataacgggttgactaatgttatctttatttagaaaatttgtatgtaaactgtgtaaacttgtctgagttaaccaatagactaccggggttttagcatggtaaactgatatacagggagacccaaatacaggcttgctttgctgactacccagcgtgctttattacaggagatgcaaaaggtggaagaccagttacacctttttttttttttttttaaaacctggacatcctttctctggtgacaagagccatccttatggtaaggaaggtgagatagaaaatggagaacctttggtaatgttgatctttcttgtgggtgtccacctagcctaaaagccaagtgaagaagaacataaaaaagcagaagaggaaaaatgaagaaaagaggaaaaagagggtggggccagagaaataaagagtaggattagtaagtgaaagaaaaagttgctttgttgtgtggggggggtgttcttgcttgctatactc

SEQ ID NO: 36901 - DNA, 570 bp, Homo sapiens
ggactgtcaatactatttgctgaatttattcaaatcacacttcactctttccctctgtgctctggccacactggccttctttcactttctctaaattgtcatgtactgtttcatctcaaggcctttgtatgtgctgtttcctggcttacaatgctttccccctttatctacttctcattcttgagatcctagttactatttcctcaaagaactcttccccagactccagctcccataattcctcatgcttttggtgtatcgcacttttttcaatatatttttcaagttttactttgaatgatgttaattacagcatttgaaggggaggatctaaattcacacaaaatggaaggctctaaaatacacccattaaactgctaaaaaataaattgagtggtgagaatacaacggaagtccaatttagattctgagtgttgtcaccatgtgattcttccaagcttatatccagaactcctggaagctatttcatattctggtggggggggcacaaaaccacagcatgagaaggaattaagtcctgaattattggcttcatcatatccaccctct

SEQ ID NO: 36902 - DNA, 793 bp, Homo sapiens
ccacctcagcctcccaaagtgctgggattacaggcatgagccaccatgcctggcacacaattctgtatgatgtaaatatagcactcaaaattgtacatgttagtgtttttgccctcaattttatactttattatctagaaaaatattacatatacacagatgttatggatcttataccactttcttttctcagagttagagaatacattagtgaacatttctgtgttgaaaactattttattgaataatttcagtcattcatataagtcagaaccagctctctctactctctccattttaccttgagtcacattaaaagttctgcccatgaccaattggtaaatatatgtgtttgtgtgtgttttccagggagcattgacatttagggatgtggccatagaattctctctggaggagtggcaatgcctggattctacacagcagaatttatataggaatgtgatgttagagaactacagaaacctggtcttcctgggtattgctgcctttaagccagacctgatcatttttctggagcaaggaaaagagccctggaatatgaagagacatgagatggtggaagaacccccagttatatgttctcatttttcccaagagttttggccagagcaaggcatagaagattctttccaaaaaatgatattgagaagatatgacaaatgtggacatgagaatttacacttaaaaattagttgtaccaatgtggatgagtgtaacgtgcacaaaaaaggttataataaacttaaccagagtttaacaactaaaaaaaaca

SEQ ID NO: 36903 - DNA, 331 bp, Homo sapiens
attagggcctgtgtcatattgcaatgtcgtcttgcttatgtagtttgaataattttataggttagatttggaaactgtacttatctgagtctaatatgtagattaatttgttatttttatttcttttcagttatatgttctcatttttcccaagagttttggccagagcaaggcatagaagattctttccaaaaaatgatattgagaagatatgacaaatgtggacatgagaatttacacttaaaaattagttgtaccaatgtggatgagtgtaacgtgcacaaaaaaggttataataaacttaaccagagtttaacaactaaaaaaaaca

SEQ ID NO: 36904 - DNA, 243 bp, Homo sapiens
ggaaaaatataaaaattagatctattctgacaccattcatcagtataattttaaatgggccagaagtttaatgtaaaaactttaattattcaaatactataggaagcaaatgcttttataatgtggctacagattaaatttacatgactactagctaaaattcagaggcaatcagggagtaaagattgactaatttgattgcatagcagttttttaaaatggcaaaacattttcaccataagc

SEQ ID NO: 36905 - DNA, 964 bp, Homo sapiens
  misc_feature (6)..(6): n is a, c, g, or t
ggccgngagcctgtggcgggcaagcggggagaccccggcgcagcagaaccatggatggcccgacgcggggccatggactccgcaaaaagcggcggtcgcggtcgcagcgagaccgggagaggcgctcccggggcgggctgggggccggcgcggccggcggcggcggggctggccggacccgggcgctctcactcgcctcgtcgtcgggctccgacaaggaagacaatgggaagcccccgtcctccgccccgtcccggcccagacccccgcggaggaagcggagagagtccacctcggcagaagaggacatcattgatggatttgccatgaccagctttgtcacttttgaagcgctggagaaagatgtagcacttaagcctcaggaacgtgtggagaaacgccagacgcccctgaccaagaagaaacgagaagcacttaccaatggcttgtcctttcattcaaagaagagcagactcagccacccacaccactacagctcagatcgagaaaatgaccgcaatctctgccagcaccttgggaagagaaagaaaatgccgaaggcactcagacagctcaagccaggacagaacagctgcagggacagtgacagtgaaagtgccagtggagaatccaagggcttccaccggagcagctctcgggaaaggctcagtgatagttcagctccttccagcttgggaacaggctacttcagatcagggaagatgtgccttggagaggaagcatgtcttaaatctggaaatgatatgaagagggatgtcagcaacacttcatcctgggccagtaatagggagagtttcttttctctcgtcaaattgcttaaaggattctagttccgtttggtgtggtcactcacatttgaattctaatactctatgtgatatagattctgttgactactgttagcgtgaccccaatgagaaattaaacacttccctccttttca

SEQ ID NO: 36906 - DNA, 851 bp, Homo sapiens
  misc_feature (736)..(736): n is a, c, g, or t
ttatattttttatctttttaatttaatctaaataaatcaactttccccccacgagatcagggaagatgtgccttggagaggaagcatgtcttaaatctggaaatgatatgaagagggatgtcagcaacacttcatcctgggccagtaatagggagagtttcttttctctcgtcaaattgcttaaaggattctagttccgtttggtgtggtcactcacatttgaattctaatactctatgtgatatagattctgttgactactgttagcgtgaccccaatgagaaattaaacacttccctccttttcaaaaaaaaaatttttttttttacacaaaaacccaaaaccaaaaacaataaaaaaataccctccccccttcttacacacctcaatatcgtgcattagaagaacttataatatttattccctctcatcttaaatatgccttttctccttttatattccaaatcatctcctcacttttactcctcatttattcactgccttcttacttccacgttgattacattccacattcttttaccactctttccacgtctcttctacaattttccttcccttccctccattttttagtcttgtaccctacatcaaaattttcatccctctttttcccttatctatcttactcttaatcctgtctacccttcctacctccaatttctttcatttcctcccattcctttcccagtattatctctccacaatatcagtcgtnattctccctccccgtcatttcttctttttttcacttctttcctccccccccacactccccttactccctcatccgtcttctatcctcgcctccttcaaataatcctccaccctat

SEQ ID NO: 36907 - DNA, 1631 bp, Homo sapiens
  misc_feature (6)..(6): n is a, c, g, or t
ggccgngagcctgtggcgggcaagcggggagaccccggcgcagcagaaccatggatggcccgacgcggggccatggactccgcaaaaagcggcggtcgcggtcgcagcgagaccgggagaggcgctcccggggcgggctgggggccggcgcggccggcggcggcggggctggccggacccgggcgctctcactcgcctcgtcgtcgggctccgacaaggaagacaatgggaagcccccgtcctccgccccgtcccggcccagacccccgcggaggaagcggagagagtccacctcggcagaagaggacatcattgatggatttgccatgaccagctttgtcacttttgaagcgctggagaaagatgtagcacttaagcctcaggaacgtgtggagaaacgccagacgcccctgaccaagaagaaacgagaagcacttaccaatggcttgtcctttcattcaaagaagagcagactcagccacccacaccactacagctcagatcgagaaaatgaccgcaatctctgccagcaccttgggaagagaaagaaaatgccgaaggcactcagacagctcaagccaggacagaacagctgcagggacagtgacagtgaaagtgccagtggagaatccaagggcttccaccggagcagctctcgggaaaggctcagtgatagttcagctccttccagcttgggaacaggctacttcagatcagggaagatgtgccttggagaggaagcatgtcttaaatctggaaatgatatgaagagggatgtcagcaacacttcatcctgggccagtaatagggagagtttcttttctctcgtcaaattgcttaaaggattctagttccgtttggtgtggtcactcacatttgaattctaatactctatgtgatatagattctgttgactactgttagcgtgaccccaatgagaaattaaacacttccctccttttcatttgcagtgtgttttagtttaaccttcatttgtttctcttttctccattcctcatcccaattcaggtatcagatcctttgacaattgttaacctgcccagctgggatttttggcattaagctatgactgtaacgtttctactaataaattagattttttaaaagagtgctgcttgccaagaagcaaagtcattacatagtgtgtatatgttcaatgtatggctataaaagtctccttagccaaacataatcgacagttaaaataaatttaaaataaccgtgctacctctagattttaaaattgttaaggtgaagataggtggtctaattttactctatttccatttttcttattcacagggtatatttgttctgtaaaaccacatatgtatcttatagtctgcagctgatgtatttatctgcctaaatacacatttctccaatggaatattctgtaatatcaagcatttcttttttagatggaaattaattttataacagttgaacatcatctttgtcaatcagcagctttatctaccataaagaacaaaaacgtacttggcgtggcctgctttaacttttgtagttcctatgtttaaactgaacagaggaatattatgtgaacaaattggaaaattatataaagaaataaaaatctttttactatt

SEQ ID NO: 36908 - DNA, 1123 bp, Homo sapiens
  misc_feature (6)..(6): n is a, c, g, or t
ggccgngagcctgtggcgggcaagcggggagaccccggcgcagcagaaccatggatggcccgacgcggggccatggactccgcaaaaagcggcggtcgcggtcgcagcgagaccgggagaggcgctcccggggcgggctgggggccggcgcggccggcggcggcggggctggccggacccgggcgctctcactcgcctcgtcgtcgggctccgacaaggaagacaatgggaagcccccgtcctccgccccgtcccggcccagacccccgcggaggaagcggagagagtccacctcggcagaagaggacatcattgatggatttgccatgaccagctttgtcacttttgaagcgctggagaaagatgtagcacttaagcctcaggaacgtgtggagaaacgccagacgcccctgaccaagaagaaacgagaagcacttaccaatggcttgtcctttcattcaaagaagagcagactcagccacccacaccactacagctcagatcgagaaaatgaccgcaatctctgccagcaccttgggaagagaaagaaaatgccgaaggcactcagacagctcaagccaggacagaacagctgcagggacagtgacagtgaaagtgccagtggagaatccaagggcttccaccggagcagctctcgggaaaggctcagtgatagttcagctccttccagcttgggaacaggctacttcagatcagggaagatgtgccttggagaggaagcatgtcttaaatctggaaatgatatgaagagggatgtcagcaacacttcatcctgggccagtaatagggagagtttcttttctctcgtcaaattgcttaaaggattctagttccgtttggtgtggtcactcacatttgaattctaatactctatgtgatatagattctgttgactactgttagcgtgaccccaatgagaaattaaacacttccctccttttcatttgcagtgtgttttagtttaaccttcatttgtttctcttttctccattcctcatcccaattcaggtatcagatcctttgacaattgttaacctgcccagctgggatttttggcattaagctatgactgtaacgtttctactaataaattagatttttt

SEQ ID NO: 36909 - DNA, 2710 bp, Homo sapiens
  misc_feature (148)..(148): n is a, c, g, or t
  misc_feature (266)..(266): n is a, c, g, or t
ggtgtatgactacagcgccgccgacgaggacgaggtctccttccaggacggggacaccattgtcaacgtgcagcagatcgacgacggctggatgtacgggacggtggagcgcaccggcgacacggggatgctgccggccaactacgtngaggccatctgaacccgcagcgcccccatctgtcttcagcacattccacggcatcgcatccgtcctgggcgtgacccgtccattcttcagtgtctctgttttttaaaacctgcgacanttgtgattccacttcagtgttcatttttatttttctgaaagtaaagatactcctgtaaaatgccattgtccatagaaaaaatattaactcattaagtttaaagacagatgataccttaatattaacttacttacacgattttaaagacgcctactgagagaactcaaatttataaactctgttgcctaataattatggtttaattctatatcctcttgcttgttacagttatacttaatttgcagtagatttttaaatgaaattatttgaatgtattccagactattttatttaaaatcatcatacatcatatactttgaacctttattttctaatgcaatcataaacattttaagttttattaactcactagcatccccactgactatattctgttttgctttatctgctcaagcactttcgaccatattttattttaggatttttatttttatcttccacagctggatattgctatttcacttttatttcacatgcagctttaagacgtatgagcatcagcacagcaaaatggttccagcctacagaatgcagtctcccagggccctgccaagaacatatctgtatgtctggccctacaaatgacaaatggtaattcccttctattttagctcttaattagttgctttcactatttccgaatatacctgtggctaagtttttattgaaacactcaaaaataccacttctcagtatgaacacaattgctaagagcctaatttggttctggactatggtcaacctgtgtgccttgttagttctctccagcagctggtgagtaaggaaatgacccttcaatttcctcttctttttcctctgacctctgtgacttaatttttcttaatgtctccaagtcatcaagggcttaataatttatgaattttacaaaaagcatttaaggaataagaaagaggttctgtgatttttcagactctgaaaattcattttgattctacatattccagaaatatactgggttggatgctagagtgaagaaagccgtccagacaattctcccagtccattcatttcttcattcatttgttcattcagtagttattgagtgcttatttcctgggtgcctggctctaggctatgtcctgagacatacagtggacagggtctctaccctcctcacaacaccctcttcaccctccacgccaccccctactactcactctcaccctagcaaggagcttcgtgctaataagagagagtcttacctgaatggcaatcgcccagattaacagtggagacagtaatgcaatgcaggaagttaagtttttaaaggtgattctgtgcagtaaggtataaaacagatatataataaatagcctagcttagtctaacatctctttagaattacacagctaaaaaggaaaaaaaacaccaaaataagataaaataaaacaaatttaaacaccaaaataagatataataaaacatttgtttttgcaaaataaggcccaatgttatggcctaatgaaagctatatacttgtgctatctaaagcactactttgtaaagatgactacccaagattgtaaatacaaaatttaaaaaggtacttaaattttctggaatatccatgtttcagaggtaatatttactttctatttcagtggcttaaattataacgttttggcttaagtgtcttttatcaatacaatgataagacaccttaatcctgagagagaaaattaagtactgtatataggtgtactttgcttctcacaatgattgtgcaaaaagtcacgtgtaaattgaacttttgtaaatcaaattgtattttaaatgcattaggggagctgccatttagaggaaacttgtgaattctttcataaagcagaaaaccattttataatacaaataaccattctctgatttatctcttttgtatgtttggattttcaatatcgactttgcttaaaacagagcccacctgcatagtaactgtgttttgccaaggctgcttgtgctaccagtttgttggtggctaacggcttgtgcttgaaagtcttctgaagtctgatgtgaattgagctatcaagcaatgctatcatagcacagtagcagtcctgaacagtctgagcagccaacccatttcaacaaaattgaacacaggactcttctgctcagcagcatctcttttctcagatgtggccatgttacagtagagggtattccataagcacatattccataaagtgctcagagtcacaggttttataataaattatgttattatgtaaacgaattgcatgcatgttgaaattttttagcagtactttagcttgaaagtactcgtacaaatactgttagatttagttgcaaataattgttctcaagttattgcaataaatgtcaaatgaaacaagctcttgtgtaaatagacttctgtgcctaatagtgacattgtttca

SEQ ID NO: 36910 - DNA, 666 bp, Homo sapiens
ggccaggctagtcttaaactcctgacctcatgatctgcctggcttgacctcccaaagtgttgggattacaggcatgagccgttgcacctggccagggtgtgtcttattgaaattgaacaaaatacctaatttctagagcgtataagagaagtttaaaatgctttatggatgtgttgttttgacagcaaaatatctactcagaatcctatagctatttcaaaatccaagtaacttagaaaaaaaggaaaaagaaaacctatatagtcaaatcttttggtgattttgtattcaatgactgaaacttcccagtgattattgggctttttagctggaattgaacttgaatcggggcagagcagcacaatgcttcagaacttcagcgactctgagccctggttctgcaatgacctgccaagtagctttagtctacttgactgctctgaaccttaattttctcacctgtatgggaatcatagactctactttatgaggctgacgtaagcattacatgaaattttgtatacttatacataatgtgcttagcaccgaatacttggtgacagcagatgcccaatgagagttatcacagatattatttcagaatcgtgaagagtcagaagccaccaaattcttgatttctgtcaataaactgatattcatattctg

SEQ ID NO: 36911 - DNA, 285 bp, Homo sapiens
aaaagctataaatcagtcccttgatagtgctttgtaacatgtatgccaatatgtgaaattactttcatccatcagttataaatttaacaatggtatagtgtttatgtatgccttatatgagcataatcattccataaagatttgtgctaaattgtatattcagttgatgacatttatcatgaagcctgaaaacgtagtatgattttcagttagtacttactattggtagattattttactgtgtttgtacatgtgacaatcatgtttttgtttttcttttagttt

SEQ ID NO: 36912 - DNA, 384 bp, Homo sapiens
tactgggacaagcaacctgcaagagggtgagcttcctacctacaattccaaaataaatcccatctttctgaccagagatataaggaacagaaatccctgtaggccagaaagtgggaggagacttcagatagagctggagaaagggattctcacattctgtatacaaacccacaaaatcatggctcacttttgaggatgtgtgtgtatggaagagaaccaaaggtagcatagcaaaggctttagaaactgttctaagatttaaaatatcacccataatgattcctatgcaagatagactaaatcagcacatcaagacttttgaaaattgaacttcgattggaactatggtccacaggagttgtacagggccacatatataggaga

SEQ ID NO: 36913 - DNA, 488 bp, Homo sapiens
agtgatttttaaaatatgcagttctttatatcccaaaagtacttatatattttatttctatctcctcctggagacagattcaactagcctatcaaaattcttggatgcaattctttcttgtgaaagagcaagggaacttaaaaaatatccctgacctcgtgatccacccacctcagcctcccaaagtgctgggattacaggcgtgagccaccgcacccaaccatttgtcattttttattgtaggtacactagtgggtgttaagtgatatctgcttgtggttttgattttgcgttttcttgatggcttgtgatgttaggctttttcttcatgcgcttattggacactcttatatcttcttcacaaaaatgtctatttaaatattttgcctatttttatgtatttttcctttttactgttgagctgtaaaatttatttgtgcattttggatacagatttctaatcaaatatataagttgcaaacattttc

SEQ ID NO: 36914 - DNA, 750 bp, Homo sapiens
aagaaaccatctaaaagacaagttcacatagtgataagtactgcagagcaagaaaaaccaaggttatggggtagaaggagagaatctctgaacaggtgatatttgagttaagacctgaatatgagaagcaaccagttatgaaaagttatgaaaagctctgggagtaagaaataactctagcataaagactttgaagtggaaacaagcttcttgcctttgagaatagaaaaatgttagtatggctgtaatatatagtgaaaacagagaccatatttgaatcagaaaagagtgagatcagatagagcactgcttcttcattcttatttcattattgtcccctccccactagatgactttataaggatttttttctttttcctaattgtcccctcatgaaatttgaataccaatgatgtactgtatgatctagtcaataaatgcatgtatatctgtactttatacataatcaacctgtatgcaggatgaagtatgaataaaatttgaaggtagtagttaaattaaaaattagaaagctagcaatatctaacttaactgtataactgtatttgctaagtgacttttaatggaatttatgtacttacataaattataatgagtcaacttatgtatgcaaattggcaatttatgtaaatacataatagtaatgtaatcacatttaaaaaattattcacaacatttttctagcaaaggtgaaacaatggaaaacattaaattaatttcttcaaagtt

SEQ ID NO: 36915 - DNA, 483 bp, Homo sapiens
ggcagcacgtgttgcccgcccccggccagggccctacctggccacgacgcgctgcgccttctcggagacgttcccggaggtgggagcgcccaggctggatcactcgctttcctctagttctgctgctcgtgccagcgcgtccgagggcgcgcgggcctgggtccgcaatcgacaactgccaggcgcaggctctcttaaaaggttcagtaagggacctttgccgtccttcctttcgacacggcctgagggcgtgctgtgaggtcccgaggtgggtaggggccagctctcccggtggtcggggtgaggccagagtccttcgcccctggagcgcacgcggggcttgatttcgtttggcaacgacgaaatggcgcgcgctgagcaggggtcagatccatgatgagatcttgcggccaccgtcggatcctaagcttctttgcttccgaggcttggaattcattgttttgcacctcgccgggcggccgg

SEQ ID NO: 36916 - DNA, 368 bp, Homo sapiens
agatgatcactatatctgtcactcagatcttttgttgtgaaaatttgcatgtatttgtcttttttctccagctgggttaagtgctttcagggcagaggcactgtacctgtatttctgtgtattaactcctgcctctttaagtccccgttttgtttactaagataataggtgaaatctgggaaacattaaatcttcatctcgaaaaggaattcatccatttctaagagatgaccaaacaagatgattttgtatgttttaattttttagttttagagataggatgtggctctgtcacccaatctggagtgcagtggtgcgatcatagctcacttcagccaccaactcctaggctaaagtgatcctcctgc

SEQ ID NO: 36917 - DNA, 653 bp, Homo sapiens
agaagaatgtccagaatctacatttggagattttggagactccaaaaatctcagtgacacaaattgctttttctcctgaatcattaaattgcaatagtacttaaataacttgaatggtgactgtggcttttattctaatatattagaaattaagagcttttcttctctaacaaattctcagctatattttatagttcttgtagttgttcaatactgccttcttaaatttattttctcaataatctcaattcttataatgtattatcagaaggtataaaatatttgtatttgttcttatgcttttttaatgtaggttttacactcaaagtgatctttacaatgtgaactgtaatgaatattttaatttttattattacatgcaaaaaatcattaaaatagcagtttgacacaatatatttgacaatttcattttttcgtctctaagttatttcagaagtgaattcctgctttgaacactgaaaatgcaactctgaaagattcccaaaaaccttggatccagtcccaaacaaatcagaaacaggctgttggctttttttttttcctgtgtttccttgttttctcaattgccaatttgttttattatttgaagggaagaaggagacaaaagtccaaaaataaaagccctgcttgtt

SEQ ID NO: 36918 - DNA, 244 bp, Homo sapiens
ggagaatttttttttaagatttctgcaattaaactatttatactttcaatgtaaactctatacggggagggatttatttctgtcttgcttattgccatgtttcccatatctagatgctggtggatgctcaatgaatatttgttctacgaatacatgaaaaacataataggtagggcaatgccaacgaaaaaaggtgccttccgtcagtaattattattataaattgtttaattatctgccttgc

SEQ ID NO: 36919 - DNA, 431 bp, Homo sapiens
tgttttgttaaccttacttagaatccaacattagaccctttcttctaacctaacctgtaggaaggcacttcttgaggttttaagcctctctttaatgttttattgtaagttgtaccttgggagcatcattttttcatcttaaatcctctccagtttaagaaaaatttgaaatataaatggcaaaaactgttaatggcaacagacttctgatgtaaatgtaaattgagatggaaacaaaatgaaaagtagatttccctaggaattagttaaactgagataaatggtcctggatgtttttatagaaagttctcttagccaggtgcagtggcatgtacctgtaatcccaactactcggggggctgagttgggaggactgcttgagcccaggagtttcaggctggcaacatagcaagaccttgtctcttaaaaaa

SEQ ID NO: 36920 - DNA, 506 bp, Homo sapiens
gtgagccaagactgcaccactatactccaacctaggcaacagaatgaaaccccatctcaaaaaaatttttaaacaatttttttaaaaagattatatcctttatcgatttctgactagctataaactataaatagaaacacctcatttccatatccctaggtcattattttagttttcaacatttttatatacagcagagcctttatatttaaaaaggcatcaggattttagcctatcactagtactaacaattgtgagatggggcactatttgatgtatctgccagataagatgtccactctttgatgtaagtttctaggactcaaaaagaacaaaaacaacccaacacttttctaagggagaagaaataaggctcttaccaaaaagctaaaccaagattttaactagaacaaatttctatgtcttaatattatatttgtagagggaagcagagtgggaaatcaacttcattccaaacagcacataagaacacttagaatatcttc

SEQ ID NO: 36921 - DNA, 207 bp, Homo sapiens
aaacactagctatgagaccctgggcaggtttctcacctgtctgttcctcagtttccctgtatacaaaacagggataacaatagtacctacctcactgtactgttgtaatgattaaagtggttaataaagtaccttaaaacaatgtccagcacattgtaagtgctttttcttttcatcactttgggaaactaccattttaaagatcta

SEQ ID NO: 36922 - DNA, 278 bp, Homo sapiens
cacctcagccttccaaagtgctgagattacaggtgtgagccactgtgcccacccgacatgtcagtgttagtatttgtaaagtgacaggcacagttattacatgcttcctggatgtggctggtaaaacctgttcaatgactggtaaaacctatactaggctgaccctctggaaacattcctaagcattgattaatgttatacaataacatttagcactgtgcttcataaatagctaggcattgtactaaacatgttatataaatgaacttactaattct

SEQ ID NO: 36923 - DNA, 648 bp, Homo sapiens
ggtcagaagagggtaaggaggaaatggagactggacaggggcagcaagagggacccgcccacaggcaagccgccatgctgagctttggggccaggacgggcaaatatcaaaatttcgttacatgatgtgatgaaacctggggtggcggcggcaatgctggtaggtagctgttgggggtaagggagtttctactctgcctacaggtctcgggtgaattcacacaaactcttcggtatgggctgggggcatttccacttccgagcgtacacgtcaaagcctacaacaggaaagaagacccttttcctgcaaaagggcggtgtgttcggagactacttccaagggacagagcgccgcgctcaggcagggctcttggctgggtgtcccggctgggtgtccacccacgggtaaccctgtgagcctcagtgtccctagctgtcctccgggggggtgggggtgttgggccacacacgcgatgatattcaaggagtccaaggttctcaaaatgtactctggggccaggcgactcccgagacccttttggggtctgcaaggttcatttttgactttccttctcctgagtatatggtggagtgttccagagcctgacgtgtgatctgactgactgcagaagcagacatgagaacatga

SEQ ID NO: 36924 - DNA, 398 bp, Homo sapiens
caactctgatctaagcacaagagagacatcagtgaatgccatcatcaaaaagtctccctgtcctcatcttattaggtaaaaccatatgaaattgctgtttttctagttaaaccaattgaatataaataacacctactatctgatccagccattccactctcaggtatttaactaaaagaaataaaagcatacaccctcggatttgtacaccaatgtttgcagcacctgtatctgtaatagcccaaactagaaacagtccaaatgcaaaaacagtgatatgtccatagaatggaatactacacaacaataaaaaggagtgagatactgatatgtactacaacatgggtggacttcagaaacactattctacgtgaaacagatcgaatacataagaccac

SEQ ID NO: 36925 - DNA, 403 bp, Homo sapiens
gtaaaatcttacatttccttgtttagtatgtaattagctctgcattttttgttatatgtgacatttattggcttgaggtgcctttttcctatacctaaatttttcagagatttatcatgaggaaatgttgaattttgtcaagcttttattctgcatctatttaatgttaaaaatgtaaaatcacaatgaattctacataaattgaaaagttttcaaagactattatgaacatctctatgtatgcaaactaaaaaatttagagaaaactgataaagttttaactatacacaactttctaagattgaaccagtaagaaccagaagtcttaaccagagcaaaaatgtataaaatatataatgatattgaataagtaataaaaaagtatcaataataaaaagccttg

SEQ ID NO: 36926 - DNA, 350 bp, Homo sapiens
actcacttgtgtaatccacagtgaaggtcagcaaaattctcaatactactgactaagaatttagaattatggttatctaaagaacttgctttgcttgatctaaactagaaatatttaaaatttcaaacaattatttgtgattacagaaatttctcagatttcatgcagttcttctagagctctatctgtggaagtatagttgtgagtacatttatacttaagcagaattactcataggaaatggtaaggtcagccaaacacaatggctcacatctataatcccagcactctgggagaccaaggccagaggatcagttgagcccaggagtttgagaccagcctcagcaaca

SEQ ID NO: 36927 - DNA, 2469 bp, Homo sapiens
ggattacaggcatgcaccacaatgcccagctaattattgtatttttaatagagacgaggttttgctatgttgtccaggttggtctcgaactcctggcctcaattgatccgcctgccttggtctttcaaagtgctaggattataggcacgagccactgcacctggcctcaaaaatcatttttaaaagaagcagtatattagctctgggtcttctcatgactaaaatgactatttttaaacataagaccatattttataaatgtacagataattcaaatctattatctaatgtattaggttaatttctatttgttctatacttttttttttttttttttttgagatggagtcttgctctgtcgcccaggctggagtgcagtggtgcaatcttggctcactgcaagctccgcctcctgggttcatgccattctcctgcctcggccttccaagtagctgggactacaggtgcccgccccgacacctggctaatttttaaaaaaatatttttagtagagacagggtttcaccgtgttagccaggatggtctcgatctcctgacctcgtgatccgcccgctttggcctcccaaagtgctgggattacaggcgtgagccaccgcacccggcctattgacattttttaaggtttcagattttcttttgtgtgtctagtaattcgtcttttattgtcaaagataatttgcttatttgacttagaaaaatgatttgtgggcatacaatattgtatgtggtacctaaacgttgccatttagttactcttacagaacaactttcattacactgtatattaatataaattacttcttgagtaatcccagaattgtagaaccaattggtagaatcagaaactgtctttggacttgaggtttttcttcccttagggtaaattttaggttttctggttagtttccaggagttggcggacaagttcatatcactaaaggtgttcatatcactaaaatagtaatgctaatttgtttcatatttctattttaaaaagcaatcaataaagacatttcaatacatttcatttggaagcccccaagtgtatggtggttaataaggctcagcatgctggtaacccaccattctcttagctagtgactccactaaatagtgctagccgctgagatggttttgaccctttaacagcctttttttttttttgagacagagtttcactcttgttatccaggctggggtgcaatggtgcgatatctcggctcactgcaaccactgcctcccaggttcaagcgattctcctgcctcagcctgccaagtagctggattacaggcacgtgccatcacgcccagctaatttttgtatttttggtagagacggggtttccccacgttgaccaggctggtctcgaactcctcacctcaagtgatccacccgcctcggcctcccaaagtgctgggattacaggcgtgagccaccgcgactggcctacacagcttttaattgcttgatttatactttattaaagagaggaagcacaatgagcagtgatactaaaatataactaatatggcatgtgaaagtgatcattattcagatgatcttcaccaacactgcatttgcatatatctgaccaaactttatgcgacataggcaggtctctggcacttcaaaaatgaatgttaaatagaaaataataaataatagctgattagggtaatcatttatttaatcagaataaagattatatccataaaatttacttgcagagaagtactttctttttgttttaaagacagggtctcactctgtcacccaagctatggtgcagtggcacaatcacagctcactgcagcctggacctcctggcctcaaggggatgatcctcctacttcaggaattatgccaccatgcccggctagttgagaagtactttcaaatagcaacatgaagcctttcctttaccatttgaaaataaaacatagttgtaaacataaaccagtatgtctttgtaaagccaataatatatcattttataggagcattgtcttcttgtgtttttcaagttgactatgtagttcaatgtcagtctccattttaatatcttgtttgtttatcagcctgagcatatttcattttaaaatgtatttgttgagaagtcatggtggttttttgtttttcacaagtcaagtagcttgaacactatcacttgtccaatgggaaagttgatgcttatctttatggcaaatgcttggttgaataatatatttgcaaagatgttaattctacagagagctaaataaagttaagatacctgtaaaacagtttctccagatgactttaaaataagccttatttttgtaaatttatgttaaattttaggtgttaagttgtgaaatacctaatgatgtgggcctaaatttgcctcattcagactgagacagggctgttaaaattcatttctagctaataaactgtgctataacttc

SEQ ID NO: 36928 - DNA, 3450 bp, Homo sapiens
ggattacaggcatgcaccacaatgcccagctaattattgtatttttaatagagacgaggttttgctatgttgtccaggttggtctcgaactcctggcctcaattgatccgcctgccttggtctttcaaagtgctaggattataggcacgagccactgcacctggcctcaaaaatcatttttaaaagaagcagtatattagctctgggtcttctcatgactaaaatgactatttttaaacataagaccatattttataaatgtacagataattcaaatctattatctaatgtattaggttaatttctatttgttctatacttttttttttttttttttttgagatggagtcttgctctgtcgcccaggctggagtgcagtggtgcaatcttggctcactgcaagctccgcctcctgggttcatgccattctcctgcctcggccttccaagtagctgggactacaggtgcccgccccgacacctggctaatttttaaaaaaatatttttagtagagacagggtttcaccgtgttagccaggatggtctcgatctcctgacctcgtgatccgcccgctttggcctcccaaagtgctgggattacaggcgtgagccaccgcacccggcctattgacattttttaaggtttcagattttcttttgtgtgtctagtaattcgtcttttattgtcaaagataatttgcttatttgacttagaaaaatgatttgtgggcatacaatattgtatgtggtacctaaacgttgccatttagttactcttacagaacaactttcattacactgtatattaatataaattacttcttgagtaatcccagaattgtagaaccaattggtagaatcagaaactgtctttggacttgaggtttttcttcccttagggtaaattttaggttttctggttagtttccaggagttggcggacaagttcatatcactaaaggtgttcatatcactaaaatagtaatgctaatttgtttcatatttctattttaaaaagcaatcaataaagacatttcaatacatttcatttggaagcccccaagtgtatggtggttaataaggctcagcatgctggtaacccaccattctcttagctagtgactccactaaatagtgctagccgctgagatggttttgaccctttaacagcctttttttttttttgagacagagtttcactcttgttatccaggctggggtgcaatggtgcgatatctcggctcactgcaaccactgcctcccaggttcaagcgattctcctgcctcagcctgccaagtagctggattacaggcacgtgccatcacgcccagctaatttttgtatttttggtagagacggggtttccccacgttgaccaggctggtctcgaactcctcacctcaagtgatccacccgcctcggcctcccaaagtgctgggattacaggcgtgagccaccgcgactggcctacacagcttttaattgcttgatttatactttattaaagagaggaagcacaatgagcagtgatactaaaatataactaatatggcatgtgaaagtgatcattattcagatgatcttcaccaacactgcatttgcatatatctgaccaaactttatgcgacataggcaggtctctggcacttcaaaaatgaatgttaaatagaaaataataaataatagctgattagggtaatcatttatttaatcagaataaagattatatccataaaatttacttgcagagaagtactttctttttgttttaaagacagggtctcactctgtcacccaagctatggtgcagtggcacaatcacagctcactgcagcctggacctcctggcctcaaggggatgatcctcctacttcaggaattatgccaccatgcccggctagttgagaagtactttcaaatagcaacatgaagcctttcctttaccatttgaaaataaaacatagttgtaaacataaaccagtatgtctttgtaaagccaataatatatcattttataggagcattgtcttcttgtgtttttcaagttgactatgtagttcaatgtcagtctccattttaatatcttgtttgtttatcagcctgagcatatttcattttaaaatgtatttgttgagaagtcatggtggttttttgtttttcacaagtcaagtagcttgaacactatcacttgtccaatgggaaagttgatgcttatctttatggcaaatgcttggttgaataatatatttgcaaagatgttaattctacagagagctaaataaagttaagatacctgtaaaacagtttctccagatgactttaaaataagccttatttttgtaaatttatgttaaattttaggtgttaagttgtgaaatacctaatgatgtgggcctaaatttgcctcattcagactgagacagggctgttaaaattcatttctagctaataaactgtgctataacttcaaagcaacaacgaccacaaaccacacacccgcccaccccgaaccaaccacccaccacccaggcgccacaccccacacaacacacaagagcgggggcggctccccggaaactcccacccggggggggcgccccgatacaaccagcacacgccacagagcggacgagggggggtgccaacaaaaccggaggcgggtaaccaacaggtggctggtccagcactccgccgcgcggggaagaacgacaaaacaagaacgactcgcacaacacgacagctacctgtcgcagacacgataacactaaaacaacacgcactacgaaagaacaagaaacaagcgactgcaaaccagagaacagacacaacaagcactacaacaggaacgagaggagagaaaggggcggccaaagcagcagagggaaggggggagaggaagaggagacaagacaagagcgaggacagaaagcgacaagaagcaggaagagaagaaaaagagagcgaccgaaagcaagcgaaagggggaggggagaggagaggaggggagagaagcgggcagagaggaggggccagcgcagaaaagcacgtgaaaaccaggggaaagcagaacgggagggagagggaggaggcaaagcaagggcaagaagggacggaaagacggacaggacgcaaagggagaagggaggggcgaaagaaaggcaagagggcgcgagggaaggagcacagagagggacgacgggaagcaaggagaagagagcggagagagcgaggaggactgcacacacgcagaagcgacaaaagcagagacagagacagaaaggaccaaaaagagaggagcacgagcaataaaagacgcgacaaagaaacgagcagaaaaagcaggacaagacaaagcgcagaaaagaagcaagagaaaggaagacgagcgaaggaacaggcaaaaggacgacccaacgaagaagcgaaacacagagaaagagaaaagacaa

SEQ ID NO: 36929 - DNA, 1600 bp, Homo sapiens
ttgcttagaaaaagtgagcagaggcagggtaagaacagaaggtatcatgtaagaaaatgccccaggtgggaggacacttcatatcactaaaggtgttcatatcactaaaatagtaatgctaatttgtttcatatttctattttaaaaagcaatcaataaagacatttcaatacatttcatttggaagcccccaagtgtatggtggttaataaggctcagcatgctggtaacccaccattctcttagctagtgactccactaaatagtgctagccgctgagatggttttgaccctttaacagcctttttttttttttgagacagagtttcactcttgttatccaggctggggtgcaatggtgcgatatctcggctcactgcaaccactgcctcccaggttcaagcgattctcctgcctcagcctgccaagtagctggattacaggcacgtgccatcacgcccagctaatttttgtatttttggtagagacggggtttccccacgttgaccaggctggtctcgaactcctcacctcaagtgatccacccgcctcggcctcccaaagtgctgggattacaggcgtgagccaccgcgactggcctacacagcttttaattgcttgatttatactttattaaagagaggaagcacaatgagcagtgatactaaaatataactaatatggcatgtgaaagtgatcattattcagatgatcttcaccaacactgcatttgcatatatctgaccaaactttatgcgacataggcaggtctctggcacttcaaaaatgaatgttaaatagaaaataataaataatagctgattagggtaatcatttatttaatcagaataaagattatatccataaaatttacttgcagagaagtactttctttttgttttaaagacagggtctcactctgtcacccaagctatggtgcagtggcacaatcacagctcactgcagcctggacctcctggcctcaaggggatgatcctcctacttcaggaattatgccaccatgcccggctagttgagaagtactttcaaatagcaacatgaagcctttcctttaccatttgaaaataaaacatagttgtaaacataaaccagtatgtctttgtaaagccaataatatatcattttataggagcattgtcttcttgtgtttttcaagttgactatgtagttcaatgtcagtctccattttaatatcttgtttgtttatcagcctgagcatatttcattttaaaatgtatttgttgagaagtcatggtggttttttgtttttcacaagtcaagtagcttgaacactatcacttgtccaatgggaaagttgatgcttatctttatggcaaatgcttggttgaataatatatttgcaaagatgttaattctacagagagctaaataaagttaagatacctgtaaaacagtttctccagatgactttaaaataagccttatttttgtaaatttatgttaaattttaggtgttaagttgtgaaatacctaatgatgtgggcctaaatttgcctcattcagactgagacagggctgttaaaattcatttctagctaataaactgtgctataacttc

SEQ ID NO: 36930 - DNA, 2415 bp, Homo sapiens
ggattacaggcatgcaccacaatgcccagctaattattgtatttttaatagagacgaggttttgctatgttgtccaggttggtctcgaactcctggcctcaattgatccgcctgccttggtctttcaaagtgctaggattataggcacgagccactgcacctggcctcaaaaatcatttttaaaagaagcagtatattagctctgggtcttctcatgactaaaatgactatttttaaacataagaccatattttataaatgtacagataattcaaatctattatctaatgtattaggttaatttctatttgttctatacttttttttttttttttttttgagatggagtcttgctctgtcgcccaggctggagtgcagtggtgcaatcttggctcactgcaagctccgcctcctgggttcatgccattctcctgcctcggccttccaagtagctgggactacaggtgcccgccccgacacctggctaatttttaaaaaaatatttttagtagagacagggtttcaccgtgttagccaggatggtctcgatctcctgacctcgtgatccgcccgctttggcctcccaaagtgctgggattacaggcgtgagccaccgcacccggcctattgacattttttaaggtttcagattttcttttgtgtgtctagtaattcgtcttttattgtcaaagataatttgcttatttgacttagaaaaatgatttgtgggcatacaatattgtatgtggtacctaaacgttgccatttagttactcttacagaacaactttcattacactgtatattaatataaattacttcttgagtaatcccagaattgtagaaccaattggtagaatcagaaactgtctttggacttgaggtttttcttcccttagggtaaattttaggttttctggttagtttccaggagttggcggacaagttcatatcactaaaggtgttcatatcactaaaatagtaatgctaatttgtttcatatttctattttaaaaagcaatcaataaagacatttcaatacatttcatttggaagcccccaagtgtatggtggttaataaggctcagcatgctggtaacccaccattctcttagctagtgactccactaaatagtgctagccgctgagatggttttgaccctttaacagcctttttttttttttgagacagagtttcactcttgttatccaggctggggtgcaatggtgcgatatctcggctcactgcaaccactgcctcccaggttcaagcgattctcctgcctcagcctgccaagtagctggattacaggcacgtgccatcacgcccagctaatttttgtatttttggtagagacggggtttccccacgttgaccaggctggtctcgaactcctcacctcaagtgatccacccgcctcggcctcccaaagtgctgggattacaggcgtgagccaccgcgactggcctacacagcttttaattgcttgatttatactttattaaagagaggaagcacaatgagcagtgatactaaaatataactaatatggcatgtgaaagtgatcattattcagatgatcttcaccaacactgcatttgcatatatctgaccaaactttatgcgacataggcaggtctctggcacttcaaaaatgaatgttaaatagaaaataataaataatagctgattagggtaatcatttatttaatcagaataaagattatatccatctgtcacccaagctatggtgcagtggcacaatcacagctcactgcagcctggacctcctggcctcaaggggatgatcctcctacttcaggaattatgccaccatgcccggctagttgagaagtactttcaaatagcaacatgaagcctttcctttaccatttgaaaataaaacatagttgtaaacataaaccagtatgtctttgtaaagccaataatatatcattttataggagcattgtcttcttgtgtttttcaagttgactatgtagttcaatgtcagtctccattttaatatcttgtttgtttatcagcctgagcatatttcattttaaaatgtatttgttgagaagtcatggtggttttttgtttttcacaagtcaagtagcttgaacactatcacttgtccaatgggaaagttgatgcttatctttatggcaaatgcttggttgaataatatatttgcaaagatgttaattctacagagagctaaataaagttaagatacctgtaaaacagtttctccagatgactttaaaataagccttatttttgtaaatttatgttaaattttaggtgttaagttgtgaaatacctaatgatgtgggcctaaatttgcctcattcagactgagacagggctgttaaaattcatttctagctaataaactgtgctataacttc

SEQ ID NO: 36931 - DNA, 1241 bp, Homo sapiens
ggacgcgtgggtcgacccacgcgtccgcacagagcctgccgctctgtcagactcacctttgtcttctctgtgagaaggaccaggctcctgatttttggctgatttttcagtcaagcccagatggaaaattctagaaagggaggaggcttcatttggatttttaatttctgctgcaatctcagaatcctgggtcccttttgggacctaagccccatctcctggcaggattttctatcaccggaatacagtagattttccctccttttttttttttttccccagcaccttaactctcagcttcccagactttctccaatgacagagctgggtgggtggaggaggagaggggttgcaagaaagcttgccggctggggtgaggagactgtgtgtggagcaggcgtgagcgtgggccgcgtgggagagaatgcgaggctgccgtcaagcccagcgtccacacgaggaggcctgcgagggcgtctgagggagcaaggtaaaggtgagggccggagctcaagaggaagcctcagcgaggaccaggaaccgggacacacctcagccatcctgtgaggggcagcccactggagacttccagccgccctggaggtccttgcacccaagaactttcacctaccccaggagagaagcagaaaggcacttcgccactgtctccatcagtgctgttgaactcaaatactgccatgggtggaggccagcagggcagcgtgtccctagcaagacagcgactgggcaacgcacctgtgccaaaccctgccagaagcccagcacgtccaaggtgatcctgagggctgtggcggacaaggggacctgcaagtatgtgtccctggccaccctgaagaaggctgtttccaccacgggctacgacatggcccgaaatgcctatcacttcaagcgtgtgctcaaggggctggtggacaagggctcagcaggtgaccggcaggggggcctcaggctccttcaccctgggcaagaagcaggcctccaagtccaagctcaaggtcaagaggcaacgacagcagaggtggcgctctgggcagcgcccctttggacagcacaggtcactactgggctccaaacaggggcacaagcggcttatcaagggggttcgaagggtggccaagtgccactgcaattaatgaggcaggccaggcaagcagtcaggggtgccaagaccgccattggctcagtgcagtgggaataaaaggaacataacttatttcaca

SEQ ID NO: 36932 - DNA, 1282 bp, Homo sapiens
tcacagccgccctaaatacagccacccagacccgctccccgagaccctcactatctcctgcagggtgtcacagagcctgccgctctgtcagactcacctttgtcttctctgtgagaaggaccaggctcctgatttttggctgatttttcagtcaagcccagatggaaaattctagaaagggaggaggcttcatttggatttttaatttctgctgcaatctcagaatcctgggtcccttttgggacctaagccccatctcctggcaggattttctatcaccggaatacagtagattttccctccttttttttttttttccccagcaccttaactctcagcttcccagactttctccaatgacagagctgggtgggtggaggaggagaggggttgcaagaaagcttgccggctggggtgaggagactgtgtgtggagcaggcgtgagcgtgggccgcgtgggagagaatgcgaggctgccgtcaagcccagcgtccacacgaggaggcctgcgagggcgtctgagggagcaaggtaaaggtgagggccggagctcaagaggaagcctcagcgaggaccaggaaccgggacacacctcagccatcctgtgaggggcagcccactggagacttccagccgccctggaggtccttgcacccaagaactttcacctaccccaggagagaagcagaaaggcacttcgccactgtctccatcagtgctgttgaactcaaatactgccatgggtggaggccagcagggcagcgtgtccctagcaagacagcgactgggcaacgcacctgtgccaaaccctgccagaagcccagcacgtccaaggtgatcctgagggctgtggcggacaaggggacctgcaagtatgtgtccctggccaccctgaagaaggctgtttccaccacgggctacgacatggcccgaaatgcctatcacttcaagcgtgtgctcaaggggctggtggacaagggctcagcaggtgaccggcaggggggcctcaggctccttcaccctgggcaagaagcaggcctccaagtccaagctcaaggtcaagaggcaacgacagcagaggtggcgctctgggcagcgcccctttggacagcacaggtcactactgggctccaaacaggggcacaagcggcttatcaagggggttcgaagggtggccaagtgccactgcaattaatgaggcaggccaggcaagcagtcaggggtgccaagaccgccattggctcagtgcagtgggaataaaaggaacataacttatttcaca

SEQ ID NO: 36933 - DNA, 655 bp, Homo sapiens
caagagggggacatagctgttctctgaggaacagctactccgtcttgcaaaattccaatcttcaggggtttagtttttgttttagttttttatagactttatatagagtagttttagattcacagcaaaactgagcagaggtacagaaatttcccatgtgcctcctgccctcacacatgcacgacctccccgttatcaacatcgtccaccacagtggtgtatttgttatgactgatgaacctaccttgcacatcattatcacctgagtccatagtttatgttagggcttcctcttggtgttgtggtattggggggttagttttcagtcctatttctttctttttaaaaaattgtgggccagtcacaatggctcacgcctgtaatcccagcattttggggggccgaagcgggcggatcacgaggtcaggagatcgagaccctcctagctaacacgtgaaaccccgtctctactaaaaataccaaaaaaattagccgggcttggtggcgggtgcctgtagtcccagctacttgggaggctgaggcaggagaatggcgtgaacccgggaggcagagcttgcagtgagccgagatcgcaccactgcactccagcctgggcgacagagcgagactgtgtctaaaaaaaaaaaaattgcgg

SEQ ID NO: 36934 - DNA, 654 bp, Homo sapiens
cctccaggctgggcagagctgtctactttcccttgctatctgaggggaagttttattaggctgtcgactgtcttttctgaactatggcttatggtaaagtcccattatcagaccatctgacttggcactttaaaggaagattttaaaatttagaagtctttccacaaagcctctagcaactcaagagggttagcatggacccccaaggctgagcagcggcccatcgtccaggtggcgtccccttccacagggagaagtgggtctgtggctgggaaaccatagcatggcatgccttacaagggaaagagggaacagtggtttaagacgctcattggtgatacccctggcctacttatggaacatatgccccattacacacatacccctgtgtaatgggacttcccattttatacttaggggtgtatatttaaataagtgaggggggcatacaacaaatgaaagtactcttttctgaatgctgagaatatgcatgattttcactttttcttttactcatacacattttctgactttctacaaccagtatgttaccttaggatagaaataaaaaaataaaattggtaacattatatgttatataaaattttaattaaaatatatattcattaaatatatctaaaaagaaaaaaaaaa

SEQ ID NO: 36935 - DNA, 806 bp, Homo sapiens
aggctggagtgcagtggcatgatcttggctcacttcaagctccacctcccgggttcacaccattctcctgcctcagcctcccgagtagctgggactacaggtgcccgccatcacgcctggctaattttttgtatttttagtagagacggggtttcaccatgttagccaggatggtctcgatctcctgacctcgtgatccatccgcctcggcctcccaaagtgctgggattacaagcttgagccaccgctcccagctgttttaaataacgtaaaataacagtgctgagcagtaagaaaatgagatccagcccttgtaacacacccgacaaagcctctccaattgggcttttactttcctctccagtcttcttctcacaactcactcctgcctcttgctccagacattcctttttttcccccaagttcttcaaatatatctggttctctttaactccaggctatgacacaagtgattacctctgtttgaaatgatgtctcaattcctcctctaccaactatgcctgggccattctcccttcaggtctcgacagaaatctcagttcctcaggccaggcactgtggctcacttgaggtcaggagttcgagactagcctggccaacatggtgaaaccctgtgtttactaaaaatacaaaattagccaggtgtggtggcgttcacctgtaatcctagctacttgggaggctgaggcaggagaatcgcttgaacccaggaggcagagtttgcagtgacccgagatcgtgccattgtactccagcctgggcaacacgagcgaaactctgtctca

SEQ ID NO: 36936 - DNA, 323 bp, Homo sapiens
atagacaggtagagatttgatggttttcagaaatcctggctggactgttaggagtcgtgttatagacaattcaaatgtcactgctggccaccgtcttcatactctatggataaaacagaaattccagtcctgtaacttacctctgtagcgtcaataacgtgggaaatgatccaaaagggtcttgtagaaagaagactttttacataaacagaaagctgtgatttttgtgggaaacaaacctaccactaaaattgatgagaattcttgtctccatgtgtaatttctggctcatcagccaggaggtaaaatttcaataagaatca

SEQ ID NO: 36937 - DNA, 312 bp, Homo sapiens
catctggtgaactaactgaataccatgaaatgcaaggacatttagccttgtttaaacataagttttccacattccataccctctcaaactctgcttttcacttagcatttagagctggggaaatgaattcaagtaggagaggaggagtcttataagtccgaggtagcctgaggcgtgtcctcccataaagaagtaaagaaactataacatgaaggcttccaaaagaacatccaaattgagacttttttttttttaaatgaaaaggggaacattactcatatgctggaataataggcataaaccagggcatct

SEQ ID NO: 36938 - DNA, 1126 bp, Homo sapiens
gagatttatagtccaccaaatgagctctattggtttacagctgggaattggccataaaaacttcataatatcttttaaaaaaatattttctatctgattccacagagatattttggtctgcagcctttattttctgctcctttcttttctgcttttctactgagtagcttgtgaatttactttcacttacatttcttgctatgagttttctgattagaaatgtaaagccataagattttaaatttaagtggttagaaaaagcagtgtacaaaattgacagaggttataaatgttgtgaacaagaagagaagtatatattcacagaaagaaacctggacagatcataatgtttgcagtgattattcctgagtggtgggagcatggatgattttcagtttctttgtattttggttattttcaaatgttcagcaatgagctcaattacttttacataattacagaatatttggagtcaaacattcacctatttcccttttactaaaacttattggaattaacatcatttgatatagtgactatttctgagttaagaaaacataattaagaccgcaaaattacaataattattaagccactggcttattccatagcactgtataaacacagcatagaataagaagatgaagatcccagaatgtggaaacaaaaagctgacaagtgattgaggaatggtgagaagacacaggttctgaggactgctggacagcctttcctgtttttaaagaaaagctctcttatcatgagagaagagtcatgaaaaccaaaaggtttctgcatttaattcgttatttagagggctgaatttatgctttgacttactctttgattacaagcactggtggttatattttatctattttgtggaaatgagttagcacatgtagaaaactgccctgaaaggggctgaaatgaagccattaagaccgaagtgtactttttaaaactccaaacgtcatgatttatttcttgatcttggtgatacttatatgggtgtgttcactttgtaaacattcatcaaactctatacttaccacttgtgtacttttctgtatgtgtgttatacttcaattaaaaagtttacttgaaagaaaaaatcccaccacag

SEQ ID NO: 36939 - DNA, 547 bp, Homo sapiens
gcagattccagttaacactagcagcctttgtgtcacttggtatagcggctggaacaatattcttagctatggaatgtgttgcttccaaaacccagggtcctaccaagacactgcctctgtgatcttcacttcaaaggagttattctagtattcccctaagcactgaacctgcaaaagctttccctaagtgtccaaattcccaaatcttaatatggtttatctcataccccctgtagcacatgtgctttaccaagatctccaatattctagtaacaacttgtgtaacttgctctgtcattatgatgttatcaatgtaataaatcagtatgatgttttgagaaatgcttaggtggacaatatcttcattctatatttccttgggcaggaaaactaacatagtcttgagacataattgaaagtgaatacagtatcgttcatctcacatgaatgtaagtcatttctgatcctcttttctaaccgcaacagaaaataattcattccccaaatcactgactgtatcatatactggagaccttttaaatgattc

SEQ ID NO: 36940 - DNA, 364 bp, Homo sapiens
gttttgtttaatccttaaccactctgtgaactaggtgttattaactccattttagagatgataaaactataaatgagtggcttacttttgcttgtttaattaatctaaactctgctctgtcattcaatgctcccaccatttggctttagctcatgctgctagttcatgttatactgtatttccttactctatgctatagccaccccagacatgctcttcatatcttatcactgtgcccctgttccagataaatccttatcctggcatttctctgcttcccactttgcctgtaaaaatcaagccaggtttggtggttcatgcctataatctcagctacttggttgagacaggaggatcgcttgag

SEQ ID NO: 36941 - DNA, 632 bp, Homo sapiens
tagtggattactatgtgaaaagtatgtggacgtgtgtgtgcagtgtttatttggcagcaattttatcaggaacataatctaaactcagctttttaaccagaaaaatcagtaattcaaatagtatattttaaactagtaaccatcccctcctcatttccaataatgtgtttattacctagactcagaaatactttgatttatttcacatgtggtttatgggaatcagtatcttcgatgtaggattgttcaaggtttgcatcttttgcctgctttaccgttcctgaggatcctctttcacttctggaaatcagtagatacagttttcccaatctctcttctgaatgataaagcaagaatataaattatagcttttatatttttaccttttttatgtgaaggtagatgattgctagtgcttatgtagtttgatggaatgctaataaaaataaagagtgtcttcgataagttttcatctatattgttaaaattaaaacaagccctttagttatttggtttctggtttaagagttgtggatgtaacaatatagaatcattaacattaggggagacaagagaaaaaaaattaataaattttaccgcatatcatttgtaggacagataacaaaaatctt

SEQ ID NO: 36942 - DNA, 331 bp, Homo sapiens
aataatcttttaaggtactttagtattatcagccccattttatagatagaccctaaggctttgaggtgcaacttgccccaagtcatacaagcattcctagcagggctaggattagaattgggttgtgtaggccgggcgcggtggctcatgcctgtaatctcagcattttgggaggccgaggcgggtggatcacaaggtcaagagatcgagaccatcctggccaacatgatgaaaccacttctctactaaaaatacaaacattagctgggcgtggtggcacacgcctgtagtccagctactcaggaggctgaggcaggataatcgcttgaac

SEQ ID NO: 36943 - DNA, 422 bp, Homo sapiens
gtttgtggaaacctgatctactaaggttgatataatcaggctatttacaagttcactgtgggtcagacaacagtatttatattcatgcacacagaaaattcgattagatagtgccgaggaagagcacacaccgatgggccgattaccctgaattcaggcagctcagattctccattcgcttgaatgtcatattagctggggatatcccttttgtgacgcagaatcttgcagcgaaacagttgggtgtagcctcctgtgagaaagaaatgcttgcagcagggattttccaggccggcatctcaattgcacagaaaaacattttgggaatgtttccatcagcccggcagtctgaaggtttgagcggaatggtgagaaggttctaaccaggcgtccttgggggtggaggatgatgggccagggca

SEQ ID NO: 36944 - DNA, 939 bp, Homo sapiens
aagccttccctggccttcccctcctcccagggccttctccctgtccttcccctccagtaacctgtgaacttcccgtctcctcccattccagccttctgtgccctccagcctcagggatccttgttattgggacagcccagctggggttgacccacaggatggggcttaggagagctctgaggagtgagtgaacagacagcgccggagtgcacggtgggccggctctgctgatctacaccaggaactgaaatatcactggaatttattgtaaacggtgtgcctatgatgctggttctgttgccacctgggcacgcagcaccctcaagtggacatttctagaaaccgcttcttacttgctcctaattgattacttttgcacattgcacagaacccaacctcgaggcctgctccctgccagttgcctgaaatcagccctgaaattctgaaaccaaagagctgcttcctgagaacaagttatttaccttagaattgaaaatgtatatccttttatgggcctttccaaatctgattagaaaaaccacaaaaggaaacagaagagaaaataagagccacagaaagtacaatatgttttattaacaggaaagccagaaataagatattttaaacatatttttaatgagactttattgctatattccaacaggtcactcctattcttagagaatgtgaatgacttgtgtcacttcggagtgacagaaaaatcaggaactgaaagataattccagacaagttaaaatgttatgttacattcaaagctcttgttttcatcacaaataaggggatattcagtttttattaacagaaaacccattctcccatggccatggaataaatgccatgctatatttaaggagtttggtttgaagggtgcaaaattgtgagcctcctggctcttatgtctgtatccagccctgaata

SEQ ID NO: 36945 - DNA, 622 bp, Homo sapiens
gaacgccgtggtccctgggacggccaccaggccaggaggctgcagcaccagggaatctgtgctcacgtcttccaggacagtgcttcttctagaagctgacatggagctgaccacagctcttggaggcatggcctgaggcttagaaaatagacagagatcatctgagatttcagcagtggggccacgtggcagcgcccgaaggcctggagcaggagcgacccagggactcagagcagcatcttcttaggagacggaaggagagccgccggaggagcacggggcacctgcgatcgcgaagagcctcctgttctggatgggagcgaaggctccgagaggacctaaggttgctcagtgggccatggaaacggcagtgattggggtggtggtggtgctgttcgtggtgactgtggccatcacctgcgtcctctgctgcttcagctgtgactcaagggcccaggatcctcaggggggtcctggccgcagcttcacggtggccacgtttcgccaggaagcttctctcttcacggggcctgttcgccatgcccagccagtgccaagtgcccaggacttctggaccttcatgtgacgcccgagtccccaggatttgctgtgctgatgggtc

SEQ ID NO: 36946 - DNA, 834 bp, Homo sapiens
cgtcaccggagggccagcgctggctaggctgtctctgtgcaacgtcttctgacccctcctctccaccttctctgtgtccagggaatctgtgctcacgtcttccaggacagtgcttcttctagaagctgacatggagctgaccacagctcttggaggcatggcctgaggcttagaaaatagacagagatcatctgagatttcagcagtggggccacgtggcagcgcccgaaggcctggagcaggagcgacccagggactcagagcagcatcttcttaggagacggaaggagagccgccggaggagcacggggcacctgcgatcgcgaagagcctcctgttctggatgggagcgaaggctccgagaggacctaaggttgctcagtgggccatggaaacggcagtgattggggtggtggtggtgctgttcgtggtgactgtggccatcacctgcgtcctctgctgcttcagctgtgactcaagggcccaggatcctcaggggggtcctggccgcagcttcacggtggccacgtttcgccaggaagcttctctcttcacggggcctgttcgccatgcccagccagtgccaagtgcccaggacttctggaccttcatgtgacgcccgagtccccaggatttgctgtgctgatgggtcagactcacccgctcctcagcaagccttccctggccttcccctcctcccagggccttctccctgtccttcccctccagtaacctgtgaacttcccgtctcctcccattccagccttctgtgccctccagcctcagggatccttgttattgggacagcccagctggggttgacccacaggatgg

SEQ ID NO: 36947 - DNA, 108 bp, Homo sapiens
tcttacggcaggcagcagtggcgggagaaggtggaagatcctcaatgtgctggaaaatcaccaacctagcaccctgtgttgttcaagagtacaaataaaataaaaagg

SEQ ID NO: 36948 - DNA, 1023 bp, Homo sapiens
gaggattgatttgccctgacttgtatcttcatgtgtggtctataaggtctgccagattggcttatagtcacaaccagcatgtcctaagcaaaatgaaactatatgaacaaaaatcagctctcatttcactgctagactttggtgttttctttaagaagtagccttgttaatgcttagttttgccttgggggccttaatgtgtcattaactgcctggaaatacctttcatttaaaaaagtatactttagtacctaatgttcaatttagtatcgatctggatattttagcaaattttgacttttcaaagacaaagtttctgtcttgtaatgtttcttgggccggctatactgcctttcatctaaaactcactacagttcactggggccgtttggtaacagggtaacctggggcataattaggtgcttgattgacaagagagttaccagtaccagaagtcaggttctattttaaccccatcatttccaattgattgtttttctctccaccattattcactgtctctcaagtgttagcactctgagttgttgaacggaggtttgtatgctgcgcagagccctgtcgcaatgccccagcaagcttcttgttggcatgtggccactctaaattgtgctccaggatctgctatgggtccatgcttgcaggagaaacagctgtgtagaatttcctattgcatttcatttgtgggtttagaactcggttgcttatttcatattgtctcccttttcagtccttcaaggtacatttttccaacttctctaatgaattattacatttctgagtagctgatatgtttttatcttatctaagcagtatatttataattccttctttgcattggctaatctgattagtagttcagaacccaattttcagattgtctatagcaaactgtgaagaactgtgctgtcaagtagaaatagaatataagccacatatgtaatttaaacttttctaataccacattaaaaactataaaaggggaggaaatggaaaattagtaaa

SEQ ID NO: 36949 - DNA, 323 bp, Homo sapiens
ttatgatacagataaattaatgaacggaggctgccttgaggttgccaatagggcattggggagtaattaatatgacaaagatgtcatcttattaatgaaatgtattaatagtatgtctagtggattgggtcaatgcaaacattttagattagatatttgctgtttatcctctgaagttactgtttaaggaagtctggccaagttctaaagtgaagcatacatatttgcctcacgtgccatttttttttttcttcctggctttttcttagccatctggaaagctactatagggtttacctctaatggtagtcaagttactgtat

SEQ ID NO: 36950 - DNA, 401 bp, Homo sapiens
ggaaactacttacctacccagcatggaaggcagggaggaagttagtctcttttcatcaagattcaagagtacaggggcaatttattacactgcaatgtacaaaacaaaaggacctgtttctgttagagagtccatgttgaatatacaggtatgagaacaactgttgatatacaggtataatccaagtagaatgcttccacagtgcattagaaggtgcccaagctccacagggccaataatattagagtatatgtcatatagaataaggttaattaggagggtgattgtgaataatgagatttttaatttttttaagaaaaagctctcaaatgctaggctaataagttcatgattttaattcatgattttaattcatgattaaaattatttgattattgagt

SEQ ID NO: 36951 - DNA, 349 bp, Homo sapiens
tatgtcttggatgtaggaagaaaacaagtgaaaatatgttattttacaaccttgatacttctgacctcatggaaaaaacatacacacacagcgtagggtgagcaggtaggcaggaggaagggtcctagcacggggtgcgggcgccctcgcgtggccatgagaagtagtgccacacgcacacgttctctttcccagagaagcagacgtgctgcacaagtgcttggccaccgcctacactgaaactggaaagagctcactgaaaaggaatgcagttcataaaaagtcttccttctctacccaagacattcttgtcactcctagggctgtcattcttgaaaaggagaggctg

SEQ ID NO: 36952 - DNA, 429 bp, Homo sapiens
ttttaatctctgtttaagtgggtctactttgagtggtctttcttcagaatcaattatcatgggttaaggagttcttccattacctttgatgcctctgtcaggcactccaataactgcttgttcaacaaactaccggaagtccacgacggggactcaatacaagtattttaggctactcttttgtgccttattgacttactggactgggagtcctctacattaagccacattacattctaaacgccactgaagccctagatccattctggggatgggagacaccattacattaagaaatttcttttctgaacgaattccattccacagaggactaacgattaagcctaaaatcttaagattccatgatttgtgtacaaaacactgtgctcattgcggtagaggaggggaagtggagccacacagaggttt

SEQ ID NO: 36953 - DNA, 528 bp, Homo sapiens
gctgataaacaacttcagcaaagtctcaagatacaaaattgatgtgcaaaaatcactaacattcctatacaccagcaacattcaagctgagagccaaatcaggaacacaatcccattcacaacacacacacacacacacacacacacacaaactgtagtttgtgacagagcaataacacctgaccctcacccaggagtcaagctcatgtaagtcctgctgatatggttaggttttttgcccccacccaaatctcatcttgagttgtaatccccataatccccacgtgttgagggtgggactttgtgggaggtgattggatcatgggggccgtttcccccatgctgttcttgtgatagtgagtgagttttcatgaaatctgatggttttataagtgtttgtcatttccttctacacacttttctctcacctgccgccatgtaagatatgcctgcttccccttctggcatgattgtaagtttcctgagacctccccagccaagcagaattgtgagtcaattaaacctctt

SEQ ID NO: 36954 - DNA, 361 bp, Homo sapiens
gttcatattcctaaggactggaaaagaacaaatatgcacgtatttaaaaggtaaaaaagatgccccttcaaatagtagattggtcattttagcattgtcatttaaaatatatattaggaaaaaaatgatctaacagccgttttaaaacatacagatgcatagaatcatgaatattaattaatgtggatttgaaaacagcatatcattagccaggctcagtgacatgtgcctgtaatcccagctgctcgggaggctgaggcaggagaattgcttgaacccgggaagcggaggttgcagtgagccaagatcacaccactgcactccagcctgggtgacatctgtctcttaaaaaaaaaaaaaa

SEQ ID NO: 36955 - DNA, 452 bp, Homo sapiens
ttataggcttgttgcaagaattaaacgaaaggtataggtaaggttccgagctagcaggaagtagtaggtaccaaccaatagcagtgtccgttttcttcttctcatctgtctcctctcaacctctcccttcccttccctcttccccgctgccccctactgacagagtggtggtagagataaaagtatctaaaatccaaggccgagtgtggtcagttcctttagaatgtcgttttctggttcttccaccagaggctgggacaaacctgacagcagtgtagggtccctgtgaccctttgttgttacctaagctggccaaagaggatggccaggaggcaaatggcagcttggagcccaagagaggtacctatggtgtagaataaggtttgggtacaaggggtaagggagaagctattttaagaagaagtcaagaactcaggtctcatggaagttgg

SEQ ID NO: 36956 - DNA, 542 bp, Homo sapiens
acatacaagtgagcaaggccatcatcgatggcctcagccccctgggtgggcaggcagggcgggggcctcctgccaagatcagcctcctccatttacagcagtgcaccacacttataattttctatgtggaaaggctggatgcactaagctagagatgtatgactgaaaccgaatccaataaggtaatggctaaaactataaattggggtaaagactcaacatgtccttcacaattataaatggttcctcagagagtaaccctgtttcatatcttcagtatgttaaggtgagaggtaattataaagtaaaggctgccctaattagaaagaatattccatctttttttactcagaaaatgacatattaaattcaaatgtgaaggatgttaataacaaatctgcaaaaaccatctcaccagttaaatactgatcatttggtttaaaaatgcacacacatccgggaggcagaggttgcagtgagtcaagatcacaccactgcactgcagcctggcgacagaacgagactccgtctcaaaaaaaaaa

SEQ ID NO: 36957 - DNA, 579 bp, Homo sapiens
gcatattggggctggtttaatgatgtgtgtaaatcactttgcttcagttttttatattgtggcttataaacatggtacctcatgaatatttttagtcacctctagaggaaagctgaatgcttgcccaagctattggataatttgaattacataggaatgttaggccagagtattaattaaatgtgatcctctaaaattatttaagtgttctaggctcagcatggtggctcacacctgtaatcctagcactttaggaggctaaggcaggaggatcacctgaggcaaaaagttcaagaccagcctggacaacatagcaagaccttgtctatataaaagctttaaaaattagtagtacatggtggtgcacctgccttgctactcaggaagctgaggcgggaagatcactggggctcaggagtttgagggtgcaatgaattatgattgagccactgtactccagtctggggaacagagtgagaccctgtctctaaaaataaaataaaattataagcattctacagtgttcactaaactgccttggaatcagatgttaaaacatttcattttcttttatttatt

SEQ ID NO: 36958 - DNA, 1315 bp, Homo sapiens
tttgttcatttaacttgttttttggctccccacagaaagcaatatttttaaaatctagtttaaagacagtatggcagtttggttcctgttctttagggtaaaaagtaacttggccaggtgcggtggctcacacctggtgaaaccccgtctctattaaaaatacaaaaaattagctgggcacggtggtggtaccaattgttcacaactccattttcttattgaacaattgcaactacatctctctgtgagtatttttaaataaacttattttggacagtatgagctttgggaagggaatttatgtatatgactttaaaagattttccttattgttttcagatttcaatgttaacaaatagtttttttttaaagctatattttcagtgatggctttaatgtcagtgagaaaccaaaccctatatggttctcataagcaatctaaaccgtagaaatttatgagacttaaatgcatctttttattttattcttagaaatttgattttggtcttgaagtggcaggtccaaaatacaaaaacaaagattagaaaaaagaaattaaaaaaaagaaatttaattttgggctcttggcctttctatagtctcttcaaataatttcatgagcctggtgattgtgtttctcagttacgtggttaagctatacattgagttcagtattttgtcatcttcctctgtgctgatacttacttcttgatatgaacaattgagtttactggtggctgtagtttcttttcagcaaccctcgacccctgccacgtgtgcagaatgtagtgaagccaagtttgaggtttggatctagagccctccaacaatccctgcgatgtgccctccaacctgggggatagatcttcctggccctggagaaacccagttgagaattcataggattgttgtgctctcagcaagtgctttagtcttgtcctctggcagatgttttctttactgggcgtgaaaaccccatcaaaataatgctaagggaactgaaatatagagaaatacaaataagcaaagaagaagaaatattcaaaatgttcaggatggccaaagcaatagacttaaggatgatctagaagagagagaaatctagctgacttgtgttttctcacatccttctacatcttgagaagaagttttagcaaataaccctaaagtagtttttttttttaaattttaattataagctgtacttggtggctgatgtctataatcccagcactttggaggctgaggtgggaagatcacttgaggccaggaatttgagattagtgtgggcaacatagtaagactttgtctctac

SEQ ID NO: 36959 - DNA, 376 bp, Homo sapiens
tttggcctggagttctctctgcccagctctgcttctggctagctcttttccaaatgtcttgttttataacagaatttatctaattagtgtaaccttctttgatagcttcaggcaaatttaggagcttttccttctatgtcccttttatattttcagggtaccttatagcacttagcatagattgttacgatttttctggtatgtcgtctttctcattagacagtaagcatcttaatgacactaactgaatcttcttgtctttaaatcaacaatgtcatacagtccctgtcacatagtaaactctcatacaacaggtgtttaaagggtgaaccaataaatgagaggacatttgatttaaagccttcttcttgtcact

SEQ ID NO: 36960 - DNA, 375 bp, Homo sapiens
cctacacccagcttcgtaagaccagcttcataagaccacagccccacctttgccaagaattaatgtcaacatgggataatagactgggtacaaactgtgaccccacaagatgtttaaagcatcccccactgactttattggcgggtctttgcctcccttatgggcattgtgcctgggaaggaggaaaggtggccgcttgtgtactgccctccactgctcctcctttcccctttgtgcggttgatgattaaccctcaaaagctgagtggctgggcgcggtggctcacgcctataatcccagccctttgggaggccgaggcacgaggatcccttgagttcaggagttagagaccagcttggccaacatagtgagacc

SEQ ID NO: 36961 - DNA, 370 bp, Homo sapiens
ttttttttgcctccatattacaactcaatgaacttgcattagtagatatattttggatttttctaaaagtataagggtttttaaattatcaatgaaaagctgattaaatgaaagtggaattaatataaaatgttaattatttaaaaactgcagtaagacgagatcatggcatgttttaaatatacataaatattttcatatatagattgaagacaatctatatatgcactaatggtctttttctctgtgtctgtgggtctaattttgaatattgttaaggccctgcttggatgtcaacgtatccaagtagctttcaatgtttttctcccaaattaccaagcatattaatgtttctcatattgaattatat

SEQ ID NO: 36962 - DNA, 796 bp, Homo sapiens
tggggttttagcactcagaagtgtatctggttttagctgagcaaatgagcctcaaacacctgccaaacggatggatgacacattcaagtggctaggcaaaggctaagacaaactcagctagcaggaaagaatacaacaaggaaagtaatggagtaagaatagcaggtgttatctcaaaatattgctcaatttgcatgttgttaagtcatggtttactttttgaattcggtgtctttaattactactgctgtgtatgttttgtatactatttctgatctgcctccatccatttaggttgtcatattggttcatccaaaaataatacatgctggttcaatctaaattctgttttaaattatagattctatcctccaagtataataagccatgcagtataaagttgtctatttgtttttattagatggaagtaaatgactcttaaagagattacttataaaatcatctgcctttagtcccagttccaaaatcaacaataaaatacttgggtattcttgagctatttgtcatgcctagacactgctttggactttgacagctccatctagtggaagggaaactacaccagagaaagcacttcacacagagctaaatgggcatagggatgtcctgaaatgcaggaggggactccaggttggatgcacaaaatgtaaccactggccaggcctggtggtgtacacctatagttcgagctacgtgggaggccaaggtgggagggttgcttgaacccagaagttcaaggccagcctggagaacatagacctgtcccaaaaaaaaa

SEQ ID NO: 36963 - DNA, 644 bp, Homo sapiens
aaaaaatctatatacatgtacacacatacgtctgtatgtatatatatatacatctatatatgtcaggtactgtgctaagcattttacataccatttgttcttgcaacgattctgtgaaatagatacccttattgtccctaattctacagagaagagaaattgagccaaataaccagtaagtggcaaaaccccacctctcaaatgctatatatgtaaatctgtttagatcgtctaatctggcctgttaggttttctgctaataaaagaccagtgttgaaagagaaaccatgctcaatatttgttcctgagactggacagtaaaattaaaaagacaggtagagaaatactgagatgatacttctctgggacatgtacattactcagtaaaaattaagcatttatgtttgaaatactaataaagtcaacgcatgacttttgaatgctttttctgtgtcaggctgtttcaggcctggggatatagcagtgaataagacactgtccctgttctcttatagtttatgtgtagcagggagaaacagataaacaagtgaacatccgcaacaaggaacaacagaaaatttaaatcagttaatttgactgtgtgtgtgcttactttattgggttatcaaagtgatatttaggct

SEQ ID NO: 36964 - DNA, 496 bp, Homo sapiens
ctggtagagggaaggaaagttaaccaaatgcatatcagactcagccacagtcagggaagcaatgtatctgagaagaggagagagtagcttgtgtgcagcacacattcccggattattctctaccttctgtaccatggtgagtcactggggcttgatctcagtacccttctcctcctatagcacagcttagaagtgatgctatgaaaggaatgggaaggaaatgtctgtagctggtattattctggatcccagacagatcttcgttcgagcttatcaatgtgtcaaaccagggtgcactgagtctgcaagttagaatgctcagagaaaaccacagccacctctgtgtatggctgctgagccagtacccttcccaacatgtgaggcactactcagtccacaagccaaggagagttcctctggcttgaaatctgcactatccatctaataatgcctcatgagggagcaccaactagctgtccctaaccctaaaacaagt

SEQ ID NO: 36965 - DNA, 936 bp, Homo sapiens
  misc_feature (52)..(52): n is a, c, g, or t
tggagtcatgtgcgcctttattagctgagccattacttgagagggatgaagngggaggactgtgtgagcccagaagtttgaggccagcctgggctggtttaattaaattagctgggcatggtggcacacgcctgtggtctcagcgacttgggcggctgaggtagaaggattgtttgagcctgggtggttgaggctacagtgagctatgatcgcgccactgcattccatcctgggtgacagagcaagactctctcaaaaaacaaacaaacaaacctatacgaacaatggtaggaatgtcaaggaacccaggagtgaagatcggattagtcagatgctgtgagaggaggtggaaaaaaccagtgtagaatgggcaggcacctttgaaaaggctagaggaaaattttggaagggcattaaggaggagcatagcaaagaagtctagacctatgacttggagctgttctgttatataaataggatatccagagatagcaaactgctcactgcaggaaataggggaaatagaggataatttggaagaacaccccactgttattatttgtggcagttatgttctataaagtcgctgtggacataattagtgaatactgagccattgctcctaggggaacaatacagagttagattcctgtgagcctctggttataacgattttgtcagctgtcaaccgatcaatacatagccttgttttgcatgtgtttctgtttaaagataccttgtttaatatacattgttgattcattaacattgacctcatggcgaagagcactgtatctcatgcctaaatgaagcttagccaatgcgtctcttcttcctaaggcacatcatggccttgttgtgattaagaacattagacgacactaaggcatgatgtttggggctcattttaaacagcaaaatcaccaagaaacccac

SEQ ID NO: 36966 - DNA, 773 bp, Homo sapiens
ttttttgttttgttgttgtgtgagacggatccggctgctgtggcccaggccggactgcattccatcctgggtgacagagcaagactctctcaaaaaacaaacaaacaaacctatacgaacaatggtaggaatgtcaaggaacccaggagtgaagatcggattagtcagatgctgtgagaggaggtggaaaaaaccagtgtagaatgggcaggcacctttgaaaaggctagaggaaaattttggaagggcattaaggaggagcatagcaaagaagtctagacctatgacttggagctgttctgttatataaataggatatccagagatagcaaactgctcactgcaggaaataggggaaatagaggataatttggaagaacaccccactgttattatttgtggcagttatgttctataaagtcgctgtggacataattagtgaatactgagccattgctcctaggggaacaatacagagttagattcctgtgagcctctggttataacgattttgtcagctgtcaaccgatcaatacatagccttgttttgcatgtgtttctgtttaaagataccttgtttaatatacattgttgattcattaacattgacctcatggcgaagagcactgtatctcatgcctaaatgaagcttagccaatgcgtctcttcttcctaaggcacatcatggccttgttgtgattaagaacattagacgacactaaggcatgatgtttggggctcattttaaacagcaaaatcaccaagaaacccac

SEQ ID NO: 36967 - DNA, 1635 bp, Homo sapiens
  misc_feature (751)..(751): n is a, c, g, or t
gctcatgcctgcaatcctagtactttgagaggccaaggcaggaggatcacatgagcctgagaggttgagcctgcagtgagatgaaattgcgccagtgcacttcagcctgtgtgacagagcaagaccatgtctcaaaaggaaaaaaaaaaaaaaaaaaaatttattcattagttataaatgcacactgatgttcttataagtgaaaagatatattgttttggttttgctttaagattccagcaaatataaaacagaaaaagagggaatatattaaaaaggctggcaaaatatgtatcattgttgaagcttagtgatgggtgcattgtattcaatatagtattctcttttgtgtatatttgaagtttttcatgatagaaggtttaaaaatttagaacaaaaatgaatgtggaggttcaggatcctaccagatgtttctaaatgaactttaagtgacaatggggaaaaatgtccatatcatcctggagtttaaggcagggaattcttggtagggggctattgaaaaatagccaaactgttagtcaaaaatgtacatatgatctcatggccacagatagtaatgtagaagacagatcacgaaagtactaatccttgggtgaggaagaacaggagaaggcagcccaagaacttaactgaggccccaagaactaaggaaatctgttttgtaaaaggacctgtacggccaggtgtggtggctgacacctgtaatcccagcactttgggaggctgaggngggaggactgtgtgagcccagaagtttgaggccagcctgggctggtttaattaaattagctgggcatggtggcacacgcctgtggtctcagcgacttgggcggctgaggtagaaggattgtttgagcctgggtggttgaggctacagtgagctatgatcgcgccactgcattccatcctgggtgacagagcaagactctctcaaaaaacaaacaaacaaacctatacgaacaatggtaggaatgtcaaggaacccaggagtgaagatcggattagtcagatgctgtgagaggaggtggaaaaaaccagtgtagaatgggcaggcacctttgaaaaggctagaggaaaattttggaagggcattaaggaggagcatagcaaagaagtctagacctatgacttggagctgttctgttatataaataggatatccagagatagcaaactgctcactgcaggaaataggggaaatagaggataatttggaagaacaccccactgttattatttgtggcagttatgttctataaagtcgctgtggacataattagtgaatactgagccattgctcctaggggaacaatacagagttagattcctgtgagcctctggttataacgattttgtcagctgtcaaccgatcaatacatagccttgttttgcatgtgtttctgtttaaagataccttgtttaatatacattgttgattcattaacattgacctcatggcgaagagcactgtatctcatgcctaaatgaagcttagccaatgcgtctcttcttcctaaggcacatcatggccttgttgtgattaagaacattagacgacactaaggcatgatgtttggggctcattttaaacagcaaaatcaccaagaaacccac

SEQ ID NO: 36968 - DNA, 824 bp, Homo sapiens
acatttaggcatctttctattatcagtctacacagacctgccttttcttgtatatggtttcagagtattattttgtatgtctctaaaatgcattaataaatcccctacagataaatatttagactatttttagtcttttgctattaaaaacaatgctgcagttaaaaatcttgcatttatttctttgcacaggtataatttctctgcatgttaaattccctagctgcataattataaagcttgtttacttaaaactgtgtctatccccctcaggaaaagatgggtttcactggaattacactcacaccatataggtgtgagaagtacttttagctctgactctgacaaatactgtgtacgtcaaaccttgtaatctttgccagtctatgaaaggaaaaaaataatatcttggcagtagttaaaagttctaggtctgtgataactttctccaattaattatttaactatcccaattaaattttttttactttcaaaactgtgtttcacaaattttatcaaagatggaagcagagtgaccagaaaagacatcactgggcaaactgacctggcttccataaactagtgagagtaaaaccagtgctatatctaagtaagtgcttagtagttgctacaataattttatatcatttgaaaatttttgtttattataaaaactgtataaaatacggtggtcagacattagtattcctatcatacaaattagactgaatatttggacaatgttctttttacttcttcgttattatgatcatcaatttaaagaacttcaataaagaaacttgaagtttcttatctaaatttta

SEQ ID NO: 36969 - DNA, 284 bp, Homo sapiens
aaaaaaaaaaagaggaaatttgaacgtacgaagaggcatcaaggatgcatgcacaaaaagaaagaccacgtgaggacaagggaggagacggccatctgcaagccaaggagagagtctcaaggagataacaaacctgctgcctttaattttgggcatctagcttccagaactgtgagaacatacatttctgttatttaagccatccagcctgtgatatttagttatggcagacctagcaaagtaatagacactccagaactttcatttctctcttctctagattt

SEQ ID NO: 36970 - DNA, 356 bp, Homo sapiens
  misc_feature (83)..(83): n is a, c, g, or t
cagacctctgtgatctctgggtgataccctgccccctaacagctggatcagttgacgagtgtgatgtgagcacccgtgggganatgggccagctttccgtctatgccaagatgagtggtgtttttgtttgttttgttttttaaacaaaacactttggtgaaaatgatttcaaacatctcccgggcgtggtggcatgtgcctgtagtcccagctgcttgggagactgggaggatccgttgagcccaggaggtgggaggcttgcagtgagccgtgatggcattcacttgtgctccagggcttgccgacagagtgaaaccctgttttcaaaaacaacagcaacaagaactttttcaggg

SEQ ID NO: 36971 - DNA, 4155 bp, Homo sapiens
  misc_feature (654)..(654): n is a, c, g, or t
  misc_feature (1023)..(1023): n is a, c, g, or t
  misc_feature (2219)..(2219): n is a, c, g, or t
  misc_feature (2322)..(2322): n is a, c, g, or t
  misc_feature (3617)..(3617): n is a, c, g, or t
gggagaggtggcgcgttgcctgggtgctcatggacaccaggtctgctccccatgcacttgtcgtctgtgccacgctgcaggggccaggcagccacaggcatcgtttgggccccgagctggccaggctggagtcagggcccactaagccgcaggtgcctcttgcttgggggtgggggctgaagggtgtcttcctgccgtggagctatagctggtgcctgttccctctgtccagacacagctctgggcttgcagcctctgcctccctgatgggacagcaaccctgggcatcgctagaggctctgaggtctgcacggggcaccatcccgtattctgcagggtccagagacacagagagggaggccagcccagcaccattgtgggagaaaggccagtgatgtcatcagggggctaaggctggcagccaccttctagtggacattactgctgagaactggccaggtgcctgcactcgctgccatgagtaattgcccagtggcccgtgaggtgctggcagctcctccatttacaagttaggagacaggtacagagagaccaggtggcctgttccagcagcactgctctggctcttgaccaccaccacatcagcagcaaaaccgccagggctgaaatcaatacagatttatccattctcancaggctgcgggcgccttgcaggtctgtgctcctagctgggggcccagggagactctgcttccaggactgcccgagtgtggaaggaacccagctgccagctgcaggactgaggtcccatctcctccctggcctcgcacaggccctcctgcctgccaagcagcaagtgatgccgcacctcagtctctccctctgctctccagttccctggacccccagcccaagctccggtgattaccaggtaattcctgtcccaagacagccgcgccgagtgtcctaacacagttgccacacggctccatgtcctgtgcacaggccaggggttcgagtgggcatcagcaatgctcacttcagagcccctccgccacgacntggccatgtgcacacagctccgtggccagcgctggaaactgcgtctcctgcctccagctgcgttacttggagaagcaggaacctctccatcctcactttccatccgcacatccagggccgcccacgtgcacccacaccgtgcgctcactgtgtggcctgtcgagaacacagtgtcctctgcccctgatttcccaggagagtcgcacgtctgtgatggtggtctcccaggcacgcatggccatggagcacgggaacgtgtgcgcctgctgggagcacatgggaagactgcacgccgggtgctgaggcttcctgtgaaaaaaagaacctgaaacaagtcttcctgagacccaggctggtgtggacacaaggaagccccgccggagggccctctttacatggggaggcctgaaccctgagcagtcaaggaagttttggaagtgagtagctatggcttctccacctgctcctgcctggacggcgcccttcagaactcaagcccatccatgagacagcacccaccggggccagtgagtcactccatgaaggccaaagatcacctggacacgagtctcggggtaaccagcccccctgcagacctgcagaagcttggacagcaagtgggagtcagcagtcaggaaactcgggggctttgcacctggagggaagcccacctgatatgaaaatgctttcgaagcttgtggatcggagaggccagtggtgtaccgggtggtccaatcgatcagtcaggacgatcatcagccccatttctcaggtgcagtacagcacgtccacgtcctcccgacaccgtgagtgcggccacaccgaagccaggggagcaggtgcgcttctccataggtcctggtttaaagcaagcggaaacaccacaggctcgggattgaggtggtaagggacgtccagtcctcaggtgaggttaagtccttctacagagacagcactggggggacctcacagtgccccccgggaagcgctgtttgggcaggctgcaggagctgaggccagagtcctggcacggggctacggggcccttggtgtctttcactgctgtgacgggggctccctgctgccccggcacctgcgggccttggccagtcccgaacaccaggttgtggcagtggagacctggggggtggccagcggccccctatggaggttctgccgtgcgtgtcagggccccnggcagggctgtgcagcgccagcctcactatcagtgtggacacacatctgtgggaggggctctcgttttccccaccttccggtgagggaaccaaggcagactcngcaccaagcaggggtcaggccctggtggaggtggattttcttcactgtggcacagtcctgctcagtttctagtcctgatggaggtggtggaggccctggtggaggtggattttcttcaccgtggcacagtcctgctcagtccctggactgcccccctgcacccagcagcacaggccgcagagcccaggagatgtgggcaggagctttcccctcgcctgccccactcctgcccacccagtgggcaccccgtagatgggagcagctctccgtctagcacttggactgctgggctgagtcatggctgcaggcaacggcttagtggcatctcccaggtgccactgcagggatagcctctgtgtctccaggctctgctgtggccccgcggagccaagcttacccatgccgctgagtcgggggctgcagaggcctgtgcgggctgcggtggctagacctgggcctggctgctcagatgctgctggaaccctgctctcagcctggaggctggcaggtctgccaggggccaacgggcaggcatcgcccgtctgaagctctttgcctctgaaggagcttcagcgccagccaggggcagtttatgagaaattcagagaaacatgtaggcttctctgtgtcttctgaagaactgccaatgcctcacccacctctggccagaggactctggaaaacttgcgtttctggtatgtatagaaaagcgacatgctaagccgcaaagccgcccccttcaagacgcagcacacgcaaggctcaccctgccacgagcactggtaccggctcactttccgctctgctcggcgggactccggccaggcccagcgtgcagctgcagaaaggtttagagtgaggcttccacttcactctccggtccaagagttatactatctggtggaagtgtttctttttccttttttggacagttaagctacagcgatgggccaactggcaccagtgtggagagacaggtattcctcactttgtggcaccaacgtggttctggcaaagtggcctcttttccagtaaaacagtcttctcccctccctcgccttccattttaggaccagtggtttgtccctggggaagcaaccccaattacagccagctttgccatctgtggaaatagcctggtcaccagaggcacagaagccagatgcgtggccatgccggcggcagcacccggggcagcccctgcccccgacccatgaatctcagtgtcccccaggccgcccacgtcccactctgcccagcctacaccacctccctcaccgcaaagtgcccgctcngcagctccatgcccctgcccagtggagcctcagccccgtcccacctgcagcatgcccagcccaagtgcccgaaacccagagcctcggactcagggcaaaaggaagccgccccattccaccacatcagggtctccactgtgcttatttagagcagagcacaactctccttgcgtctgagtcccttcacacaggtgactgagaggctcaggacagagcattgcaggggagacagaggaggggctcggcctcgccaagcagctggctctattcatttagcagaaccgctgccccaccccctcccagcccctgcacggagggaggccactggggccggcccgtccccaacttctattttgttttcgccagagccgcctccagactccctcttcacattttatgtcaactctggggccctgctggctgaaagtgagttctgttttccggcagccctgtggcttttggactcggccttgaaattagttcatggcgacccaggcacacatcgcgctgggaagccacgtgggagccgtgcgggtga

SEQ ID NO: 36972 - DNA, 572 bp, Homo sapiens
gagtgatgtttcaaaacacaaacataataggtagagtcaattacttaggggagtctaaacctggaggtaacattagaaatagaaataataaaatgcagtgtttttggatttgtctgttaagattattttaatccagatcatatttaatggtttacatagttgtatatcaaatttggtttcagaaataaattatacagtaaatttaaaaatgcaaaaaatgtatattgttatacattctgtaacctatgaatccatataacttgggcaagaaaattatataattaaaaataaaacctttctgttctcaattatgttttagggacagctatatagttcacactcacaaaggaatcataaaaactctatgtataatcttggaagtaaaaatatctgttgtatcatatttatgaagtatacaattgattaaaaatgataatgtctgtcttctatccaacggcaataacagaagataatggcatataagtaggcctgtctccttttttttggcattgatttatatatctttactagctttgttgttttaactccaataaaagattatttagtaagcc

SEQ ID NO: 36973 - DNA, 755 bp, Homo sapiens
ggcagtaaagacaggacgcacccatgtcacaagaggagcacaggcaggggtgttggtgttggggcagccctcagggtctccagacccaagccccactcacacagcagcctaggaaggaagggcagagtcccaggtgtcagctggtgggtctcccaggagctgcccctccctggaagtcacaggacaggaatgacagatcagggaactgcaggaagctgccacctctggggtcagaatatgcccagcctgcgggggctctctatcggggtcttcgagagccagacagcctgccttgtgctgcatacctggctttgctctgtgcagaacccagcacacgtgattttgtgtgacatgccagcagcctggctcccaggacaggaggcctgccctgggggaggggctgcaggaggagggggggcaggcacccatgagtctgtccagccttgtcacagatgcatcgcccagcctgcggtcctgatttcagctcacctcagagtaaatcagaataaactgcacccagactttcacgaatgcatgttgacgctttcagttcacccctttctttgctaactttcttcctattttcttctaatgcgagagcttattaattccatatttatcattttgaataacttttctcctttttagtaacaaaatgtacttcactcttagtaaaatgtatttactattttagtaacaaaaatatacttgcctaatcatgtttaaaatatagtgatgtgaaaaattcagacgtc

SEQ ID NO: 36974 - DNA, 199 bp, Homo sapiens
gccctgcagcccaggcatgggactgaccacggacagcgaggggacagccagtggtgctgaggctgggagggagggccattgggcgtggggcacgcacggtgaattttctagggaaattgctgcagtcaacacctggagccctggtctgggagtggcctgtggggtccagtggcctcatgccctgtgcccatatgatgac

SEQ ID NO: 36975 - DNA, 406 bp, Homo sapiens
tttttttttgttgttgttttttaggatcttgctctgttgttaggtatgttgtaaactgctgcagaatcctcctcaaaacccagttgtagagattgagactgtctgtaaatacttcaaaggagaaagaaaaaggggataatgggacgcagaaaaacaaaaatgacaagaaacgttctgtcagcagcatgcgattaaaaaaccccatacagatctggcagagcatggttatttctgaaaatgacactcactttgaaggctgttcttttagtcagacctctgttaggctaaggacctctcccactgctgacatgatagatcaaaggaagcaccttgcactgtctgaggtgcatgactagcacaagtcactacagacacagaacaacagagcaggcaatggacgtgcagc

SEQ ID NO: 36976 - DNA, 567 bp, Homo sapiens
ttttttttttaatgatttctctgaattctattttttcctcaaatctgctaggattttagtttcctattcccttaaaacattttgaagcttgccttacttctttaaagagagggttttgttttataatctgtctgacaattatgaaaccttaagttgtgtggttctatttcggtggttggttgtttctgctggttcttatcctgggttcctagattccttgtatgcttgcttaaatttgaccgtgatttgcccaagttattcatggaactatttgggaattctcggaggcttaggactagcatttccttctaccacacacacacaaaagcaccacctgttcagaacaaccttaaactaaattcacacctagctctgttttaactgcctaggtaaggtgtatttaagcaatgagtccttgagaacaccagtgattggctaaaacttctcaaagatctgtttatttcatttggtttgattttggggccatcttctgctaagcactaaaatgactactcgtgcagtttcctgagacggccagaagagtttacttgtggttcaccattatcc

SEQ ID NO: 36977 - DNA, 796 bp, Homo sapiens
gacttgcttatgggttgtggggagggaagggcactggcatgattgcaatacattcctgggcaagacatctggcctctcccatttgcggttccttcatctataaaatgttaacacagtgtgtcaaaatgttgatgttctcgagtgacttttcctgagatctttgccaattctcaaatcaacatccttatggtcattgttgccaggatctcatttattgtgtacagtagcctaagaggaggcattttgttcttgcttgacacatgacaaaatcacacacatgccaccagagcacataattcccccttacaccgtaaatacaatcaagcacacctgaaaatctaagtgatttcttccttattgattccacgaataaaaggcagtagggatttctaaatttgttaaaggaaattcatcactgagtgtaaattctccctaacatggactagcaattttgtttctctgggagccataattcacaagccaacaggtatttctgtcacttcctaatacatggagggtacagcatcccctgcacactgggttccagcctgagtgtgaactctcttgcgtacgaagggactggcccctgtgtgcttcttactgcacgcacttcataattactccttagcagacttaggctgtttcatgtctaggaccttcggagttattctcaaaagtaaaaatcccaaatgttgattctgtaaataccaagggtcaactataatattagcaatgatccagggctgctggaggattcaatgagataaaatgctaagtgtccagcatcctaagtgtg

SEQ ID NO: 36978 - DNA, 580 bp, Homo sapiens
gacttgcttatgggttgtggggagggaagggcactggcatgattgcaatacattcctgggcaagacatctggcctctcccatttgcggttccttcatctataaaatgttaacacagtgtgtcaaaatgttgatgttctcgagtgacttttcctgagatctttgccaattctcaaatcaacatccttatggtcattgttgccaggatctcatttattgtgtacagtagcctaagaggaggcattttgttcttgcttgacacatgacaaaatcacacacatgccaccagagcacataattcccccttacaccgtaaatacaatcaagcacacctgaaaatctaagtgatttcttccttattgattccacgaataaaaggcagtagggatttctaaatttgttaaaggaaattcatcactgagtgtaaattctccctaacatggactagcaattttgtttctttgggaggctgaggtgggaggattggtggaggctgggaggtcgaggctgcagtgagctgtgattgagccactgcattccagcctgggtgacacagtgacaacttgtctcaggaaaaaaaaa

SEQ ID NO: 36979 - DNA, 330 bp, Homo sapiens
cactttttaggggaatagcagacaagaggaattaggtccaaaagtcatccttgacatctcttcctttatgctccatggccaattcatcagcacatggtgtaagattccctttccaaatgtgcacagaatctaatccatcactgccactgctcccaccttggtccaaacctggacaactacaatggcctcctacctcatcctaatggtcctcattttccatggataaatgcagggtgatcctttaaaatgtcagatcatttcacttctctgcttaaaatcctccaatggcaggccggccacggtagctcgtgcctgtaatcccagcacttt

SEQ ID NO: 36980 - DNA, 425 bp, Homo sapiens
ttttgagacagggtctcactctgccacccaggctggagtgcactggtgtaatcttgggctcactgcagccttgacctcctaggctgaagccattcttccgcctcagctcctctagtagctggggactacaggcatgtgccaccacacctggctaatttttttaaaaatttttgtaggacaaggtctcactatgttgtccaggctggtcttgaactcccaaactcaagcaatcctctcaccttagcctcccaaagggctgcgattataggcgtgggccaccgtgtccagcctgggattacactttgactctgtttcccaatgctatcactttcccctttccctaggaatctggtgtctcttattttcactttgagtaccctataagtatgtgttggtatttttattttgagcacatctcaatccta

SEQ ID NO: 36981 - DNA, 408 bp, Homo sapiens
tgcagtctttgatttccatagaaagtcaaaagtcattctagtaatacacacttaggaaatgtgaagtgctatgactcattttattttggctttgcacagtgtagaaaatttcttggctaggaagaaattccttttcaaactaccagtcctccccaaacaattctcctcccttctgaataggtagttctctctttgcacagacattcttctgggcttagctgctgtgtaacctcttaacccttcattaataatttcctgaggccagtttgttataaagaaatattgcagcacagacagtgtgtgagcaagagagagagagagaaagagcgagagagaaagagagagagacacacacacatactactttttaatgaccaactagaatggggttaatgctctgaaagaaat

SEQ ID NO: 36982 - DNA, 1149 bp, Homo sapiens
tttttcacatgtagaaaagaggctttattaagaaggctttgaagtcaaaaaataaaactcttgatacaatttttttaacccttaaatcagctcagcaaatatataatcagtaatttagctgtgtaagattaaaggtccattactttatttaaaataaaatatattttagttcttaaaatttattccataaagtacatatttccctataaattccctacatatacacaagaggtaaaaagtaaaagtaaaaaaaaaaaaaaaattaaaaaaattttaaaaatgacaacagaaaccgcagtaaaaaggggattaataattaacagaaagttagaaatttgattggaacgcccctcgcccccgcccccctgcccccctccggccgcgcacggttgatgtacaaaagcataaatggttagccccaaaaagggagtaaaaatgtcaccctcctcctctggaacgtctgtgcggcctgagaccggccggcgagaaaagtcaaatcagaaaacggcttcggacgaaaggaaaaaacgctgagcgctggaaaagtcgtgttttttgttttgcttttttaaagatcaccctggaggggaggggtgtctaaaaataagaaaactaaaaaaagtgcaagcggaccttttctctccggtttattgtaacctgaccactcaatactgtcgttgaagggctgaggcgccgccgggctgcggggtctccgtctccacgcctgaggcggcagttaaagctcatctgtaaacactggccgccgcccacccccctgccccctcggcctccgcccctcgccccctccccgtccctctcccaccccgggtcccgccccgtctcccgcgcccacccctggcccccgcagatggccccggccacgtggtggtccgcgctctaggaaaagatatgaatggcctgggtggccggcgtgcggcaggcgggacactcgggctcgctcttgccgcagatgcggacggcgcagtccatgcagaagaggttgtggccgcaggggaccagcgcagccatcacctcgccctcggcgcacaccacgcactctcgcgccagggccggggccgaggacgccgaagggggcttgcggctgttctcggaggcgccggagtccaggggggcgcaggcggcggccgc

SEQ ID NO: 36983 - DNA, 1195 bp, Homo sapiens
tttttcacatgtagaaaagaggctttattaagaaggctttgaagtcaaaaaataaaactcttgatacaatttttttaacccttaaatcagctcagcaaatatataatcagtaatttagctgtgtaagattaaaggtccattactttatttaaaataaaatatattttagttcttaaaatttattccataaagtacatatttccctcttgtgtatatgtagggaatttatagggaaatatgtactttatggaataaattccctacatatacacaagaggtaaaaagtaaaagtaaaaaaaaaaaaaaaattaaaaaaattttaaaaatgacaacagaaaccgcagtaaaaaggggattaataattaacagaaagttagaaatttgattggaacgcccctcgcccccgcccccctgcccccctccggccgcgcacggttgatgtacaaaagcataaatggttagccccaaaaagggagtaaaaatgtcaccctcctcctctggaacgtctgtgcggcctgagaccggccggcgagaaaagtcaaatcagaaaacggcttcggacgaaaggaaaaaacgctgagcgctggaaaagtcgtgttttttgttttgcttttttaaagatcaccctggaggggaggggtgtctaaaaataagaaaactaaaaaaagtgcaagcggaccttttctctccggtttattgtaacctgaccactcaatactgtcgttgaagggctgaggcgccgccgggctgcggggtctccgtctccacgcctgaggcggcagttaaagctcatctgtaaacactggccgccgcccacccccctgccccctcggcctccgcccctcgccccctccccgtccctctcccaccccgggtcccgccccgtctcccgcgcccacccctggcccccgcagatggccccggccacgtggtggtccgcgctctaggaaaagatatgaatggcctgggtggccggcgtgcggcaggcgggacactcgggctcgctcttgccgcagatgcggacggcgcagtccatgcagaagaggttgtggccgcaggggaccagcgcagccatcacctcgccctcggcgcacaccacgcactctcgcgccagggccggggccgaggacgccgaagggggcttgcggctgttctcggaggcgccggagtccaggggggcgcaggcggcggccgc

SEQ ID NO: 36984 - DNA, 1057 bp, Homo sapiens
tttttcacatgtagaaaagaggctttattaagaaggctttgaagtcaaaaaataaaactcttgatacaatttttttaacccttaaatcagctcagcaaatatataatcagtaatttagctgtgtaagattaaaggtccattactttatttaaaataaaatatattttagttcttaaaatttattccataaagtacatatttccctataaattccctacatatacacaagaggtaaaaagtaaaagtaaaaaaaaaaaaaaaattaaaaaaattttaaaaatgacaacagaaaccgcagtaaaaaggggattaataattaacagaaagttagaaatttgattggaacgcccctcgcccccgcccccctgcccccctccggccgcgcacggttgatgtacaaaagcataaatggttagccccaaaaagggagtaaaaatgtcaccctcctcctctggaacgtctgtgcggcctgagaccggccggcgagaaaagtcaaatcagaaaacggcttcggacgaaaggaaaaaacgctgagcgctggaaaagtcgtgttttttgttttgcttttttaaagatcaccctggaggggaggggtgtctaaaaataagaaaactaaaaaaagtgcaagcggaccttttctctccggtttattgtaacctgaccactcaatactgtcgttgaagggctgaggcgccgccgggctgcggggtctccgtctccacgcctgaggcggcagttaaagctcatctgtaaacactggccgtggagaaggcggcgccgcctgggaaggatacggggccgcgctctaggaaaagatatgaatggcctgggtggccggcgtgcggcaggcgggacactcgggctcgctcttgccgcagatgcggacggcgcagtccatgcagaagaggttgtggccgcaggggaccagcgcagccatcacctcgccctcggcgcacaccacgcactctcgcgccagggccggggccgaggacgccgaagggggcttgcggctgttctcggaggcgccggagtccaggggggcgcaggcggcggccgc

SEQ ID NO: 36985 - DNA, 824 bp, Homo sapiens
tttttcacatgtagaaaagaggctttattaagaaggctttgaagtcaaaaaataaaactcttgatacaatttttttaacccttaaatcagctcagcaaatatataatcagtaatttagctgtgtaagattaaaggtccattactttatttaaaataaaatatattttagttcttaaaatttattccataaagtacatatttccctataaattccctacatatacacaagaggtaaaaagtaaaagtaaaaaaaaaaaaaaaattaaaaaaattttaaaaatgacaacagaaaccgcagtaaaaaggggattaataattaacagaaagttagaaatttgattggaacgcccctcgcccccgcccccctgcccccctccggccgcgcacggttgatgtacaaaagcataaatggttagccccaaaaagggagtaaaaatgtcaccctcctcctctggaacgtctgtgcggcctgagaccggccggcgagaaaagtcaaatcagaaaacggcttcggacgaaaggaaaaaacgctgagcgctggaaaagtcgtgttttttgttttgcttttttaaagatcaccctggaggggaggggtgtctaaaaataagaaaactaaaaaaagtgcaagcggaccttttctctccggtttattgtaacctgaccactcaatactgtcgttgaagggctgaggcgccgccgggctgcggggtctccgtctccacgcctgaggcggcagttaaagctcatctgtaaacactggccgccgcccacccccctgccccctcggaggcgccggagtccaggggggcgcaggcggcggccgc

SEQ ID NO: 36986 - DNA, 962 bp, Homo sapiens
tttttcacatgtagaaaagaggctttattaagaaggctttgaagtcaaaaaataaaactcttgatacaatttttttaacccttaaatcagctcagcaaatatataatcagtaatttagctgtgtaagattaaaggtccattactttatttaaaataaaatatattttagttcttaaaatttattccataaagtacatatttccctataaattccctacatatacacaagaggtaaaaagtaaaagtaaaaaaaaaaaaaaaattaaaaaaattttaaaaatgacaacagaaaccgcagtaaaaaggggattaataattaacagaaagttagaaatttgattggaacgcccctcgcccccgcccccctgcccccctccggccgcgcacggttgatgtacaaaagcataaatggttagccccaaaaagggagtaaaaatgtcaccctcctcctctggaacgtctgtgcggcctgagaccggccggcgagaaaagtcaaatcagaaaacggcttcggacgaaaggaaaaaacgctgagcgctggaaaagtcgtgttttttgttttgcttttttaaagatcaccctggaggggaggggtgtctaaaaataagaaaactaaaaaaagtgcaagcggaccttttctctccggtttattgtaacctgaccactcaatactgtcgttgaagggctgaggcgccgccgggctgcggggtctccgtctccacgcgaatggcctgggtggccggcgtgcggcaggcgggacactcgggctcgctcttgccgcagatgcggacggcgcagtccatgcagaagaggttgtggccgcaggggaccagcgcagccatcacctcgccctcggcgcacaccacgcactctcgcgccagggccggggccgaggacgccgaagggggcttgcggctgttctcggaggcgccggagtccaggggggcgcaggcggcggccgc

SEQ ID NO: 36987 - DNA, 284 bp, Homo sapiens
attcttcagctgtaacatagcatgctctgcaaagccagtgtaaaaataaccagggcaggggtgtgtgtggcattttgcagctgggtaatctgatccgcagagatctgtccaaggtcaggggcttggcagcagctcctggccacgcctacagctcccaaccgtggacctctctgccctgtgtgtccagccctgctcccagcccgttgactttagcctctcaacagcactgcctccccgggttacccgatgaggtgggatttttctcctgttcatgctgcaaatct

SEQ ID NO: 36988 - DNA, 360 bp, Homo sapiens
cttaagccaggcattgtgcctgagggaagaaatagtggctcttatgagctctgctagaaaagtaacccttcaggccaggcgcggtggctcacgcctataatcccagcattttgggaggccgagacaggcggatcacctgaggttgggagtttgagaccagcctggccaacatggaaaaaccccctctctactaaaaatgcaaaattagccagtcatggtggcaggtgcctgtaatcccagctacttgggaggctgaggcaggagaattgcttgaacctgggaggcggcggttgcagtgagctgaaatcgtgccattgcactccagcctgggcgacaagagtgaaactccatctcaaaaaa

SEQ ID NO: 36989 - DNA, 153 bp, Homo sapiens
ttttttttaagtttcccagatatgaaggactgtgagactaaataaatcattatatattccacaagcaattctcctgcgacagcctttcaaaaaagaattaggaagcctgaatattaaatgccagcaacccatgactaggataaggtcagtttc

SEQ ID NO: 36990 - DNA, 472 bp, Homo sapiens
ggcttttttcaggtatctctaacttagtggagaagtttgaaaagctctgcttgccactgaaattagtccagaaggatctttgcttggctgtccgtacttatcacatcactgagaaaggtctaagtgtcttttaatgtagatggagagtgtccttgtcctacccaggtcctagaactggagggagctggtaacacaagaacatgctgaagatgaacattgaaaacactccttcattagcagaaacagaatgggccttgtcggagttgtgacagttactgactgggcagggggtttggatctggctaaatatagccaggggaaagaaactagtagtatagctggaaagatggtaatgattacacaaatgcatatgttttaatttgaaggtaaaagaggagagaatatcaatcagagatattactgaggtcccagcttaatattttaaatatttaaggagctctaaagaggaata

SEQ ID NO: 36991 - DNA, 744 bp, Homo sapiens
tactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaagtgatgaaaataaattaaaactgaattacc

SEQ ID NO: 36992 - DNA, 1082 bp, Homo sapiens
tactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaagtgatgaaaataaattaaaactgaattaccaaaaaaaaaaaaaaaaaaaattttgggggggcggggcctgaaaaaaatttttaaaccattgtttggggcgggccaattgttagtaacatgtggcctaagcgttgtcccaagaggaaaccgggcatggaacggtgggtggtttcccccaataaaaaacgcccgggcaccgggtgtttgacaatccaagtggttctcggcctctggtctctaacggtccaggtcgtaaccctcccccgctcacgctgttgaaacaaacagaggagatcgaaaaagaagaacagagaaagcgcaagaagaagcaaaaacacaaaagaagaatataagaacaaatgaagcac

SEQ ID NO: 36993 - DNA, 1098 bp, Homo sapiens
tactttgaggaaaaaaagtcaaagaaaaattgtatttgagggaaaaaaccatgaccaagtaaaggataaattcaaaaaatagcctcatgagacttggcatacacactcgtgggattccagttattatggagtgcttccatccctctccaccccttccccccaaaaggttttctttgcaagtgcttttggaactaagagctagtatcttggattaactgatgcctgctagtgctttctgattactcgcattctgtttcttgctttaaaagaagagtaaagacaagagtgttggaccagtattgcagttctgtagtgtcatttcttataaaaaacaaaacaacaacaataatttatcaaaattggcatatttaaagcctaacattctaataaaggcacaaatttctttttaatacttgtttcagcctctttaatctctttataagttaactaataaatctattttcttcagacttctgcaatagttctttaaaatcacaacagttagcaagctgacttttgtaatgtgctcaatacaaatacttgtgaacttttaatatgttgagtgctttcattttgataactggatctccatttgatattttcatttgtataactcatttgcagtctgaaaattttttttagtgccagtccctgaacatatcattgaaagttaattttctttgcattttaaaatatctggattatgaagaaaaagtgatgaaaataaattaaaactgaattaccttttctaatgtttttttttttaaagtaatgtaattctattttgtttttatgtatgtgatatctgtttctgttgagatttgggagttattgaaatctctgtaatgtgtatggtagaaaatttcttgtgaccttaaaattttaccagttatttatagaaagagaaaatgggaaatgttttataggctttttactagcagtatcagtgaacacttgaactccattattcatgaaaataacacgttaggattggaatacgtctattcaaaagtgaaagaatataaagtgtatagttttttgtttatactctaaagatagaattggggagtaaacttcagtttttgtttagagtggatc

SEQ ID NO: 36994 - DNA, 677 bp, Homo sapiens
tatgatctaaatattctggcaatccttcgtaaaaaataaaacatcatataatccacatcagtagttaaattgaccttttgttcagtgtcacgaatcaagtaaatctgaatagtgtgtttcagatttgttttggccctttaggtaatcagttctgatgcatattgatgaaagatatagtaatttttttttttagatggagtctcactcttgtcgcccaggctggagtgcaatggtgcgatctcagcgcaccgtaacctctacctcctaggttcaagtgattctcctgctccagcctcccgagtagctgggattacaggtgccccaccaccacgctaggctaatttttgtatttttagtagaaatggggtttcacccatgttggcccaggctagtctcgaactcctgacctcaggtgatctgcccacctcagccacccaaagtgctgggattacaggcgtgagcctaatttaattcacatatttaaatacttttatttccaaaggaggttaatggtaaatgtgatcatcaagtcaagcatgacactctgcttgtaaacacattgattttaaccagagttcagtgcatgtcctggctaggtgtggtggctcacacctgtaatcctactactttgggaggcctaggtgggaggatagcttgaggccaggagttcaagaccg

SEQ ID NO: 36995 - DNA, 705 bp, Homo sapiens
aactcatttttatacatttaggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattgagatatggttcgagtttgcagaacttcccttgtcataaccttgggctttgcaaacggtttcatcttatggcatggatttgttgccaaatacaaggattaactct

SEQ ID NO: 36996 - DNA, 5715 bp, Homo sapiens
aggcccagccccgcacgcgccaccgctcgcgggccaatgggtggcagcctctctgcataggcaacgagtgccggccgggggtgagcgtcccaggcggttccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcggttttgacacaagggcgcatatcttcaaagcacctagtacctcctaccattgtcaactgatacagaattcgttgttgggaaggactggggaaacagctgtaacatttgccaccctcagaagctgctggtcctgtgtcacaccaccttagcctcttgatcgaggaagattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccgacctggtccgagttccccaagggcatcattgtgcataccatggctgcagtggaggccctgggagccaaggccagcatggaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaaacaaattagtcatggaaaattattctattccaaagtctccttttagtctagataatcattatttcattttaaaattagtgtttttcatagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtaagtctcttcatttattactgcttgtctgttgttatatctggattatcaaaagcaatagtgcaccaattaagatgtgctcaaatcaggacttaaatcataggcaccacatttttcatgtcagactagttactttgttgattctcagttactgtaggcatcaaaaggcaaaaatcaaaaaaaaaaaaacaaaaacaaacaaaaaaaaagatgaacctaggtctgtgtaaagtaaggggagtgttaggagcagccaggactgtgtagtgtgtgtttggttgcatcacaaacatcgtatgtggagacattgcaatacagtgttttttgttttcaacttttcttgtattcttgtatatttgtattatgttttgaatgcttttctcttttcataattaaatattaatgtttgggataactgccaagaagaagtaaaaatattgaatggaacttctatatgaggatgctgtgatctaaaaattaaatctcagtgggcggagagaatttgtttctgatgccttgtctttagaataattgtttgctttcagatgattaaaaaaaggagattgtatctaggaaaaaagtgtgaatgcttcaaaggagagatactgataattgtgacttgaaatagtgtcagatgaattatgtagctgatcactgatggaaccatctaatgaggcaggcttaaactctatttagtttcgtttgttttctcatatgaagtttataattcctttcagtcctaaaatgtcagatgccaggtgtcaaatgccacagtagaacgtgaaattaagtagagtccccttttaaacaaatttctctgtaagcaaaactatctttagtgacttaaaaaataatatcctctaaaattaccctttcaagaggaaaaaactgttcaatgaaaaaaccactcaattatgactcatataagaaatactggtttaaccaggagatatttggggagcaaaattttaaggaatttcaaattgctaaatctaatacaaatatctgacaataagatacagatctaaaagaatggttcttaagaactattgtttactgggaataaactaagctctatgaagaattcgtaagcattacatgttccagtaagtttagcaacttagagccaagactggtggccacctccatttatttccccactgctcctccactgacatccttcttagcagaaacttcatgaaaaagtttttgctgacacagaacaaacctgaaagtagtatctactttctaaatactactttgcttttcagtagtggatttgatatttataatgttctctaaagcttgcaactttttcagcaacgtttaaaaatagattaacctggaataacttacttgtttgctgctaaaatactcaagattttgccatttttaaacaaccagtccctgtgatacaactttgaaaaaacttttaaaaatctctgatgtatgggctctttttttcccataagaattatgtacatctgtgatgttttacagggggatccgcttttaaacagtgtacatattggaccacactgaaatgtcatatatcctttctctacttaaaattggttatttactgtgagttcatttccgatgtgttcttggttgttgctgttttctgcctgaagacgtgtatcataaagagctacatggtatggactatttatttgtaatttgacataaagtttgaagaataaagatctataaaagttgaagtttctgatattaaagctcttaatatattggcttt

SEQ ID NO: 36997 - DNA, 5608 bp, Homo sapiens
aggcccagccccgcacgcgccaccgctcgcgggccaatgggtggcagcctctctgcataggcaacgagtgccggccgggggtgagcgtcccaggcggttccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcggttttgacacaagggcgcatatcttcaaagcacctagtacctcctaccattgtcaactgattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccgacctggtccgagttccccaagggcatcattgtgcataccatggctgcagtggaggccctgggagccaaggccagcatggaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaaacaaattagtcatggaaaattattctattccaaagtctccttttagtctagataatcattatttcattttaaaattagtgtttttcatagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtaagtctcttcatttattactgcttgtctgttgttatatctggattatcaaaagcaatagtgcaccaattaagatgtgctcaaatcaggacttaaatcataggcaccacatttttcatgtcagactagttactttgttgattctcagttactgtaggcatcaaaaggcaaaaatcaaaaaaaaaaaaacaaaaacaaacaaaaaaaaagatgaacctaggtctgtgtaaagtaaggggagtgttaggagcagccaggactgtgtagtgtgtgtttggttgcatcacaaacatcgtatgtggagacattgcaatacagtgttttttgttttcaacttttcttgtattcttgtatatttgtattatgttttgaatgcttttctcttttcataattaaatattaatgtttgggataactgccaagaagaagtaaaaatattgaatggaacttctatatgaggatgctgtgatctaaaaattaaatctcagtgggcggagagaatttgtttctgatgccttgtctttagaataattgtttgctttcagatgattaaaaaaaggagattgtatctaggaaaaaagtgtgaatgcttcaaaggagagatactgataattgtgacttgaaatagtgtcagatgaattatgtagctgatcactgatggaaccatctaatgaggcaggcttaaactctatttagtttcgtttgttttctcatatgaagtttataattcctttcagtcctaaaatgtcagatgccaggtgtcaaatgccacagtagaacgtgaaattaagtagagtccccttttaaacaaatttctctgtaagcaaaactatctttagtgacttaaaaaataatatcctctaaaattaccctttcaagaggaaaaaactgttcaatgaaaaaaccactcaattatgactcatataagaaatactggtttaaccaggagatatttggggagcaaaattttaaggaatttcaaattgctaaatctaatacaaatatctgacaataagatacagatctaaaagaatggttcttaagaactattgtttactgggaataaactaagctctatgaagaattcgtaagcattacatgttccagtaagtttagcaacttagagccaagactggtggccacctccatttatttccccactgctcctccactgacatccttcttagcagaaacttcatgaaaaagtttttgctgacacagaacaaacctgaaagtagtatctactttctaaatactactttgcttttcagtagtggatttgatatttataatgttctctaaagcttgcaactttttcagcaacgtttaaaaatagattaacctggaataacttacttgtttgctgctaaaatactcaagattttgccatttttaaacaaccagtccctgtgatacaactttgaaaaaacttttaaaaatctctgatgtatgggctctttttttcccataagaattatgtacatctgtgatgttttacagggggatccgcttttaaacagtgtacatattggaccacactgaaatgtcatatatcctttctctacttaaaattggttatttactgtgagttcatttccgatgtgttcttggttgttgctgttttctgcctgaagacgtgtatcataaagagctacatggtatggactatttatttgtaatttgacataaagtttgaagaataaagatctataaaagttgaagtttctgatattaaagctcttaatatattggcttt

SEQ ID NO: 36998 - DNA, 5881 bp, Homo sapiens
gccgttttgtttactgttactttcgcagtgcttagaacgatatctaacatagtggattttcaataaatctgatgaatgcaaagtacagaatgaccaaagtatactgctttcttgcgtcatagtttaacctaacttgaaaactatctgtagagccattgtggaaaatgaattttttgtgtttgcaaactccagttgcttgttgctgactagagtgagaatggggctcacagggaaggaatgtggtgattatttggcagtggctgctggggctgtgagagaggatggatgtgttgtatttgtaaagtacttgccatccctaatgcagtgagatgctaaagcacaggaaatgggtaaatttttggtcttcccccaaccctctttctgacttgctccctttttactactgggaaatgtttgtggatacttaaggttttggttggaacagccgcctgtttacagtatgatgtggaaacttttcttgtaattccgttgttaatagatattgtacaaatgagtctcttagaaatatcaagacattgtaggggaccagtgtggtagctgctgcctgatagaaaaaaaaaaatcttcatttgccgatgtaacttttctttaaattattttaaaatgattttgaactaacgcctttctttttcttcctcctagattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccgacctggtccgagttccccaagggcatcattgtgcataccatggctgcagtggaggccctgggagccaaggccagcatggaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaaacaaattagtcatggaaaattattctattccaaagtctccttttagtctagataatcattatttcattttaaaattagtgtttttcatagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtaagtctcttcatttattactgcttgtctgttgttatatctggattatcaaaagcaatagtgcaccaattaagatgtgctcaaatcaggacttaaatcataggcaccacatttttcatgtcagactagttactttgttgattctcagttactgtaggcatcaaaaggcaaaaatcaaaaaaaaaaaaacaaaaacaaacaaaaaaaaagatgaacctaggtctgtgtaaagtaaggggagtgttaggagcagccaggactgtgtagtgtgtgtttggttgcatcacaaacatcgtatgtggagacattgcaatacagtgttttttgttttcaacttttcttgtattcttgtatatttgtattatgttttgaatgcttttctcttttcataattaaatattaatgtttgggataactgccaagaagaagtaaaaatattgaatggaacttctatatgaggatgctgtgatctaaaaattaaatctcagtgggcggagagaatttgtttctgatgccttgtctttagaataattgtttgctttcagatgattaaaaaaaggagattgtatctaggaaaaaagtgtgaatgcttcaaaggagagatactgataattgtgacttgaaatagtgtcagatgaattatgtagctgatcactgatggaaccatctaatgaggcaggcttaaactctatttagtttcgtttgttttctcatatgaagtttataattcctttcagtcctaaaatgtcagatgccaggtgtcaaatgccacagtagaacgtgaaattaagtagagtccccttttaaacaaatttctctgtaagcaaaactatctttagtgacttaaaaaataatatcctctaaaattaccctttcaagaggaaaaaactgttcaatgaaaaaaccactcaattatgactcatataagaaatactggtttaaccaggagatatttggggagcaaaattttaaggaatttcaaattgctaaatctaatacaaatatctgacaataagatacagatctaaaagaatggttcttaagaactattgtttactgggaataaactaagctctatgaagaattcgtaagcattacatgttccagtaagtttagcaacttagagccaagactggtggccacctccatttatttccccactgctcctccactgacatccttcttagcagaaacttcatgaaaaagtttttgctgacacagaacaaacctgaaagtagtatctactttctaaatactactttgcttttcagtagtggatttgatatttataatgttctctaaagcttgcaactttttcagcaacgtttaaaaatagattaacctggaataacttacttgtttgctgctaaaatactcaagattttgccatttttaaacaaccagtccctgtgatacaactttgaaaaaacttttaaaaatctctgatgtatgggctctttttttcccataagaattatgtacatctgtgatgttttacagggggatccgcttttaaacagtgtacatattggaccacactgaaatgtcatatatcctttctctacttaaaattggttatttactgtgagttcatttccgatgtgttcttggttgttgctgttttctgcctgaagacgtgtatcataaagagctacatggtatggactatttatttgtaatttgacataaagtttgaagaataaagatctataaaagttgaagtttctgatattaaagctcttaatatattggcttt

SEQ ID NO: 36999 - DNA, 5549 bp, Homo sapiens
aggcccagccccgcacgcgccaccgctcgcgggccaatgggtggcagcctctctgcataggcaacgagtgccggccgggggtgagcgtcccaggcggttccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcgattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccgacctggtccgagttccccaagggcatcattgtgcataccatggctgcagtggaggccctgggagccaaggccagcatggaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaaacaaattagtcatggaaaattattctattccaaagtctccttttagtctagataatcattatttcattttaaaattagtgtttttcatagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtaagtctcttcatttattactgcttgtctgttgttatatctggattatcaaaagcaatagtgcaccaattaagatgtgctcaaatcaggacttaaatcataggcaccacatttttcatgtcagactagttactttgttgattctcagttactgtaggcatcaaaaggcaaaaatcaaaaaaaaaaaaacaaaaacaaacaaaaaaaaagatgaacctaggtctgtgtaaagtaaggggagtgttaggagcagccaggactgtgtagtgtgtgtttggttgcatcacaaacatcgtatgtggagacattgcaatacagtgttttttgttttcaacttttcttgtattcttgtatatttgtattatgttttgaatgcttttctcttttcataattaaatattaatgtttgggataactgccaagaagaagtaaaaatattgaatggaacttctatatgaggatgctgtgatctaaaaattaaatctcagtgggcggagagaatttgtttctgatgccttgtctttagaataattgtttgctttcagatgattaaaaaaaggagattgtatctaggaaaaaagtgtgaatgcttcaaaggagagatactgataattgtgacttgaaatagtgtcagatgaattatgtagctgatcactgatggaaccatctaatgaggcaggcttaaactctatttagtttcgtttgttttctcatatgaagtttataattcctttcagtcctaaaatgtcagatgccaggtgtcaaatgccacagtagaacgtgaaattaagtagagtccccttttaaacaaatttctctgtaagcaaaactatctttagtgacttaaaaaataatatcctctaaaattaccctttcaagaggaaaaaactgttcaatgaaaaaaccactcaattatgactcatataagaaatactggtttaaccaggagatatttggggagcaaaattttaaggaatttcaaattgctaaatctaatacaaatatctgacaataagatacagatctaaaagaatggttcttaagaactattgtttactgggaataaactaagctctatgaagaattcgtaagcattacatgttccagtaagtttagcaacttagagccaagactggtggccacctccatttatttccccactgctcctccactgacatccttcttagcagaaacttcatgaaaaagtttttgctgacacagaacaaacctgaaagtagtatctactttctaaatactactttgcttttcagtagtggatttgatatttataatgttctctaaagcttgcaactttttcagcaacgtttaaaaatagattaacctggaataacttacttgtttgctgctaaaatactcaagattttgccatttttaaacaaccagtccctgtgatacaactttgaaaaaacttttaaaaatctctgatgtatgggctctttttttcccataagaattatgtacatctgtgatgttttacagggggatccgcttttaaacagtgtacatattggaccacactgaaatgtcatatatcctttctctacttaaaattggttatttactgtgagttcatttccgatgtgttcttggttgttgctgttttctgcctgaagacgtgtatcataaagagctacatggtatggactatttatttgtaatttgacataaagtttgaagaataaagatctataaaagttgaagtttctgatattaaagctcttaatatattggcttt

SEQ ID NO: 37000 - DNA, 4980 bp, Homo sapiens
gttctttttcacattgtaaagccaagtggccaacaattaagaatttgaagtcttagaaatcagttataattccttcacaatgtggtagtcccagagtaacatctgtaagtgaaacaaaataaaaatttaaatatcttcatctttaaaaattggaaatcttggggcatttaggggaggatgagtaggtgtaatgttgattagtatgataagataactttaaaaaacataacacttatagactgtggatttaacagtttagggctcctaatgcgttattatgattcatctccacattcagagactttacatttgtagttaaatgtttgaatatttgactggctgctgcttttccttttagttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccgacctggtccgagttccccaagggcatcattgtgcataccatggctgcagtggaggccctgggagccaaggccagcatggaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaaacaaattagtcatggaaaattattctattccaaagtctccttttagtctagataatcattatttcattttaaaattagtgtttttcatagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtaagtctcttcatttattactgcttgtctgttgttatatctggattatcaaaagcaatagtgcaccaattaagatgtgctcaaatcaggacttaaatcataggcaccacatttttcatgtcagactagttactttgttgattctcagttactgtaggcatcaaaaggcaaaaatcaaaaaaaaaaaaacaaaaacaaacaaaaaaaaagatgaacctaggtctgtgtaaagtaaggggagtgttaggagcagccaggactgtgtagtgtgtgtttggttgcatcacaaacatcgtatgtggagacattgcaatacagtgttttttgttttcaacttttcttgtattcttgtatatttgtattatgttttgaatgcttttctcttttcataattaaatattaatgtttgggataactgccaagaagaagtaaaaatattgaatggaacttctatatgaggatgctgtgatctaaaaattaaatctcagtgggcggagagaatttgtttctgatgccttgtctttagaataattgtttgctttcagatgattaaaaaaaggagattgtatctaggaaaaaagtgtgaatgcttcaaaggagagatactgataattgtgacttgaaatagtgtcagatgaattatgtagctgatcactgatggaaccatctaatgaggcaggcttaaactctatttagtttcgtttgttttctcatatgaagtttataattcctttcagtcctaaaatgtcagatgccaggtgtcaaatgccacagtagaacgtgaaattaagtagagtccccttttaaacaaatttctctgtaagcaaaactatctttagtgacttaaaaaataatatcctctaaaattaccctttcaagaggaaaaaactgttcaatgaaaaaaccactcaattatgactcatataagaaatactggtttaaccaggagatatttggggagcaaaattttaaggaatttcaaattgctaaatctaatacaaatatctgacaataagatacagatctaaaagaatggttcttaagaactattgtttactgggaataaactaagctctatgaagaattcgtaagcattacatgttccagtaagtttagcaacttagagccaagactggtggccacctccatttatttccccactgctcctccactgacatccttcttagcagaaacttcatgaaaaagtttttgctgacacagaacaaacctgaaagtagtatctactttctaaatactactttgcttttcagtagtggatttgatatttataatgttctctaaagcttgcaactttttcagcaacgtttaaaaatagattaacctggaataacttacttgtttgctgctaaaatactcaagattttgccatttttaaacaaccagtccctgtgatacaactttgaaaaaacttttaaaaatctctgatgtatgggctctttttttcccataagaattatgtacatctgtgatgttttacagggggatccgcttttaaacagtgtacatattggaccacactgaaatgtcatatatcctttctctacttaaaattggttatttactgtgagttcatttccgatgtgttcttggttgttgctgttttctgcctgaagacgtgtatcataaagagctacatggtatggactatttatttgtaatttgacataaagtttgaagaataaagatctataaaagttgaagtttctgatattaaagctcttaatatattggcttt

SEQ ID NO: 37001 - DNA, 4493 bp, Homo sapiens
tcctcactttattcaggcctttgctaaacgaaactctacagagacggtctccaggcttttccatccaaatagcatctattgtcatcttctcaccttgtcttgcttcagttttcttcatagaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaaacaaattagtcatggaaaattattctattccaaagtctccttttagtctagataatcattatttcattttaaaattagtgtttttcatagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtaagtctcttcatttattactgcttgtctgttgttatatctggattatcaaaagcaatagtgcaccaattaagatgtgctcaaatcaggacttaaatcataggcaccacatttttcatgtcagactagttactttgttgattctcagttactgtaggcatcaaaaggcaaaaatcaaaaaaaaaaaaacaaaaacaaacaaaaaaaaagatgaacctaggtctgtgtaaagtaaggggagtgttaggagcagccaggactgtgtagtgtgtgtttggttgcatcacaaacatcgtatgtggagacattgcaatacagtgttttttgttttcaacttttcttgtattcttgtatatttgtattatgttttgaatgcttttctcttttcataattaaatattaatgtttgggataactgccaagaagaagtaaaaatattgaatggaacttctatatgaggatgctgtgatctaaaaattaaatctcagtgggcggagagaatttgtttctgatgccttgtctttagaataattgtttgctttcagatgattaaaaaaaggagattgtatctaggaaaaaagtgtgaatgcttcaaaggagagatactgataattgtgacttgaaatagtgtcagatgaattatgtagctgatcactgatggaaccatctaatgaggcaggcttaaactctatttagtttcgtttgttttctcatatgaagtttataattcctttcagtcctaaaatgtcagatgccaggtgtcaaatgccacagtagaacgtgaaattaagtagagtccccttttaaacaaatttctctgtaagcaaaactatctttagtgacttaaaaaataatatcctctaaaattaccctttcaagaggaaaaaactgttcaatgaaaaaaccactcaattatgactcatataagaaatactggtttaaccaggagatatttggggagcaaaattttaaggaatttcaaattgctaaatctaatacaaatatctgacaataagatacagatctaaaagaatggttcttaagaactattgtttactgggaataaactaagctctatgaagaattcgtaagcattacatgttccagtaagtttagcaacttagagccaagactggtggccacctccatttatttccccactgctcctccactgacatccttcttagcagaaacttcatgaaaaagtttttgctgacacagaacaaacctgaaagtagtatctactttctaaatactactttgcttttcagtagtggatttgatatttataatgttctctaaagcttgcaactttttcagcaacgtttaaaaatagattaacctggaataacttacttgtttgctgctaaaatactcaagattttgccatttttaaacaaccagtccctgtgatacaactttgaaaaaacttttaaaaatctctgatgtatgggctctttttttcccataagaattatgtacatctgtgatgttttacagggggatccgcttttaaacagtgtacatattggaccacactgaaatgtcatatatcctttctctacttaaaattggttatttactgtgagttcatttccgatgtgttcttggttgttgctgttttctgcctgaagacgtgtatcataaagagctacatggtatggactatttatttgtaatttgacataaagtttgaagaataaagatctataaaagttgaagtttctgatattaaagctcttaatatattggcttt

SEQ ID NO: 37002 - DNA, 5661 bp, Homo sapiens
aggcccagccccgcacgcgccaccgctcgcgggccaatgggtggcagcctctctgcataggcaacgagtgccggccgggggtgagcgtcccaggcggttccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcggttttgacacaagggcgcatatcttcaaagcacctagtacctcctaccattgtcaactgatacagaattcgttgttgggaaggactggggaaacagctgtaacatttgccaccctcagaagctgctggtcctgtgtcacaccaccttagcctcttgatcgaggaagattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccgacctggtccgagttccccaagggcatcattgtgcataccatggctgcagtggaggccctgggagccaaggccagcatggaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattgatcgtaaagcagcttttgaagaaatcttcacttagtgattacaattgtgcatttgcaaacgttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaaacaaattagtcatggaaaattattctattccaaagtctccttttagtctagataatcattatttcattttaaaattagtgtttttcatagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtaagtctcttcatttattactgcttgtctgttgttatatctggattatcaaaagcaatagtgcaccaattaagatgtgctcaaatcaggacttaaatcataggcaccacatttttcatgtcagactagttactttgttgattctcagttactgtaggcatcaaaaggcaaaaatcaaaaaaaaaaaaacaaaaacaaacaaaaaaaaagatgaacctaggtctgtgtaaagtaaggggagtgttaggagcagccaggactgtgtagtgtgtgtttggttgcatcacaaacatcgtatgtggagacattgcaatacagtgttttttgttttcaacttttcttgtattcttgtatatttgtattatgttttgaatgcttttctcttttcataattaaatattaatgtttgggataactgccaagaagaagtaaaaatattgaatggaacttctatatgaggatgctgtgatctaaaaattaaatctcagtgggcggagagaatttgtttctgatgccttgtctttagaataattgtttgctttcagatgattaaaaaaaggagattgtatctaggaaaaaagtgtgaatgcttcaaaggagagatactgataattgtgacttgaaatagtgtcagatgaattatgtagctgatcactgatggaaccatctaatgaggcaggcttaaactctatttagtttcgtttgttttctcatatgaagtttataattcctttcagtcctaaaatgtcagatgccaggtgtcaaatgccacagtagaacgtgaaattaagtagagtccccttttaaacaaatttctctgtaagcaaaactatctttagtgacttaaaaaataatatcctctaaaattaccctttcaagaggaaaaaactgttcaatgaaaaaaccactcaattatgactcatataagaaatactggtttaaccaggagatatttggggagcaaaattttaaggaatttcaaattgctaaatctaatacaaatatctgacaataagatacagatctaaaagaatggttcttaagaactattgtttactgggaataaactaagctctatgaagaattcgtaagcattacatgttccagtaagtttagcaacttagagccaagactggtggccacctccatttatttccccactgctcctccactgacatccttcttagcagaaacttcatgaaaaagtttttgctgacacagaacaaacctgaaagtagtatctactttctaaatactactttgcttttcagtagtggatttgatatttataatgttctctaaagcttgcaactttttcagcaacgtttaaaaatagattaacctggaataacttacttgtttgctgctaaaatactcaagattttgccatttttaaacaaccagtccctgtgatacaactttgaaaaaacttttaaaaatctctgatgtatgggctctttttttcccataagaattatgtacatctgtgatgttttacagggggatccgcttttaaacagtgtacatattggaccacactgaaatgtcatatatcctttctctacttaaaattggttatttactgtgagttcatttccgatgtgttcttggttgttgctgttttctgcctgaagacgtgtatcataaagagctacatggtatggactatttatttgtaatttgacataaagtttgaagaataaagatctataaaagttgaagtttctgatattaaagctcttaatatattggcttt

SEQ ID NO: 37003 - DNA, 4293 bp, Homo sapiens
aggcccagccccgcacgcgccaccgctcgcgggccaatgggtggcagcctctctgcataggcaacgagtgccggccgggggtgagcgtcccaggcggttccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcggttttgacacaagggcgcatatcttcaaagcacctagtacctcctaccattgtcaactgatacagaattcgttgttgggaaggactggggaaacagctgtaacatttgccaccctcagaagctgctggtcctgtgtcacaccaccttagcctcttgatcgaggaagattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaaacaaattagtcatggaaaattattctattccaaagtctccttttagtctagataatcattatttcattttaaaattagtgtttttcatagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtaagtctcttcatttattactgcttgtctgttgttatatctggattatcaaaagcaatagtgcaccaattaagatgtgctcaaatcaggacttaaatcataggcaccacatttttcatgtcagactagttactttgttgattctcagttactgtaggcatcaaaaggcaaaaatcaaaaaaaaaaaaacaaaaacaaacaaaaaaaaagatgaacctaggtctgtgtaaagtaaggggagtgttaggagcagccaggactgtgtagtgtgtgtttggttgcatcacaaacatcgtatgtggagacattgcaatacagtgttttttgttttcaacttttcttgtattcttgtatatttgtattatgttttgaatgcttttctcttttcataattaaatattaatgtttgggataactgccaagaagaagtaaaaatattgaatggaacttctatatgaggatgctgtgatctaaaaattaaatctcagtgggcggagagaatttgtttctgatgccttgtctttagaataattgtttgctttcagatgattaaaaaaaggagattgtatctaggaaaaaagtgtgaatgcttcaaaggagagatactgataattgtgacttgaaatagtgtcagatgaattatgtagctgatcactgatggaaccatctaatgaggcaggcttaaactctatttagtttcgtttgttttctcatatgaagtttataattcctttcagtcctaaaatgtcagatgccaggtgtcaaatgccacagtagaacgtgaaattaagtagagtccccttttaaacaaatttctctgtaagcaaaactatctttagtgacttaaaaaataatatcctctaaaattaccctttcaagaggaaaaaactgttcaatgaaaaaaccactcaattatgactcatataagaaatactggtttaaccaggagatatttggggagcaaaattttaaggaatttcaaattgctaaatctaatacaaatatctgacaataagatacagatctaaaagaatggttcttaagaactattgtttactgggaataaactaagctctatgaagaattcgtaagcattacatgttccagtaagtttagcaacttagagccaagactggtggccacctccatttatttccccactgctcctccactgacatccttcttagcagaaacttcatgaaaaagtttttgctgacacagaacaaacctgaaagtagtatctactttctaaatactactttgcttttcagtagtggatttgatatttataatgttctctaaagcttgcaactttttcagcaacgtttaaaaatagattaacctggaataacttacttgtttgctgctaaaatactcaagattttgccatttttaaacaaccagtccctgtgatacaactttgaaaaaacttttaaaaatctctgatgtatgggctctttttttcccataagaattatgtacatctgtgatgttttacagggggatccgcttttaaacagtgtacatattggaccacactgaaatgtcatatatcctttctctacttaaaattggttatttactgtgagttcatttccgatgtgttcttggttgttgctgttttctgcctgaagacgtgtatcataaagagctacatggtatggactatttatttgtaatttgacataaagtttgaagaataaagatctataaaagttgaagtttctgatattaaagctcttaatatattggcttt

SEQ ID NO: 37004 - DNA, 3264 bp, Homo sapiens
aggcccagccccgcacgcgccaccgctcgcgggccaatgggtggcagcctctctgcataggcaacgagtgccggccgggggtgagcgtcccaggcggttccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcggttttgacacaagggcgcatatcttcaaagcacctagtacctcctaccattgtcaactgatacagaattcgttgttgggaaggactggggaaacagctgtaacatttgccaccctcagaagctgctggtcctgtgtcacaccaccttagcctcttgatcgaggaagattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccgacctggtccgagttccccaagggcatcattgtgcataccatggctgcagtggaggccctgggagccaaggccagcatggaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgtttta

SEQ ID NO: 37005 - DNA, 3755 bp, Homo sapiens
aaatgagatggggtttcgctctgttgcccaggctggagtgcagtagcacgatcatagctcactgcatcttcagatctcctgggctcaagtcatcctcccacctcagcctcctgagtaactggtactacaagcgtatgccactatacccagcttatattttttatttctattaaaaaatatttttaagttacttattttagagacaaggtctcgctatgttaccgaggctggccttgaattcctggcctcaagcgatcctcctgcctgagctttcagagttactgggattacaggcatgagccatcatgcctggctctaactcgttttcaatgacagaatatgtattctattttgttcctatatcatattttatttaactcattttcctcttgatggggacttgttaaatagtttattgttttacttatgtttgtattttgaggaatagattctttagaagtgacattcatggttcacttgttggttgtgcattttgatggatacgcaaaaagtggggaagttacaccatttgctaagaacttaaataccttttcttcttttctttttttttaatcatcttagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgttttaagaagttgagatcttgtgaatatatgcctgtcagtgtcttctttatatatttattttttattagaaaaaatgaagtttggttggtgatgcatgaaacaaaatagcaagagagggttatagtttaatagtaagggagataacacagcatgtgtagcaccagttgataattggtctctagtagcttactgtcaaaatgttcaatgaagtcttctgttcatctgttgaaactaggaaaatacccaaacttaaatggaagaattctgaaagagaggatagaatttaaagaacaagagtatataaagttattctttgaatatttcgttgactatatgtacattgagttatctatatttgtaaacaaattagtcatggaaaattattctattccaaagtctccttttagtctagataatcattatttcattttaaaattagtgtttttcatagtttgcactgatgcgtgtatggatgtgtgtgagtcagtggtagcttatttaaaaagcaccttatcctttctcccataacctttgtacactaaaaaatgaaagaatttagaatgtatttgatgatagcattctcactaagacacatgagaatttaactttataaccgcgtgagttaagatttaattcataggttttgatgtcattgttgaagttatttgtaattcagaaaccttgcttgtgtgatacatagtaagtctcttcatttattactgcttgtctgttgttatatctggattatcaaaagcaatagtgcaccaattaagatgtgctcaaatcaggacttaaatcataggcaccacatttttcatgtcagactagttactttgttgattctcagttactgtaggcatcaaaaggcaaaaatcaaaaaaaaaaaaacaaaaacaaacaaaaaaaaagatgaacctaggtctgtgtaaagtaaggggagtgttaggagcagccaggactgtgtagtgtgtgtttggttgcatcacaaacatcgtatgtggagacattgcaatacagtgttttttgttttcaacttttcttgtattcttgtatatttgtattatgttttgaatgcttttctcttttcataattaaatattaatgtttgggataactgccaagaagaagtaaaaatattgaatggaacttctatatgaggatgctgtgatctaaaaattaaatctcagtgggcggagagaatttgtttctgatgccttgtctttagaataattgtttgctttcagatgattaaaaaaaggagattgtatctaggaaaaaagtgtgaatgcttcaaaggagagatactgataattgtgacttgaaatagtgtcagatgaattatgtagctgatcactgatggaaccatctaatgaggcaggcttaaactctatttagtttcgtttgttttctcatatgaagtttataattcctttcagtcctaaaatgtcagatgccaggtgtcaaatgccacagtagaacgtgaaattaagtagagtccccttttaaacaaatttctctgtaagcaaaactatctttagtgacttaaaaaataatatcctctaaaattaccctttcaagaggaaaaaactgttcaatgaaaaaaccactcaattatgactcatataagaaatactggtttaaccaggagatatttggggagcaaaattttaaggaatttcaaattgctaaatctaatacaaatatctgacaataagatacagatctaaaagaatggttcttaagaactattgtttactgggaataaactaagctctatgaagaattcgtaagcattacatgttccagtaagtttagcaacttagagccaagactggtggccacctccatttatttccccactgctcctccactgacatccttcttagcagaaacttcatgaaaaagtttttgctgacacagaacaaacctgaaagtagtatctactttctaaatactactttgcttttcagtagtggatttgatatttataatgttctctaaagcttgcaactttttcagcaacgtttaaaaatagattaacctggaataacttacttgtttgctgctaaaatactcaagattttgccatttttaaacaaccagtccctgtgatacaactttgaaaaaacttttaaaaatctctgatgtatgggctctttttttcccataagaattatgtacatctgtgatgttttacagggggatccgcttttaaacagtgtacatattggaccacactgaaatgtcatatatcctttctctacttaaaattggttatttactgtgagttcatttccgatgtgttcttggttgttgctgttttctgcctgaagacgtgtatcataaagagctacatggtatggactatttatttgtaatttgacataaagtttgaagaataaagatctataaaagttgaagtttctgatattaaagctcttaatatattggcttt

SEQ ID NO: 37006 - DNA, 2867 bp, Homo sapiens
aggcccagccccgcacgcgccaccgctcgcgggccaatgggtggcagcctctctgcataggcaacgagtgccggccgggggtgagcgtcccaggcggttccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcggttttgacacaagggcgcatatcttcaaagcacctagtacctcctaccattgtcaactgatacagaattcgttgttgggaaggactggggaaacagctgtaacatttgccaccctcagaagctgctggtcctgtgtcacaccaccttagcctcttgatcgaggaagattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccgacctggtccgagttccccaagggcatcattgtgcataccatggctgcagtggaggccctgggagccaaggccagcatggaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcaaggcaaactccattcctcatattaaactattacttctcatgacgtcaccatttttaactgacaggattagtaaaacattaagacagc

SEQ ID NO: 37007 - DNA, 3210 bp, Homo sapiens
aggcccagccccgcacgcgccaccgctcgcgggccaatgggtggcagcctctctgcataggcaacgagtgccggccgggggtgagcgtcccaggcggttccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcggttttgacacaagggcgcatatcttcaaagcacctagtacctcctaccattgtcaactgatacagaattcgttgttgggaaggactggggaaacagctgtaacatttgccaccctcagaagctgctggtcctgtgtcacaccaccttagcctcttgatcgaggaagattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccgacctggtccgagttccccaagggcatcattgtgcataccatggctgcagtggaggccctgggagccaaggccagcatggaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcagcaagtctggaaaagtttgaaattccagtaaaaattcgtttgagtcctgaaccgtggacccctgaaactggtctggtgacagatgccttcaagctgaaacgcaaagagcttaaaacacattaccaggcggacattgagcgaatgtatggaagaaaataattattctcttctggcatcagtttgctacagtgagctcagatcaaataggaaaatacttgaaatgcatgtctcaagctgcataactgacaggattagtaaaacattaagacagcaaacttgtgtctgtctcttctttcattttccccgccaccaacttactttaccacctatgactgtacttgtcagtatgagaatttttctgaatcatattggggaagcagtgattttaaaacctcaagtttttaaacatgatttatatgttctgtataatgttcagtttgtaactttttaaaagtttggatgtatagagggataaataggaaatataagaattggttatttgggggcttttttacttactgtatttaaaaatacaagggtattgatatgaaattatgtaaatttcaaatgcttatgaatcaaatcattgttgaacaaaagatttgttgctgtgtaattattgtcttgtatgcatttgagagaaataaatatacccatacttatgtttta

SEQ ID NO: 37008 - DNA, 3081 bp, Homo sapiens
aggcccagccccgcacgcgccaccgctcgcgggccaatgggtggcagcctctctgcataggcaacgagtgccggccgggggtgagcgtcccaggcggttccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcggttttgacacaagggcgcatatcttcaaagcacctagtacctcctaccattgtcaactgatacagaattcgttgttgggaaggactggggaaacagctgtaacatttgccaccctcagaagctgctggtcctgtgtcacaccaccttagcctcttgatcgaggaagattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcttgttacattatatgccactctaggaggtccagccattgttcatgcattaaatgaaacagaggtgaccaacatcattactagtaaagaactcttacaaacaaagttgaaggatatagtttctttggtcccacgcctgcggcacatcatcactgttgatggaaagccaccgacctggtccgagttccccaagggcatcattgtgcataccatggctgcagtggaggccctgggagccaaggccagcatggaaaaccaacctcatagcaaaccattgccctcagatattgcagtaatcatgtacacaagtggatccacaggacttccaaagggagtcatgatctcacatagtaacattattgctggtataactgggatggcagaaaggattccagaactaggagaggaagatgtctacattggatatttgcctctggcccatgttctagaattaagtgctgagcttgtctgtctttctcacggatgccgcattggttactcttcaccacagactttagcagatcagtcttcaaaaattaaaaaaggaagcaaaggggatacatccatgttgaaaccaacactgatggcagcagttccggaaatcatggatcggatctacaaaaatgtcatgaataaagtcagtgaaatgagtagttttcaacgtaatctgtttattctggcctataattacaaaatggaacagatttcaaaaggacgtaatactccactgtgcgacagctttgttttccggaaagttcgaagcttgctagggggaaatattcgtctcctgttgtgtggtggcgctccactttctgcaaccacgcagcgattcatgaacatctgtttctgctgtcctgttggtcagggatacgggctcactgaatctgctggggctggaacaatttccgaagtgtgggactacaatactggcagagtgggagcaccattagtttgctgtgaaatcaaattaaaaaactgggaggaaggtggatactttaatactgataagccacaccccaggggtgaaattcttattgggggccaaagtgtgacaatggggtactacaaaaatgaagcaaaaacaaaagctgatttctttgaagatgaaaatggacaaaggtggctctgtactggggatattggagagtttgaacccgatggatgcttaaagattattgatcgtaaaaaggaccttgtaaaactacaggcaggggaatatgtttctcttgggaaagtagaggcagctttgaagaatcttccactagtagataacatttgtgcatatgcaaacagttatcattcttatgtcattggatttgttgtgccaaatcaaaaggaactaactgaactagctcgaaagaaaggacttaaagggacttgggaggagctgtgtaacagttgtgaaatggaaaatgaggtacttaaagtgctttccgaagctgctatttcaggtgagtattcggttaaactgatactaaaaactgagatgggaagagagtacttacatgcattcaacctgttttaaggtttagggttcattactttctgctcagaaaccatttctaccgttagtatatggaagagtaaacttatcagtcccccattcaagccttgctacacaaattaaccactcccaccaaactgatgtacatgtatcttgaatgttcttgtctctgcaacctttgctttctgggttaccctttctcttatgtcagctgttcttcaaggccttgctcagttttctggccacactagcccatagtgatcaggccaaaactccttttgaaactttatacaatgttagagtactggtagttggttgtactaatagtttcataaccatttttggtggggtgaggagtgcccaagactagtttaatattgttggtctaataaaaacatctgtgtcttttgagttgttgtgtcaagcataaaacaagcgtgaattattttttattttatttatttttttaagagacagggtctcttc

SEQ ID NO: 37009 - DNA, 1278 bp, Homo sapiens
aggcccagccccgcacgcgccaccgctcgcgggccaatgggtggcagcctctctgcataggcaacgagtgccggccgggggtgagcgtcccaggcggttccgctcaacagacgctgctgtggctgcgccgggctgcgacactgcagttgtctacgcggccggggccgggacgaggaggcgttggacggggtcgcatacgttcgtcccctcgcattgcggccccgacagctgcgccaggatccccgggcggcggcgcggggcgtgaacgctctggggctcagccaggcctgcgcgggcccgaggccggaggaacccggactccggcgtagcggttttgacacaagggcgcatatcttcaaagcacctagtacctcctaccattgtcaactgatacagaattcgttgttgggaaggactggggaaacagctgtaacatttgccaccctcagaagctgctggtcctgtgtcacaccaccttagcctcttgatcgaggaagattctcgctgaagtctgttaattctactttttgagtacttatgaataaccacgtgtcttcaaaaccatctaccatgaagctaaaacataccatcaaccctattcttttatattttatacattttctaatatcactttatactattttaacatacattccgttttattttttctccgagtcaagacaagaaaaatcaaaccgaattaaagcaaagcctgtaaattcaaaacctgattctgcatacagatctgttaatagtttggatggtttggcttcagtattataccctggatgtgatactttagataaagtttttacatatgcaaaaaacaaatttaagaacaaaagactcttgggaacacgtgaagttttaaatgaggaagatgaagtacaaccaaatggaaaaatttttaaaaaggttattcttggacagtataattggctttcctatgaagatgtctttgttcgagcctttaattttggaaatggattacagatgttgggtcagaaaccaaagaccaacatcgccatcttctgtgagaccagggccgagtggatgatagctgcacaggcgtgttttatgtataattttcagcgtatgtagactttcttatcttctggaagaatgaacttaactgatatttattgaaatactttactctgaagaggttaaaattctgatgttaattttcacccagtgtccagttagtggagaactctgttgtgacttggaatttttggtttattttggaaaataaatcaattatatgacaaattgtac

SEQ ID NO: 37010 - DNA, 226 bp, Homo sapiens
aataatttgatagcaaattacttagagaatggccagtatttatatatgtattaaatgttactaatattattactcattgttttcccctctccacctttctttgttttgcagatcgtaaaaaggaccttgtaaaactacaggcaggggaatatgtttctcttgggaaagtagaggcagctttgaagaatcttccactagtagataacatttgtgcatatgcaaacag

SEQ ID NO: 37011 - DNA, 799 bp, Homo sapiens
cacctacagttgagctgaggctgcagggcattaacttgggcctagaagatgatggtgttgcagatgaatctgtgaaagggctggaaagccaggtgttggataaggaagaggaacagcctttatgggctgcaaatgagaattctgttcaaatgatgagaagtgaaatcaatacagaggtaaatgagaaagctggactattaccttgtcctgagccaacaataatcagtgctatcttgaaggatgataaccacagtcttacattttttcctgagtcaactgagcagaaacaatcagacataaagaaaccagaaaatacacaaccagaaaataaagaaaccatatctcaagcaacttcagagaaacttcccatgattttaacccagagatctgttgctttgggacaagacaaagttgcccttcagaaattaaatgatgcagccaccaagcttcaggcctgttggcggggattttatgccaggaactacaaccctcaagccaaagatgtgcgttacgaaatccggctacgcagaatgcaagagcacattgtctgcttaactgatgaaataaggagattacgaaaagaaagagatgaagaacgtattaaaaaatttgtacaagaagaagctttcagattcctttgggaaccaggtaaggtctctacaggtttggcaacagacagtggaccagcgtctaagttcctgggcatactgatgttcctcctatatcaagtactcttgtgccatcgaaacatccattatttacccaaagccaggagtcctcttgtgatcaaaatgctgat

SEQ ID NO: 37012 - DNA, 1568 bp, Homo sapiens
ggagaaggttgagtcaggtagcagaaagaccaagtgccacatccagcctgcttttccctttactagctgattctgccaaacctgactgcctgctgaccctggtgagcatgcctcagccactggggggctttcctgcagtttccccttgtcctctcccctcgcctggtgtgctgagggcgtcttcactggctgcaggctcctgggctttgttcccttgctggcatcaaggattggaaagcctctttctcccccatcttctgacgttggtcaaggctcaccattccacctctgccaaggagctccaggcgctctgagctgtctgctttctggcttcccactgagagtgcaagagctcacctgaggactgtcctgtgcctcttctcttgggctgtgctgcaggaacccaggcttgtagctcattccttatcccagcagaatgcccagagtggttcctccatcgcctttctggaaacaggatgcatctctggcctggccacacactgaagattcacaggctagctccttcatcaggaaagaagttcatcttcattgctctcgaggaaaggaagaaattgcagagtggtgaagatgtattttgtctttactcagtgaccacaagcacacaggggccaaatagataacaccatgttcctctcagtttctgcctggaatcctcgacttgaacggtagcattcacttgaaaccaagccccgaccattgaagggagagtcatttggcaaagttcctgctgaaactgccatccacttatgtctaagtggcattctggctccagccatccttccagatttccccgatatctgagccctcactgctgccaccagagccgccctgcttcttggccctgcctgggtttgaagacagctcctcagctgggctgcatgtctaaggaggtcttgaaggctcgatgccacagcagtccctgtctctggcaacaagtagccttggcttttgctgtcttgcccaaatcactctgagctttcttcagtggtgtgagcatcttgaagaatgaatgttgaggtctgcctatcccccagggtagcaggtgagatggggccggtgcatgtctattccagttcactgttgcagaactgagaaatgtgcggggactttctcctctgtgttcgctgcgttttcagcagccagtgctgggcacttagccttcttgcataggtgcggaaagctaaccggagttcctgttccttcctccgtgctggtccccgcagggcttgtggtggaggaccctgtggccatctcaccaactacaccgaaacgcatctgacttctgacgccacgcccgtgtgcggtgcagcctccctgctgggcccaggcctggccgcttggagatggtgccctcatcgtcctgggccttccaggctgcagagggtgcggggagcactgaggaactgcatagatggctgtgggaggtggtggcttttaaaaaattgtggtaaaatacatataacataaaaatatatgttagccattttaaaatgtacaactcaatggcactaggtataatacattcacagtgttacgtgaccatcaaa

SEQ ID NO: 37013 - DNA, 759 bp, Homo sapiens
gtccagggattatacaggtgtaggctactgggcctggccctgaattttttattttaaaaaattaccacagtatttccattcctttttttgacccatttacgttaatttcctaccggattctccttctttctccttcttttcaaaccctcagaatctctgtcagcattgatttatgaaaacattcttgatttataaagacattttaactcaattcaaacagtttaaaaataatcagagggtaagctgaaatacaaatacacatttagtttacaactcttgatgtatccttacaaatgaccactatgttgcagaaatgagggaaaattcactacatggtagaacagtgataggtggaagtttattgctagatcccaggaggaatgaaaagctaaaaggatgagagagaagagctagatatggaggacagggaacataaagctgtgtaacatatggataactcattttctgaagcataaaacaaaaactagaaattgctggcaaaacaataatcagagagatgctggagaaaacttctgcactaaaaaatacttgtgtgtgcaaactgctatattctaggaagaaaaatactcgatgtaaaaagacttacaaatctcagtctagcaatattttttaatattaaagataaaaaattaatcttgtaaatatccaggcagagaaaataagcttccagaagaatagttcagtttgttaagactgtaaagaattagtagcacccatggctatttaaggaaaaaaaaa

SEQ ID NO: 37014 - DNA, 756 bp, Homo sapiens
gcttcacattcagcccctgccctgagacaaatgcattattttcatcagccctgggtgcttatttttctaagctctcattttattactggagtcacaatttgtgtgtaggtgttgccgacaaaaatgataattaactttcccttgaggtgacacataactaaaatttcaaatctttagtatttctccctttcattttaaattcatatgcctaactataaaataactgtgactgagatacaagtacaaaccaaagcctggaattgcagcaggtgctgaggcatttgaaagtgaaatgtttctcttcgcaaaggactcttataccctcccctaaagaaatcaccatgccggtctcacccctactggctttgttacctaaggcttcacctctcagtgcttctggttccttccttatccttaaaatgagtgttaataattctctcgtggggtcattgtgcggaccacattgagtagtgcctgtaaaacagtgctggctacacggtaaatactcaataaatgttgacacgtttattacctgtctttaaaaatcactgggaagtgccagtgggagtcttgagtataaaatttctaaatacggagaaatgtttccctgtcagctctccgaatggatgcgctggcttctggacacctcatgccagcccatccttcctcctgcttgtctcagataattcaaatatttgttggataaacaaacaaacgagtcacgtgtgccttgtatcacaaattatctggtcgacg

SEQ ID NO: 37015 - DNA, 653 bp, Homo sapiens
cgcctatctttagcttggaggtatttctggaggggtcttgatcattagttctttagttctgcttgatccttgtagaagtctctcttaactcagagtgggagctgggcaggtttgagggcagagctgcaagttgtgatgattgtgacagatgggttggtcccccatggctcagaactaggtgtttcccttcaggtgcagcatcctgttcgctgcagtgggcgggccggcagggaatgcacatagccatctctattcagtaggtgttagatgaaagaatagctggtggcacttgctttgaggaacatcaccatttcccagaccaaatgtggttgtggccattcccttccagtctcttcttgaaaacccactccttgcaggaaatgcagtgattgggagcaatccttgtacagagtgaggatcgagagaaatttttttatgattgatctacctaggtttgccctccctggaggtttcaccagatccatttcccagtaaagattttgcaaaaaatttttgttctaacccagagggacatccagagaagattgaagcccataaacacaagccttttaaatttatttttatttgtttattttttttgagatgatgtctcactgtgctccagcctggggacagagtgagactccatctca

SEQ ID NO: 37016 - DNA, 183 bp, Homo sapiens
gtgaaatctgttgctggtctgctctgcaggtactgaagtttccttgccaggagctgcagttgctttacttccactacaccgagccctgcatggattcaagctggcatatttagaaagcagagtcatcttaaatcaaccaggaatccattcatttcagagcagtgggagaatcctgtttttatt

SEQ ID NO: 37017 - DNA, 363 bp, Homo sapiens
ctttgtgatatctccaaatatgaggaagagtaatatcacctagataactctaattagagtgtccaaattgtgagtattaaagggagactcttgaagttgctgcctccagttgaatgtgaaatgatgtcagttaccttgttctgacattacgagagactttgctgacaacaaataattgcatcatgtgctatagaattaaagtctcggccactttggcttattgttaacaggcctgaactgcacaatattaccttcatgccagagaatgaatcacagcctttgtggatcctggttctaaatttttaatgttttgaacaaatggcttatgaagcatgtatccagccattagaactttgacttgcc

SEQ ID NO: 37018 - DNA, 844 bp, Homo sapiens
ctagggcggggcgaggggaggacggctacgagctgtcaggagcctccagctttccccgtgacgaagctcaccctcgccctgatgtcgccactcacccagcagcgggctgcgagctggagcagacgttaacaccgagggaggactgaagggaacgtcttgatttttctccttaatttgccacagacacagggaaaaaaaaaaaaaaacaaaaacagcagacgcagctctacctttgcgctggctttaaagcttttaagctccccacgtcatcctaccccatgcaacagacttaccgaatagcaatgcccaccccacacacctgctaggtaactcgccttctggaaacctgcgcctggggtggggttgaagagacactgtctggtatcctaaagtcagagggcgtgaggagaccggcgcccttcgccccacccaggcgcgctgcaccctccggtccccgtctctagagtgcaccaaggcatcctgcgtcctgccggagaaaagagggtacggggcagaggcccgagttccagggagttgctgattccagtggagaaccgagacaccgcgtcctttctaattaataagcacgccaccccctacctccaacccccccccccgccccgcctttatttcttgttgacagcaaaggtgggggacgtgggagaaaggcaagagttgtctctaggttcgggatgttgggctgcgcggagggaagaggtgggatctcgaaatggaaacagtccccccttcctcccccctcccctcctcctcctcctcctcctcttcttctgtttacctcaagtttgaattttatctgcgcaacattagctggaatgcggacatt

SEQ ID NO: 37019 - DNA, 411 bp, Homo sapiens
tctacctttgcgctggctttaaagcttttaagctccccacgtcatcctaccccatgcaacagacttaccgaatagcaatgcccaccccacacacctgctaggtaactcgccttctggaaatcgggggccccacccaccccgccttctggaaacctgcgcctggggtggggttgaagagacactgtctggtatcctaaagtcagagggcgtgaggagaccggcgcccttcgccccacccaggcgcgctgcaccctccggtccccgtctctagagtgcaccaaggcatcctgcgtcctgccggagaaaagagggtacggggcagaggcccgagttccagggagttgctgattccagtggagaaccgagacaccgcgtcctttctaattaataagcacgccaccccctacctcc

SEQ ID NO: 37020 - DNA, 1205 bp, Homo sapiens
ggtaataggatgtgtaaagtctacttgggtttgtaagaccagcctttggttgaagaccttccttgggtcctagcagacagaaaccaggagagacagagacatctatatccggctacatagagaggttatctgtctaactctctgcctgttctctatctatatctgtctgtctgtctgtctgtctacctacctacctgtctctgtctgtctgtctgtctacctacctacctatctaatctacctacctacctacctatctgtctgatctacctacctacgtacctacctacttagaaattgagagatttactttgaggattgacccacatgattgtggggactagccaagtccaaaatctgcaggctggagatttagggagagctgatgttacagtttgagtctgaaggcagtctggaggcagaatttcttccttgagagagacccagtttttttctcacgaggccttcagctgattaaatgaggtgtatgtacccacagtatacaggttaatctactttattcagagtctactgatttaaatgttaatctcatttagaaaatcccttcatacatacatctaaactagtgttagatcaaatatctgggtactgtggctcatccaggctgacccataaaattaaccatcacacctgtgcaagcgcttttccctcctggatggtgtcctagggatgacagaggaggggaaagccaggtctctgcttcaaggagacaaaattatgcatacgaagaaattaagaatgctgctgtgtctgtggagtagccattcttttattcctttactttcttaacaaacttgcttttacttaaaaaaaaaaaagaaattaagaacaagaccatttatatttaagtgccaacttatgaaatgtaaaaagggatttagaggtgacaaggcaagtgagggctggaggatttggagagatttcatggtgtagggactgaataggagcttccagaacatggaggtttcagataagtgaggacacagaagtcttcacaaccagagtgggcaccacaggacaattctacatctatctaggactctgagtttttgaagggtttccatatgcattgtttggtttgctgcttgcaacaaccctgttgttttaactgaaggtcttagggcctagggattccccagaggccacacaacttgccagtggcaggggaaggtcttactcttcca

SEQ ID NO: 37021 - DNA, 7004 bp, Homo sapiens
  misc_feature (3894)..(3894): n is a, c, g, or t
agctactttgaagaaacctatcagagtagagggccttcattctgcttctggccttactctcacttgccttgggatctttatcaagtctgttgaatatctttgcactttagtgtctatatctgtaaagtggaaaatttttgtgtgtggttttttaaatatctcttaaatcctgataaacagctaaacagtatcaaaaggcagctaaattgtataaaaaaatacctgcaaaaaccatacaaatgcttaccagaaaaggcagtggcccattaccagcaggccatcaaacttagccccagtcatcacgtggccatggtgaacttgggaagactctacaggtcactgggagagaacagcatggctgaagaatggtacaagcgcgccctgcaggtggcacacaaagctgagatattgtcacctttgggagcactgtattacaacactggccgatacgaagaggctttgcagatttaccaggaagctgcagcacttcagccttctcagagggagctccgcttggcactggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggcacttgatgctatagacaaggctctccagctgaaaccaaaggacccaaaagtcatttctgaactttttttcacaaaaggaaaccaattaagagagcagaaccttctcgacaaagcttttgagagctatagagtggctgtgcaactaaacccagaccaagcacaggcctggatgaacatgggtggcatccaacacatcaagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggggagtgatggaagccttgctttcacatcagcaggggcacaactaatgagattttctctcattccgagttcagggtgacacattttgggacatctgctggtagcccagtgctgaaggacttgcttttccatgaagaagacgaaaacagcaaacaagggcaagaaggtctgagagggaaggagaatgacatttacacattttacagatttttgtttggtttaactccagatttctcttgatatatctctgtgcttttgagacctggagatctaattctgtttagacattttttgtcccagaaatacagaagcttgaaatgctatgaaggcagagcttctattctttatgggatgaaatatttcaaaagaggataaatcctctgtggtaagccatttggaaaatcctaccaagaattggcttatttaattttccagaaccaggaatgagtatctaatagcttttgtagaaccttccagaatatgtggggaaaaagggctattgctaagtgagctttatctaatatcctcctaagagttttactagtgcttttttgaggaattacagggaagctcctggaattgtacatggatatctttatccctagggggaaatcaaggagctgggcacccctaattctttatggaagtgtttaaaactattttaattttattacaagtattactagagtagtggttctactctaagatttcaaaagtgcatttaaaatcatacatgttcccgcctgcaaatatattgttattttggtggagaaaaaaatagtatattctacataaaaaattaaagatattaactaagagaaatgtcctactttattatcttaatgttcagacatcatgagatttattatttttttgaaaaatatattgaaccattgaggaacctttatgatgtatcacagaaatcttcatagattctaactagatggaaaaagagctctatttatttgtgttcctaggcttaatgagaattctgggcttagaacatcaacgattaatacccagaattctttgttttgagaatattatggagaatgctctaaaaatctagggtaaagatctaaattcaaattttaaatatatatttatatttaagaaataggaaaggcaaagttgaactcacaatttgacatttatttttagtgttatttatttcataacttataaaatatttaatatatacatacacactcttcttttttctctgtacaaagtggttttaatatcagctttcaaaactgatcttataaaatgtaaatctaaattgtaaaatagttaagttttaacagtccctcccaaactttgtgttgattattcacttgctaaagagatgtgaggaatcagccttcagttttttggcagtagtatattttggaagtgaagaaattggaacacctgtttctaatttggtcttcatcattagagacaaaaccaaaacactccaggcagtactgtttatagtgctgagccaggtagcacacagacatagtagcctaaaggctcacataattcgcatgctcaggccagggcagggtaaaaatagccttctgcttctttcaacccagtatcaggaagcactaccccagtgttattatttgttttgtcaaggtaagtctaaataaacaagaaaaacttcttcggaaggcatggcgaagggagtattttaaatgaaaatgattacagaatttgaattagcatgcatctctttgtgtgcaacagtaatccaagaatgtatatgttaccactacaaccatttgtttctaatagttttttcatgttatataacataaatgtatccacaaccttaattaagaactattcttcccccaaaatcatagtcctagtgtcaagaaacatactccagtgtttattgtaaaataacaaccacaccctcaaattgaaaaaagtgaatgtctaggactttattacaacttttcagaataatctgtaatgaaaactcatgcttaaaaatttaatggaaaagactgagccccaaattttgaatagtgattacgccttacttgaagtgctaataaaggtaggagagtacatttgttggaataacagaaatggtgatttcagcctaaaagtttctgagggtaaaggatcacatgaccttcaggaaactctctgcctcctgtaggtgctttcctatctcccccatccttccctaccccttttcccttttccttcctctctttttctctcactgtcactctgtctacacacactggcatcttttgaacactaaaagtaagcactgttttttaaaaaagtaattatttgttggatcagatacttttatcccaagtgaataccttcactgagatgtggccaatgcaatagtttcacagtaaaaacagtgcctataagaaaatagatcacatactatttttcaatgatattaagtgtattttgtaactattttcatttggtccttgtaacatgaaataatacatggaacttacctttataataaaaatggagtgccctggttcatcatagaggtgcatctagtttgcccttaatggaagtatacttgctgtgtggattgatagcaccttcttgaaatggaggagctcagctggcctcatggatgtgcaatttttgcagtcccacagggccttgcatacagaagcaccccgagctcagttgaatgtctgtttgattttttcttatttatttttttgagacacagttccactttgtctttttgtcacccaggatggagttcagtggcacaaacatggctcactgtagcctcgacctccctggctgaagggatcctcccacctcagcctcccaagtaaccgagactacaggcatntgccagcatgtccagctaatttttgtattttttgtagagacagggtttcaccatgttgcccaggctggtctcaaactcctgggctcaagcgatctgcccacctctgcctcccaaagtgctgggattaaaggcataagccaccatgtccaactgaaattcttaataattaataatttttgagcaagaggtccacactttcattttgcactgggttcccaaacaggtcctgggtaggaaggatggctgaggataaaacaggagttgctttggcctggctgaacatttgaaccaatgatcagagtttcattttatgattgtgttactctgaacagatttgctatttttttccagctacatttagagttcctcatgtatatatcacccctctttttccagtccatctaacctctccttttttttgtgcctagaatcagttctccttgccttcaaaatccctgataagtgtccatttctttttgtatcctttgatgtagaagccacaagaatggctttagcagcttattttaatcttatgaattattcattcaggattttttaaatgattcagatgctttcagtctgttaacagtatttataaaacatgtttcagtgatacaacataggtgaactaaaccaaagatgcaaatgccttggaggaaaagaaattgtattatagagaatcctgagatatatccttttgggttgtttaatttaaagcctatcacaaaacaaagagaattgtcgcactttaattccaacctcctgcagtacttcacaacccttagcataagattctgaaatttgtaataggtggtacctagtttgatgcagggttttgcagcagttgtgcgaatgcctctgcgcaacggcctttcagtcagactaaatgagaaaatccaaactgtcctatcaaaactgacccacaataactgtactctgaggcgaaacagagcaaatgtgggtttcctgttttcattgtaaaacattccaggttctcagattgaagagctacattcagctgatagttgacatctgttccctcacacgtagtggctctcaacacgggctgcactttggaatcacctgaggacctttcggaatcttcggttgaatcatcctggctgtcctggtgatgcttcttatgtgcagctaggctggagaaccactacagggctgacacctggaatgggagcttgtaacttttacaaaataatagatgtttatcatcttttgcaatttttacttttaagtctatactaaaatgagccaaagaagtcttaacaatgatgtatggcacaattggttggttgaggctatcattccatgattacaaataggtggttatgtggggtggttttgcacttgtggcaattggactgcaatttggccttaaaatgacacaattcctcgttctcagatggagaggaattgccttgaaatttgcatgtaccagactaagtgccagtatatatatgactgatattttcgtgactcatagaaggtgtccatggtatagagtttatgcctacatctctatctttattttgggcacacatgagcttttgttaattatttctttgtacttgttagaatctgtttttgaaaaaaaaaaaaacttttgctttgatttgtggtggattcaccttcttaaaataataaatttagaggatattaggaatgacattcaaaacaaatatagtgagaggtgattttttaaaaatttttgttcctggtttccaaattatgtttactttgatttgattatatgttggtatctcccaaatataggttaacttagctatttaaatggtatcttttgacatttaaaaagaattaagtacctgtcaaatctagcattgaggttgcagttgaataagataaaagcttaggatgtcaaaaaataatatagagaaatattataagattttatgattattcttgacgtttttgatgcaaaaggaaaatatgctgaatagttcttccaaaaaatattatttccctcaatattttatttgtagccatgtaatttaaagagaacagaaaataactgcaatcaaaagtatggtttaatatcaatcaaagtggcacaacagaattgataagatctttataacaatcaattggctgatattaaaatattgattttaattgatcttttcaattaaaatctttagggcctgtaactcataaaatcagcatccaccacaatatatggtcattattggtttgtaagcatagatcaccattgactcctacctggagagacatgtctatttctaaaaatccagtagtttctttgcattctcagtagtacacgttgtatatatatatatgtaacaaatttggtagttttcagtatgtgtgatgtcctttgggggttatttatcttgctggtccataggaggggtacactaccccaagaatcaagacatctgagttctagttctagttctagctctgccactgaagagccaccttacctggggcaagttagccattgtctcccagtcatgtttaccacccatgaaaggactcgtcggtttgatgtttccattaagctcaatgagtaactctaatagttactcttgaatctggattgaaaaacaccatgcatctgatgagataattcataaatgttgccccttttttaaatgatacaaccctaaaagtgactgaattgcccaagtgcttgaacatggcagaggtagttactcttattttgcagtttgtgcacttaaaaattcctacagtgattgttactttactggggaaaaaagatgaggtgaaacttcctcccaaggaattaaaatatctgtagaagccatggcttgcttttataatgtggaaatcatttgatttgctgtaattcacgcagatccctccttttgtcagggggaaatgatttgcatcatgttcttttttcataatgcttttacttcctgtttggatcagttgtatgtaaatgtacatttttgttactttggctgtgcccgttagaatttatcttccataaagtatttctcccattgagtctaatgatgtatactttgcctaggtctttccaaaattaaatttatgtaaatgtctattttatataaaatatgattaaa

SEQ ID NO: 37022 - DNA, 6914 bp, Homo sapiens
  misc_feature (3804)..(3804): n is a, c, g, or t
gagtttgcagatgcatattcaagcttagcttcgttattggctgagcaggagcggtttaaagaagctgaagaaatataccaaactggaataaagaactgtccagacagctcagatttacacaacaactatggggttttcttagttgatactggcttaccagaaaaggcagtggcccattaccagcaggccatcaaacttagccccagtcatcacgtggccatggtgaacttgggaagactctacaggtcactgggagagaacagcatggctgaagaatggtacaagcgcgccctgcaggtggcacacaaagctgagatattgtcacctttgggagcactgtattacaacactggccgatacgaagaggctttgcagatttaccaggaagctgcagcacttcagccttctcagagggagctccgcttggcactggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggcacttgatgctatagacaaggctctccagctgaaaccaaaggacccaaaagtcatttctgaactttttttcacaaaaggaaaccaattaagagagcagaaccttctcgacaaagcttttgagagctatagagtggctgtgcaactaaacccagaccaagcacaggcctggatgaacatgggtggcatccaacacatcaagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggggagtgatggaagccttgctttcacatcagcaggggcacaactaatgagattttctctcattccgagttcagggtgacacattttgggacatctgctggtagcccagtgctgaaggacttgcttttccatgaagaagacgaaaacagcaaacaagggcaagaaggtctgagagggaaggagaatgacatttacacattttacagatttttgtttggtttaactccagatttctcttgatatatctctgtgcttttgagacctggagatctaattctgtttagacattttttgtcccagaaatacagaagcttgaaatgctatgaaggcagagcttctattctttatgggatgaaatatttcaaaagaggataaatcctctgtggtaagccatttggaaaatcctaccaagaattggcttatttaattttccagaaccaggaatgagtatctaatagcttttgtagaaccttccagaatatgtggggaaaaagggctattgctaagtgagctttatctaatatcctcctaagagttttactagtgcttttttgaggaattacagggaagctcctggaattgtacatggatatctttatccctagggggaaatcaaggagctgggcacccctaattctttatggaagtgtttaaaactattttaattttattacaagtattactagagtagtggttctactctaagatttcaaaagtgcatttaaaatcatacatgttcccgcctgcaaatatattgttattttggtggagaaaaaaatagtatattctacataaaaaattaaagatattaactaagagaaatgtcctactttattatcttaatgttcagacatcatgagatttattatttttttgaaaaatatattgaaccattgaggaacctttatgatgtatcacagaaatcttcatagattctaactagatggaaaaagagctctatttatttgtgttcctaggcttaatgagaattctgggcttagaacatcaacgattaatacccagaattctttgttttgagaatattatggagaatgctctaaaaatctagggtaaagatctaaattcaaattttaaatatatatttatatttaagaaataggaaaggcaaagttgaactcacaatttgacatttatttttagtgttatttatttcataacttataaaatatttaatatatacatacacactcttcttttttctctgtacaaagtggttttaatatcagctttcaaaactgatcttataaaatgtaaatctaaattgtaaaatagttaagttttaacagtccctcccaaactttgtgttgattattcacttgctaaagagatgtgaggaatcagccttcagttttttggcagtagtatattttggaagtgaagaaattggaacacctgtttctaatttggtcttcatcattagagacaaaaccaaaacactccaggcagtactgtttatagtgctgagccaggtagcacacagacatagtagcctaaaggctcacataattcgcatgctcaggccagggcagggtaaaaatagccttctgcttctttcaacccagtatcaggaagcactaccccagtgttattatttgttttgtcaaggtaagtctaaataaacaagaaaaacttcttcggaaggcatggcgaagggagtattttaaatgaaaatgattacagaatttgaattagcatgcatctctttgtgtgcaacagtaatccaagaatgtatatgttaccactacaaccatttgtttctaatagttttttcatgttatataacataaatgtatccacaaccttaattaagaactattcttcccccaaaatcatagtcctagtgtcaagaaacatactccagtgtttattgtaaaataacaaccacaccctcaaattgaaaaaagtgaatgtctaggactttattacaacttttcagaataatctgtaatgaaaactcatgcttaaaaatttaatggaaaagactgagccccaaattttgaatagtgattacgccttacttgaagtgctaataaaggtaggagagtacatttgttggaataacagaaatggtgatttcagcctaaaagtttctgagggtaaaggatcacatgaccttcaggaaactctctgcctcctgtaggtgctttcctatctcccccatccttccctaccccttttcccttttccttcctctctttttctctcactgtcactctgtctacacacactggcatcttttgaacactaaaagtaagcactgttttttaaaaaagtaattatttgttggatcagatacttttatcccaagtgaataccttcactgagatgtggccaatgcaatagtttcacagtaaaaacagtgcctataagaaaatagatcacatactatttttcaatgatattaagtgtattttgtaactattttcatttggtccttgtaacatgaaataatacatggaacttacctttataataaaaatggagtgccctggttcatcatagaggtgcatctagtttgcccttaatggaagtatacttgctgtgtggattgatagcaccttcttgaaatggaggagctcagctggcctcatggatgtgcaatttttgcagtcccacagggccttgcatacagaagcaccccgagctcagttgaatgtctgtttgattttttcttatttatttttttgagacacagttccactttgtctttttgtcacccaggatggagttcagtggcacaaacatggctcactgtagcctcgacctccctggctgaagggatcctcccacctcagcctcccaagtaaccgagactacaggcatntgccagcatgtccagctaatttttgtattttttgtagagacagggtttcaccatgttgcccaggctggtctcaaactcctgggctcaagcgatctgcccacctctgcctcccaaagtgctgggattaaaggcataagccaccatgtccaactgaaattcttaataattaataatttttgagcaagaggtccacactttcattttgcactgggttcccaaacaggtcctgggtaggaaggatggctgaggataaaacaggagttgctttggcctggctgaacatttgaaccaatgatcagagtttcattttatgattgtgttactctgaacagatttgctatttttttccagctacatttagagttcctcatgtatatatcacccctctttttccagtccatctaacctctccttttttttgtgcctagaatcagttctccttgccttcaaaatccctgataagtgtccatttctttttgtatcctttgatgtagaagccacaagaatggctttagcagcttattttaatcttatgaattattcattcaggattttttaaatgattcagatgctttcagtctgttaacagtatttataaaacatgtttcagtgatacaacataggtgaactaaaccaaagatgcaaatgccttggaggaaaagaaattgtattatagagaatcctgagatatatccttttgggttgtttaatttaaagcctatcacaaaacaaagagaattgtcgcactttaattccaacctcctgcagtacttcacaacccttagcataagattctgaaatttgtaataggtggtacctagtttgatgcagggttttgcagcagttgtgcgaatgcctctgcgcaacggcctttcagtcagactaaatgagaaaatccaaactgtcctatcaaaactgacccacaataactgtactctgaggcgaaacagagcaaatgtgggtttcctgttttcattgtaaaacattccaggttctcagattgaagagctacattcagctgatagttgacatctgttccctcacacgtagtggctctcaacacgggctgcactttggaatcacctgaggacctttcggaatcttcggttgaatcatcctggctgtcctggtgatgcttcttatgtgcagctaggctggagaaccactacagggctgacacctggaatgggagcttgtaacttttacaaaataatagatgtttatcatcttttgcaatttttacttttaagtctatactaaaatgagccaaagaagtcttaacaatgatgtatggcacaattggttggttgaggctatcattccatgattacaaataggtggttatgtggggtggttttgcacttgtggcaattggactgcaatttggccttaaaatgacacaattcctcgttctcagatggagaggaattgccttgaaatttgcatgtaccagactaagtgccagtatatatatgactgatattttcgtgactcatagaaggtgtccatggtatagagtttatgcctacatctctatctttattttgggcacacatgagcttttgttaattatttctttgtacttgttagaatctgtttttgaaaaaaaaaaaaacttttgctttgatttgtggtggattcaccttcttaaaataataaatttagaggatattaggaatgacattcaaaacaaatatagtgagaggtgattttttaaaaatttttgttcctggtttccaaattatgtttactttgatttgattatatgttggtatctcccaaatataggttaacttagctatttaaatggtatcttttgacatttaaaaagaattaagtacctgtcaaatctagcattgaggttgcagttgaataagataaaagcttaggatgtcaaaaaataatatagagaaatattataagattttatgattattcttgacgtttttgatgcaaaaggaaaatatgctgaatagttcttccaaaaaatattatttccctcaatattttatttgtagccatgtaatttaaagagaacagaaaataactgcaatcaaaagtatggtttaatatcaatcaaagtggcacaacagaattgataagatctttataacaatcaattggctgatattaaaatattgattttaattgatcttttcaattaaaatctttagggcctgtaactcataaaatcagcatccaccacaatatatggtcattattggtttgtaagcatagatcaccattgactcctacctggagagacatgtctatttctaaaaatccagtagtttctttgcattctcagtagtacacgttgtatatatatatatgtaacaaatttggtagttttcagtatgtgtgatgtcctttgggggttatttatcttgctggtccataggaggggtacactaccccaagaatcaagacatctgagttctagttctagttctagctctgccactgaagagccaccttacctggggcaagttagccattgtctcccagtcatgtttaccacccatgaaaggactcgtcggtttgatgtttccattaagctcaatgagtaactctaatagttactcttgaatctggattgaaaaacaccatgcatctgatgagataattcataaatgttgccccttttttaaatgatacaaccctaaaagtgactgaattgcccaagtgcttgaacatggcagaggtagttactcttattttgcagtttgtgcacttaaaaattcctacagtgattgttactttactggggaaaaaagatgaggtgaaacttcctcccaaggaattaaaatatctgtagaagccatggcttgcttttataatgtggaaatcatttgatttgctgtaattcacgcagatccctccttttgtcagggggaaatgatttgcatcatgttcttttttcataatgcttttacttcctgtttggatcagttgtatgtaaatgtacatttttgttactttggctgtgcccgttagaatttatcttccataaagtatttctcccattgagtctaatgatgtatactttgcctaggtctttccaaaattaaatttatgtaaatgtctattttatataaaatatgattaaa

SEQ ID NO: 37023 - DNA, 1867 bp, Homo sapiens
agctactttgaagaaacctatcagagtagagggccttcattctgcttctggccttactctcacttgccttgggatctttatcaagtctgttgaatatctttgcactttagtgtctatatctgtaaagtggaaaatttttgtgtgtggttttttaaatatctcttaaatcctgataaacagctaaacagtatcaaaaggcagctaaattgtataaaaaaatacctgcaaaaaccatacaaatgcttaccagaaaaggcagtggcccattaccagcaggccatcaaacttagccccagtcatcacgtggccatggtgaacttgggaagactctacaggtcactgggagagaacagcatggctgaagaatggtacaagcgcgccctgcaggtggcacacaaagctgagatattgtcacctttgggagcactgtattacaacactggccgatacgaagaggctttgcagatttaccaggaagctgcagcacttcagccttctcagagggagctccgcttggcactggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggcacttgatgctatagacaaggctctccagctgaaaccaaaggacccaaaagtcatttctgaactttttttcacaaaaggaaaccaattaagagagcagaaccttctcgacaaagcttttgagagctatagagtggctgtgcaactaaacccagaccaagcacaggcctggatgaacatgggtggcatccaacacatcaagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggggagtgatggaagccttgctttcacatcagcaggggcacaactaatgagattttctctcattccgagttcagggtgacacattttgggacatctgctggtagcccagtgctgaaggacttgcttttccatgaagaagacgaaaacagcaaacaagggcaagaaggtctgagagggaaggagaatgacatttacacattttacagatttttgtttggtttaactccagatttctcttgatatatctctgtgcttttgagacctggagatctaattctgtttagacattttttgtcccagaaatacagaagcttgaaatgctatgaaggcagagcttctattctttatgggatgaaatatttcaaaagaggataaatcctctgtggtaagccatttggaaaatcctaccaagaattggcttatttaattttccagaaccaggaatgagtatctaatagcttttgtagaaccttccagaatatgtggggaaaaagggctattgctaagtgagctttatctaatatcctcctaagagttttactagtgcttttttgaggaattacagggaagctcctggaattgtacatggatatctttatccctagggggaaatcaaggagctgggcacccctaattctttatggaagtgtttaaaactattttaattttattacaagtattactagagtagtggttctactctaagatttcaaaagtgcatttaaaatcatacatgttcccgcctgcaaatatattgttattttggtggagaaaaaaatagtatattctacataaaaaattaaagatattaactaaga

SEQ ID NO: 37024 - DNA, 7044 bp, Homo sapiens
  misc_feature (3894)..(3894): n is a, c, g, or t
agctactttgaagaaacctatcagagtagagggccttcattctgcttctggccttactctcacttgccttgggatctttatcaagtctgttgaatatctttgcactttagtgtctatatctgtaaagtggaaaatttttgtgtgtggttttttaaatatctcttaaatcctgataaacagctaaacagtatcaaaaggcagctaaattgtataaaaaaatacctgcaaaaaccatacaaatgcttaccagaaaaggcagtggcccattaccagcaggccatcaaacttagccccagtcatcacgtggccatggtgaacttgggaagactctacaggtcactgggagagaacagcatggctgaagaatggtacaagcgcgccctgcaggtggcacacaaagctgagatattgtcacctttgggagcactgtattacaacactggccgatacgaagaggctttgcagatttaccaggaagctgcagcacttcagccttctcagagggagctccgcttggcactggctcaggttttggccgtgatgggtcagacaaaagaagctgaaaagatgaccaatcacattgtgtcagaggagaccggatgccttgaatgctatcgcctcttgtcagccatctatagcaagcaggagaaccacgacaaggcacttgatgctatagacaaggctctccagctgaaaccaaaggacccaaaagtcatttctgaactttttttcacaaaaggaaaccaattaagagagcagaaccttctcgacaaagcttttgagagctatagagtggctgtgcaactaaacccagaccaagcacaggcctggatgaacatgggtggcatccaacacatcaagggaaaatatgtgtctgcaagagcttattatgagagagccttacagctggttccagacagcaaactgctgaaggaaaatcttgccaaattggatcgcctagaaaaacgattacaagaagttcgagaaaaggatcaaacatagcaccaccgtctgacccaacctcataggataatgtggtgcctctgaaaggggagtgatggaagccttgctttcacatcagcaggggcacaactaatgagattttctctcattccgagttcagggtgacacattttgggacatctgctggtagcccagtgctgaaggacttgcttttccatgaagaagacgaaaacagcaaacaagggcaagaaggtctgagagggaaggagaatgacatttacacattttacagatttttgtttggtttaactccagatttctcttgatatatctctgtgcttttgagacctggagatctaattctgtttagacattttttgtcccagaaatacagaagcttgaaatgctatgaaggcagagcttctattctttatgggatgaaatatttcaaaagaggataaatcctctgtggtaagccatttggaaaatcctaccaagaattggcttatttaattttccagaaccaggaatgagtatctaatagcttttgtagaaccttccagaatatgtggggaaaaagggctattgctaagtgagctttatctaatatcctcctaagagttttactagtgcttttttgaggaattacagggaagctcctggaattgtacatggatatctttatccctagggggaaatcaaggagctgggcacccctaattctttatggaagtgtttaaaactattttaattttattacaagtattactagagtagtggttctactctaagatttcaaaagtgcatttaaaatcatacatgttcccgcctgcaaatatattgttattttggtggagaaaaaaatagtatattctacataaaaaattaaagatattaactaagagaaatgtcctactttattatcttaatgttcagacatcatgagatttattatttttttgaaaaatatattgaaccattgaggaacctttatgatgtatcacagaaatcttcatagattctaactagatggaaaaagagctctatttatttgtgttcctaggcttaatgagaattctgggcttagaacatcaacgattaatacccagaattctttgttttgagaatattatggagaatgctctaaaaatctagggtaaagatctaaattcaaattttaaatatatatttatatttaagaaataggaaaggcaaagttgaactcacaatttgacatttatttttagtgttatttatttcataacttataaaatatttaatatatacatacacactcttcttttttctctgtacaaagtggttttaatatcagctttcaaaactgatcttataaaatgtaaatctaaattgtaaaatagttaagttttaacagtccctcccaaactttgtgttgattattcacttgctaaagagatgtgaggaatcagccttcagttttttggcagtagtatattttggaagtgaagaaattggaacacctgtttctaatttggtcttcatcattagagacaaaaccaaaacactccaggcagtactgtttatagtgctgagccaggtagcacacagacatagtagcctaaaggctcacataattcgcatgctcaggccagggcagggtaaaaatagccttctgcttctttcaacccagtatcaggaagcactaccccagtgttattatttgttttgtcaaggtaagtctaaataaacaagaaaaacttcttcggaaggcatggcgaagggagtattttaaatgaaaatgattacagaatttgaattagcatgcatctctttgtgtgcaacagtaatccaagaatgtatatgttaccactacaaccatttgtttctaatagttttttcatgttatataacataaatgtatccacaaccttaattaagaactattcttcccccaaaatcatagtcctagtgtcaagaaacatactccagtgtttattgtaaaataacaaccacaccctcaaattgaaaaaagtgaatgtctaggactttattacaacttttcagaataatctgtaatgaaaactcatgcttaaaaatttaatggaaaagactgagccccaaattttgaatagtgattacgccttacttgaagtgctaataaaggtaggagagtacatttgttggaataacagaaatggtgatttcagcctaaaagtttctgagggtaaaggatcacatgaccttcaggaaactctctgcctcctgtaggtgctttcctatctcccccatccttccctaccccttttcccttttccttcctctctttttctctcactgtcactctgtctacacacactggcatcttttgaacactaaaagtaagcactgttttttaaaaaagtaattatttgttggatcagatacttttatcccaagtgaataccttcactgagatgtggccaatgcaatagtttcacagtaaaaacagtgcctataagaaaatagatcacatactatttttcaatgatattaagtgtattttgtaactattttcatttggtccttgtaacatgaaataatacatggaacttacctttataataaaaatggagtgccctggttcatcatagaggtgcatctagtttgcccttaatggaagtatacttgctgtgtggattgatagcaccttcttgaaatggaggagctcagctggcctcatggatgtgcaatttttgcagtcccacagggccttgcatacagaagcaccccgagctcagttgaatgtctgtttgattttttcttatttatttttttgagacacagttccactttgtctttttgtcacccaggatggagttcagtggcacaaacatggctcactgtagcctcgacctccctggctgaagggatcctcccacctcagcctcccaagtaaccgagactacaggcatntgccagcatgtccagctaatttttgtattttttgtagagacagggtttcaccatgttgcccaggctggtctcaaactcctgggctcaagcgatctgcccacctctgcctcccaaagtgctgggattaaaggcataagccaccatgtccaactgaaattcttaataattaataatttttgagcaagaggtccacactttcattttgcactgggttcccaaacaggtcctgggtaggaaggatggctgaggataaaacaggagttgctttggcctggctgaacatttgaaccaatgatcagagtttcattttatgattgtgttactctgaacagatttgctatttttttccagctacatttagagttcctcatgtatatatcacccctctttttccagtccatctaacctctccttttttttgtgcctagaatcagttctccttgccttcaaaatccctgataagtgtccatttctttttgtatcctttgatgtagaagccacaagaatggctttagcagcttattttaatcttatgaattattcattcaggattttttaaatgattcagatgctttcagtctgttaacagtatttataaaacatgtttcagtgatacaacataggtgaactaaaccaaagatgcaaatgccttggaggaaaagaaattgtattatagagaatcctgagatatatccttttgggttgtttaatttaaagcctatcacaaaacaaagagaattgtcgcactttaattccaacctcctgcagtacttcacaacccttagcataagattctgaaatttgtaataggtggtacctagtttgatgcagggttttgcagcagttgtgcgaatgcctctgcgcaacggcctttcagtcagactaaatgagaaaatccaaactgtcctatcaaaactgacccacaataactgtactctgaggcgaaacagagcaaatgtgggtttcctgttttcattgtaaaacattccaggttctcagattgaagagctacattcagctgatagttgacatctgttccctcacacgtagtggctctcaacacgggctgcactttggaatcacctgaggacctttcggaatcttcggttgaatcatcctggctgtcctggtgatgcttcttatgtgcagctaggctggagaaccactacagggctgacacctggaatgggagcttgtaacttttacaaaataatagatgtttatcatcttttgcaatttttacttttaagtctatactaaaatgagccaaagaagtcttaacaatgatgtatggcacaattggttggttgaggctatcattccatgattacaaataggtggttatgtggggtggttttgcacttgtggcaattggactgcaatttggccttaaaatgacacaattcctcgttctcagatggagaggaattgccttgaaatttgcatgtaccagactaagtgccagtatatatatgactgatattttcgtgactcatagaaggtgtccatggtatagagtttatgcctacatctctatctttattttgggcacacatgagcttttgttaattatttctttgtacttgttagaatctgtttttgaaaaaaaaaaaaacttttgctttgatttgtggtggattcaccttcttaaaataataaatttagaggatattaggaatgacattcaaaacaaatatagtgagaggtgattttttaaaaatttttgttcctggtttccaaattatgtttactttgatttgattatatgttggtatctcccaaatataggttaacttagctatttaaatggtatcttttgacatttaaaaagaattaagtacctgtcaaatctagcattgaggttgcagttgaataagataaaagcttaggatgtcaaaaaataatatagagaaatattataagattttatgattattcttgacgtttttgatgcaaaaggaaaatatgctgaatagttcttccaaaaaatattatttccctcaatattttatttgtagccatgtaatttaaagagaacagaaaataactgcaatcaaaagtatggtttaatatcaatcaaagtggcacaacagaattgataagatctttataacaatcaattggctgatattaaaatattgattttaattgatcttttcaattaaaatctttagggcctgtaactcataaaatcagcatccaccacaatatatggtcattattggtttgtaagcatagatcaccattgactcctacctggagagacatgtctatttctaaaaatccagtagtttctttgcattctcagtagtacacgttgtatatatatatatgtaacaaatttggtagttttcagtatgtgtgatgtcctttgggggttatttatcttgctggtccataggaggggtacactaccccaagaatcaagacatctgagttctagttctagttctagctctgccactgaagagccaccttacctggggcaagttagccattgtctcccagtcatgtttaccacccatgaaaggactcgtcggtttgatgtttccattaagctcaatgagtaactctaatagttactcttgaatctggattgaaaaacaccatgcatctgatgagataattcataaatgttgccccttttttaaatgatacaaccctaaaagtgactgaattgcccaagtgcttgaacatggcagaggtagttactcttattttgcagtttgtgcacttaaaaattcctacagtgattgttactttactggggaaaaaagatgaggtgaaacttcctcccaaggaattaaaatatctgtagaagccatggcttgcttttataatgtggaaatcatttgatttgctgtaattcacgcagatccctccttttgtcagggggaaatgatttgcatcatgttcttttttcataatgcttttacttcctgtttggatcagttgtatgtaaatgtacatttttgttactttggctgtgcccgttagaatttatcttccataaagtatttctcccattgagtctaatgatgtatactttgcctaggtctttccaaaattaaatttatgtaaatgtctattttatataaaatatgattaaaataagtatgtctggtttcaatctctcaagtacttcatggt

SEQ ID NO: 37025 - DNA, 368 bp, Homo sapiens
ttgtagagacggggtttctccatgctgcccaggctggtcttgaactcctaagctcaatctgcctgcctcggcctctcaaagtgctgagattacaggtgtgaaccactgcacctggcccggttgattctaatatacattctactcccaaatgattagtccaaagtttcactgtctaatatggtggcaccagcaacatgtatctagtgaacacttaaaatgtggtaagctcaaacccaatttagatttgtatttcaaaagatctgttttttaatggaggaaaaaagaatgacgaatatctcattaattttaaattttgagttcatgttgaaatatttttaatatactgaataaaatatgctgttaaaatt

SEQ ID NO: 37026 - DNA, 330 bp, Homo sapiens
tgggatgggagctggtcttagaggggcctctcccctccccagacaccatggccaggttgggaattgaggcatctgtcacttccatgcagctctgcgcactcgggaagcccaggacaatgctcttaggtgcccaaagcacctgcatcaagtttgagctttcactggtcaggcacctcagtgatggtcaggaagctcctgggtggaagccctgcaggtccaaaaggactgcctctaagtcatctggccggtactgtcaggtggggctgcagaaagaaatttataaggctgcacatgctgtggctcatgcctgtaatcccagcactttaggag

SEQ ID NO: 37027 - DNA, 472 bp, Homo sapiens
tcagcacactcaccgaggatttgcttacattgcaagccctatagctacagagaaactgagcgttgcagataagatgaacccacacataactagactaacaggtaaatgaggaccagcatcccaagaagcacaaatccaaacagtacccatttcctgaacacctgcacatgctgttcatgttgcctcccaatagtccccaaagctaagtgctgtcaccccatataacagagaggttaaatgactaagacctcggtaccaaaaagtggggacacaggatgaacctccaaaacatgctaactaaaagaagccaaacgtaatatgggtccatttatatgaaatgtccaaaatacataaatccagagaacagttgccaggggctggagggcaggttgggaggtggtgactgcttcatgggtgtgagattttcttgggggctgatggaagtcttttggaactaggtagaggtgcttgc

SEQ ID NO: 37028 - DNA, 353 bp, Homo sapiens
gaccaatctagactgatgctgagaatcttctgtcaagacctgggccttaaacctggccatgaagaattagagacccctgttaattcaggatctcacatggcagtaaaacatctcacccagcagcttacaccacacctccctgttacatcttttattcttagcatatgtaataacagattcttgttaggagtaggcactgaattttatcaagatatttttaggggcatctattaaagggatcatatagttttcttctttacttttgggaagttgtgattaatacaactaccttgtttattatattaatagatattctaatgctgagacattgttgcctttcagattaagatttt

SEQ ID NO: 37029 - DNA, 649 bp, Homo sapiens
agacagatgaagtgtccattttttcttttattgtgtgcatgaagtatggggattacaagcagtagtttttatgtgctttttagtttttcatatacaaagataatgttaatattagctcatttacattttgaaacttttgtaatagtggtatagatttgcactgcataattcacattctctcagtctcctgcacacagttgtgagatgactggttaagagggcactttgtttcaaagttaaatgatccagatgagtattgaacctataagcttagctttgttcattatcatgaggttctgatcaacaaagcagttcaacagagaaccatgccatgctgtcatttctgcttgaaaataagccttttagaggtagaaggtacaaacatgcatatacacatgcaccaataaaaaaaggaaattgtgtatggttattaaggtagagttgaaacaggaaataacgtgcgtttataagtggtttaaaaataattcttttaataaaattttcagaaatacttgatatacgcatggaaaattaaatgttttatgaaataaactccaatcagtagacaagttaatggcttttttaaaagcactaatgacttatttacttaggctatataaatttaggttagataaatctgaaaaaaaaa

SEQ ID NO: 37030 - DNA, 564 bp, Homo sapiens
aagcagaatacattggtagggctgggaggggaataaaatattctgcctgccagtgttgtacttggcctttgggggaataaatgactttcaattagagtacttaaatatcttttaactttaataattattattagagcctcaacagaattttacttggaaaagagtaaaaaaaaaaaagatttcttctttgttttttgactttctaatttgatcaccttgtggatttgtgagattgtccttacctctttccttttttggtctctgcttttagcttctttgtagtaagcacacttatttacagcttcatcttgtgttgggctgtgtgtatgcaggtccactgttgttgacttgctgctgagcgtccagctaagtctgtgatctaagcctgtcaccagtcccacttctgggccctcccagccaaagccactagttcccatttgctacctggttctgctactgggaggctcccttccctaaattcagtcacggttctattttgttttctttcctctacttgatagctcttactgtttgtgttgttatcagtgttgaagaacaaatcca

SEQ ID NO: 37031 - DNA, 434 bp, Homo sapiens
tattatctatgaaaagtttatgaaccaaattagagtacaaataaagttatgtaacaaatttacctatttaagattaccatttgtttttaaggcctttagtacattgtgtgtgaatagctcctgctaattatacaatatttatgaaacctaaaattatctgaagttggaagcactttgttagcaactaattatatctacttgaaagaaagcatgtatgtatattttgtaaatacctcttaaattttttactgattcaagtaaggtttattacagttagtcaaaagtaacagggctactgtataccttataagaaagtatgtcgtggaggttggaacagaattatgcactgtattatagtttcttcgtgtgcatgtattgcattgttgtcctttgaatatagtatttggagtcagcttaaatcaaggatttgtttg

SEQ ID NO: 37032 - DNA, 515 bp, Homo sapiens
ctatcctgttttggaaggcttttcagatattcgaaaggacttgggtattgttgtctaagctgtatctgcactgggagcactgcaagcccagtaatgctgagattcttgcagagtcatagaggtactgccttgttggtcaattggtgagtctgattccaggctatgctcttagccagtatattacctgttgatctataagcaggataaagaaagtctgaaatggtagcaaagggaaaatttatttttactgaataagtcaaaaaaataataagtcaggaagccaaaaagaaactgctaaataccccccaccccaaacaaagaaaagcgctacaaatctataataaatattcacagagagataagagaataaacataaaagaaccaaatagtataaaaaaaggaacagtcagaggaaaggaaagttacaataactaaagtgaaatattcacaatttcggaagatagagtcaaggacatttctcaggaaatagaactaagcgacagagtaggaaaaaa

SEQ ID NO: 37033 - DNA, 267 bp, Homo sapiens
tcctcttctataaatagggttatttctgctaacctctgagagttgggaagaagctaaaatatgctaatatatgtaaggtgtctaacattggcccttaaatggttagtgcttcataaatgttaaatggttagtgcttcataaatgttaaattgttagtgcttcataaatgtttgcatcctttcaaaggctcttattgccccttggataaattctgcactgggaactacatttttctgcaatgtgtttcccaccaatctttgtttcttt

SEQ ID NO: 37034 - DNA, 463 bp, Homo sapiens
cacatcacaatggcagcacatcacaccacatgggagaaagaaaataactgaggaaacaatgactgacagtcctctttaattgagggaaaacataaatgtgcagatttagaaagcacaagaaattttaagcaactaaacacatccttgtaaaagtgaagattgccaaaagaaatcaaaagatcttaagagcagtcagggaaacaccagctacctgcaaattgactgccagttgatgtctcataagcaaaaatggaaaccaaagtatggtgaaataatatcttcaaagtgaagtaagagaaaataattatatatttactaagttattattcaagaagtgattcgaaataaaagcatttccagataagcaaagcagagcttatcgccaacagtctcttgactaaaggaacttctaaagcactaattcttaaccttgcttccacacacattggattcaacaagggag

SEQ ID NO: 37035 - DNA, 364 bp, Homo sapiens
ctacttacattgttttaaaatgcacattttcttttctaggaagagggagcaggcaggaatgttatacactttatccatgatgagtgtagcagcaggtgaaaccctgaggtgttggccacagaagtgcttatatatatatatctcatatatatatgagatatatatatttgagacagagtctggctgtgtcacccaggctggagtgcagtggcacgatcttggctcactgcaacctccgctcccaggtcccagtgattctcatgccccagcctcctgagtacttgggattacaggcatgcgtgaccacgcccagctaattttttgtatttttagtagagatggggtttcgctatgttgcccaggc

SEQ ID NO: 37036 - DNA, 1117 bp, Homo sapiens
acttctcaggccttttgctagtaaggaagtagctactgtctctttgggtcaaactagtctaggaccttgttcagtccatatcctagaaaggttggctacagatttgattctgtgcttcctagtagcaaaagcaaaaaagggaaataggatccgtttcaaattgccaaacatttagaattggaaactaatcagttatttaaggagaagcagatttttttcctggtactggaccccatgcaaaatttctttcataatttctttttttttttttttgagacggagtttcgctcttgttccccaggctggagtgcagtgacgcgatctcagctcactgcaacctctgcctcctgggttcaagcaattctcctgcctcagcctcccgagtagctgggattacaggcacatgccaccacacccagctaatttttgtatttttagtagagatggggtttcatcatattggtcaggttggtctggagctcctgacctcaggtgatctgcctgccttggccacccaaagtgctgggaattacaagtgtgagccaccgtgcccggcctcataatttctagtaagaagatgctagtgatatgataggcattgccctcaacgacatgataaaaaattatatttcatgttttaccatagccctttatgcataacccatccacagcactcatcagatgttatcataattattggtttactatgtaattctcttgttagactcagaatttcttgaaaatgatgaacaggatttgtatgctcagcccatagtacatattcagttaatatatttttgaattgaaacactgttttatctgcttattcaaaaggggaaaatttaatttattaacacttactgagtacttgctactctttactctgaaataaaaagagggatgaatcaaaagtccctgtccttgaggaaggtatgatttactgggaataaacatgtattaatagttatattgtactctagctggataattgctacatgatagaagtgtgaacattcttttgtgaaatgacttatagattgcttaaactacactctcattacagccagcttcaccttttagaatttggggtttggatctttaagccaagagaggcggg

SEQ ID NO: 37037 - DNA, 314 bp, Homo sapiens
acttctcaggccttttgctagtaaggaagtagctactgtctctttgggtcaaactagtctaggaccttgttcagtccatatcctagaaaggttggctacagatttgattctgtgcttcctagtagcaaaagcaaaaaagggaaataggatccgtttcaaattgccaaacatttagaatttttttcttctaatttcctcatttatctagtaaatctcttggtatctctcacatcttttggtaagcttcttgcatgcctttttgaaatgaaataagcaataaacaaataaataagatacataacaggttctgtgga

SEQ ID NO: 37038 - DNA, 433 bp, Homo sapiens
cgtgaggctgaagcgagtttatcactgggaacaagcttctagagcacagcatgttagaatttttgaaggagccccctccccgaaagtgatacgtaatcggggttttaaaaaatttgaattaggctgggcgcggtggctcacaactgtgatcccagcactctgagaggccgaggcgggcggatcacctgaggtcgggagttcgagaccagactgaccaacatggagaaaccgcgtcgctgcaaaaatacaaaaaaaattagccgggcgtggtggcacatgcctgtaatcccagctactcgggaggctgaggttaggagaatcgcttgaatctgggaggtggaggttgcggtgagccgagatcatgccattgcactccagcctgggcaacaagagtgaaaccccgtctcaaaataaataaatttgaatgtatata

SEQ ID NO: 37039 - DNA, 648 bp, Homo sapiens
gatcacagcttatgtatgtattcacgtgtaatctccacagtagctacgctaggtcattgcatgtacatgaaggtacgtgaaggaatggatggaattctcttacattagggaagatgctaacctcccagctgaattttggcgttagcatgacacttagcatctttcttggctgttaaaataaagcataacagggtggcaggagaggatgatataccaccactaaatacagttggatcccaaaggtgtgtacttggcctctctgtttctattggttcattgcctttttcttattcaaaaacatatttaaaattttgaagtatttaaaacaaaaaacaaatgcaagtaccacatacccattcctcatgccctcgccaaatggatctggggcaagttagaatgctgctccatttccttcaaatagttaattttcaaacaataagtaatgtgtaaaaactgtatctaaagcctctccctccatcacagagttagccacagctctgaagtcaggacggatgtctgctaagtttgcctatatttacctattttttcctatacttataggtacatgcgtgtacctgaaacaccgccaagcatccttttacattttcatgctttgaataaatgtcatcatttttccaaagtgtgtgt

SEQ ID NO: 37040 - DNA, 389 bp, Homo sapiens
tgaggacccagaggggtgggagatggaggtgtgagcagcatggtctgttgtggttttttcttgttgtggagtagagttagatcatgcatgaagctctctgggcataggtggagtagcagctgtccacaccattgctattcaaagtgtggtttgcacaccagtaatggaaaatcatctgtgcacactgtttagtttaactgatactttttttttcatagcaagattttcttaatgaaggaagtaatgtattgatttacattctgactcattgtctttatcttgtctttgatcagtttgtagactggcactggtccacactttgaataacactattcttcattctactttccatgtacccggatgccaggcaaacagggagttttacgctg

SEQ ID NO: 37041 - DNA, 1392 bp, Homo sapiens
  misc_feature (842)..(842): n is a, c, g, or t
gggaaaaagatttgatgtagtttttatatagagagattaagaaagaaaactgagatggtaaatattcgaagagacctggggtcaggaggataagaggctagagaattcttctaaacattcaaatatggttaccatttagagtgtactgcatattcagatagtttcaactatcatgttaaaagctctctggatgtattttttccctataacattaaagcttgtcaaactttttcactctttctgtttcttccaggaacaggacacactggcacatccttttcccaccaaaccacagaaaaacatttttaagtgaaggttgaagaaatggcaatttacagatgccagaagaaaggataaaaatcaaggcaagataagaaaaaaggaggctgatgttctgctggtccacttggtttactggcttctctgtctgattgtgcctaactctgacactgtgccttccctctagacactgtagatgatgtttagtcctagctcaatcagtctctccctttgcacatttccgttacaaccctgctcatgtgctcaagatattgctcctgctactctcccctctcttctgcatcaacagttctttctcatctactggacaattcgcatcagcctactatcatacacaaatacccccacctttaaaaacccctcccttggtcccacactagtcttcagattccatcccattttttgctccccttgacagcaaaaacctccaaagagtatctgtactcagtgtattttctcttcacccatcagcaaaatttgacttagttaccatctcctcctggaaacagcttcttcacctggcatccaagtggacctcgtcntacatcatacctacctcatcaagaacttctgctttgctgattcttcatccccttgatatccaaacatagcaatgtcccaaggctcagttctcaggtccaccaagcactctcccacttcacagcccttgtatttgcagccctttctgcctgtaagctctctcaaccctcttatcctcctgaccccaggtctcttcaaatatttaccatctcagttttctttcttaatctctctatataaaaaactacatcaaaatctttttcccttatcttgctttattttttctccatagcatttagcaccagctgatatattaccatgtttatttgtttgctgtttgtcctactagaatgctagttttttgaaggcaagggctctgtctgcttggttcctgctgttggccacttcgtaacccagattctggcacataacagacccttgctacatatttgttgaatagctgaactcttagacacaatatcctaagactttgatagagatcttacttctgatagattgggtaggtatgatgaaggacgggggtcctctaga

SEQ ID NO: 37042 - DNA, 1519 bp, Homo sapiens
  misc_feature (842)..(842): n is a, c, g, or t
gggaaaaagatttgatgtagtttttatatagagagattaagaaagaaaactgagatggtaaatattcgaagagacctggggtcaggaggataagaggctagagaattcttctaaacattcaaatatggttaccatttagagtgtactgcatattcagatagtttcaactatcatgttaaaagctctctggatgtattttttccctataacattaaagcttgtcaaactttttcactctttctgtttcttccaggaacaggacacactggcacatccttttcccaccaaaccacagaaaaacatttttaagtgaaggttgaagaaatggcaatttacagatgccagaagaaaggataaaaatcaaggcaagataagaaaaaaggaggctgatgttctgctggtccacttggtttactggcttctctgtctgattgtgcctaactctgacactgtgccttccctctagacactgtagatgatgtttagtcctagctcaatcagtctctccctttgcacatttccgttacaaccctgctcatgtgctcaagatattgctcctgctactctcccctctcttctgcatcaacagttctttctcatctactggacaattcgcatcagcctactatcatacacaaatacccccacctttaaaaacccctcccttggtcccacactagtcttcagattccatcccattttttgctccccttgacagcaaaaacctccaaagagtatctgtactcagtgtattttctcttcacccatcagcaaaatttgacttagttaccatctcctcctggaaacagcttcttcacctggcatccaagtggacctcgtcntacatcatacctacctcatcaagaacttctgctttgctgattcttcatccccttgatatccaaacatagcaatgtcccaaggctcagttctcaggtccaccaagcactctcccacttcacagcccttgtatttgcagccctttctgcctgtaagctctctcaaccctcttatcctcctgaccccaggtctcttcaaatatttaccatctcagttttctttcttaatctctctatataaaaaactacatcaaaatctttttcccttatcttgctttattttttctccatagcatttagcaccagctgatatattaccatgtttatttgtttgctgtttgtcctactagaatgctagttttttgaaggcaagggctctgtctgcttggttcctgctgttggccacttcgtaacccagattctggcacataacagacccttgctacatatttgttgaatagctgaactcttagacacaatatcctaagactttgatagagatcttacttctgatagattgttctttcctgcaacaatactgattcctatataaatctggggaaggaagaaaaggtgactgatcactttttacctctcatcttttgccaaggtaaggttttttgtggttgttaaatctgaatataattaaattaaaaactttggatacccgaggcagctaa

SEQ ID NO: 37043 - DNA, 185 bp, Homo sapiens
gtttatttgttagactaaaaagatgggcatattaaatccacatgcacaggcttataaagaacacacaatgaaataaatacagaaaactcaaatactgttaaccaataactacactcacatggatatttttacttatgtaaaatctcaatcagaagttgaacaaaatataaataggtaagtataaa

SEQ ID NO: 37044 - DNA, 240 bp, Homo sapiens
ggttttcaagtttttttcttccaaatgggtttaggttacaaaaaagattctgttgatattacttctagaatttctttattcttataagttcatttgggatcagttggcatcatttcagtagtctttgcagtctggaataacttctcatttttttcaacattcctttttatgttcttcagtaaagttttaaatgtgtttattttttattttaaaatgagatgggaagccattggagttggt

SEQ ID NO: 37045 - DNA, 703 bp, Homo sapiens
ctgcaatgttttaagacaaatccaaagtatcctattatttcacccacaaataatttagtacccacacttgttttatattgaagcactgtatgtttttaaaagaagcagtagctgaaagcccagagggctctggaagtggatagagtagggactttggtactagtgcttttggtttcctttaagttttgtggctttgagatgcccaaggactagaccttattccttaaattaaagcagggttttcatttcttaggcagtcagcttgctctttaaaactgaaatttttattttgggtaaaaaggactttgccatttgaatgtctgtaataggtagccacagaaccattattataatcaatgtaaattctaactctgagagataaataagtactagagaaaaatagactaacctactaggagagatatgaaaagacataaaacagaattaacaatgtagtactacatagagtgcctcaaattagcaatacaaaaaataggtgtgctcaatgacagcaagccaactatataaattggaaattgggatatgtaattcaggaaaagatttgttttctaatgtgcaacttattacaatcagtgatggatgcaccaagcttaattgtggtaattacttcactttatatgtacataaaattgtcacattgtacagcttaaacttatacatttttttgtcaattgtaactcaa

SEQ ID NO: 37046 - DNA, 2957 bp, Homo sapiens
  misc_feature (764)..(764): n is a, c, g, or t
  misc_feature (1001)..(1001): n is a, c, g, or t
  misc_feature (1902)..(1902): n is a, c, g, or t
  misc_feature (1964)..(1964): n is a, c, g, or t
agtctgtgagctgggagcctgttggcaggtccctctttttattttcgctgagagctttcttttactaaatgccaccatccttacctttcaaggtgtctgcgtgcctaatttttcctggttgttagacaagaacccggattttagttgaactctggagcaaaaatcctgcatcatttgtaggtaatgtttgttttctttggttgcttttatgaccttctctttattcctagtatttgggcatttcacaaaaacatttataaatctgaattaaaaaacaaactgaccttgccaaggaccctactgatcccttttcatataattctatctgctaggtcttgtgctgccttctaagttagttcatcagttctatacttcagtatttaattctatattcagccatgttatcaaatgtttatttcaacctttgagtttctcatttgtaatagtattttttcatttttatgtttttaaaagagttcttttcatattttactatttttgtttagtaactttcagtacttgttgcgtagattttatttcatctttatgtttttgagatgtttgcataacacatttaaagacaattacatattgttgtatgatttccatttccttggtcaagaattctcccatttgttgcatctctgaagagtttcccaaggtgggttaatcttgaatatggtaaacttgctgccctcagttttttagttttaatactttatcagttgtttcttgttctttttttttctgggcatattattacntcatttgaaaataatgacaattttggcctttctcttcgagattttgtaactcattttcttttcttttcacatagaatttgataaggcctccagtactttgtgatatagtagttgtggggatggtccttcttgtcttactgctgatctcaagtttatgtttgtagcaaatttttgctacatgaccattacaagtttaagaggttaccaagagtttttattacaaataccttaaatctnagcaaagactataaaaactgagataaacatgtttttcttctaaatagtaatcatttagacaaatcacaaatgtgatatcagattagtgcatcctacactgtatggaaactataaattcatgattttcaaaaattgtaggtaaatatttatttttcaaaataatttatccatcttgctttaccaaaaaaggcaaggtcttgtttttctttccctatacagtagtaatggctctttggtgtaaaaactttataggacctaaagtaaaaaagaagataaaaaccagtttgtctttcaaagtcttaaaatatttcattaacctcgtagtgcctgatctctgtcaccaagcaaatagtctgaactattatttccaagctcaattcaaacaggtaaagttttactacaattatatctggccatcactacagtgttttctccaatcacttccaaagcctaccccttttctttatcatacttccacctacattgcataatacagagcttagctagtgaggtacaagtgataaggattatctccccagagtctccgggccttggtaattcctagaccacagcaccatgcattaggttatagtcacaggcctctatatagtcttccacatatcccattacattttaaatcctatgcataccctttatatcctgcacttatctgtcaaaattctaaggtataagattttttttttacttatccctgctgtttaattttgaagaaagaaaaatataaaagaaaattttttaaaaagaggccttcatggatatcaaagaatgccaacaataatgctgaagaaagaagttattctacagcaatgagacacaaagaaaagaattttgtaaacattagcatcttggttactggagaactataacttttatgtagtcntgcttggaaaacactaaaagggaaatcgagtctgtttgacaatattctgtcttcactgttgntcacttcataatgtgttggaatataaagttctatacagttaatatgaagctctctttagcatttaaaacatgatttgcattttcatgaggcattttggctaattttattgatttccttatatttcatagtccttagccttatgagaatcttatgtttctgtgtgttttctatcatgtagcacaatttctgacacacaaaacatacaataaacttgtgttaatttttctatcaaagtcagaatttattcataaggaatctgaagtaaggtgtactaagcttgtttatgggttaagtgatatagccaaattcaaaactttactttttatgtcagtctagaaatatctcagattaaaacatatcacttcttagttccaattagataagggaaatcttttataataatgccaggattgctataatctgataggagacaacaatttcattttgctacaggaaaatttggaggacaaaaaaaaaaaaagaaaacataagatagaggagagaaaatagtcagatgaagaagcaaaaaacacaaacaaggcatttagatttgttaggaaggaattcaagtcagtcagtaaagtgataacttttgaattatctgagaaaaatatactcagaacaaaatcaggcacactaaaggtatccataatccacattatttactaggctaaaggtaagtacaaacaaatctacatggactaattgtatcacagaacaaaaagggtagcaaaatccagtaattccaatggagtaataaagttgcagacaaaggaaaattaacgtgtgcattgcttgagatatgactaaaatgtcattaaaataaattctaagttatgaatattcatttgaaaagttacaaagtacacactgatttatatttcagaagcaaggatatatgtttctatataatttagtcctaaatatagttcatttcctatgctaatgcttttttccttcttcttaccttcttaggtcaacaacaagaggcc

SEQ ID NO: 37047 - DNA, 1848 bp, Homo sapiens
agtctgtgagctgggagcctgttggcaggtccctctttttattttcgctgagagctttcttttactaaatgccaccatccttacctttcaaggtgtctgcgtgcctaatttttcctggttgttagacaagaacccggattttagttgaactctggagcaaaaatcctgcatcatttgtaggtgggtgtcattgtgactggctgctacctccccatgagtcttctaaaataaaacctgcaaattcacatcttccccatgcttccagagaatgcatattcttcctttgaaaaaagaaaaccagcactgttcataatagccaagatttggaagccacctaagtgtccatcaacagatgaatggagaaactgtggtacatatacacaacggagtgctattcagccataaaaaagaatgatactctgtcatctgcaacaacatgaatggaactggagatcattatgttgttaaataagccagacacagaaagacaaacatcacatattttcacttattttggggatataaaagtcaaaacaaactcatggagatagagaacagatagacggttaccagaggctaggaggaggagtggtggggggcagttagtgatggttaattggtacaaaaaaatggttagaaataataaataagacctagtattagataggacaacaggaggactatagtcaaaaataatttatttgtacatttcaaagtaactaaaagagtgtaattgtattatttgtagcacataggataaatgcttgaggtgacggataccccatttaccctgatgtgattattacacatcgtatgcctgtaccaaaagatctcatgtacctcataaatacatacacctactatatacccacacaaattaaaaattaaaaaaatttaaagaaattacagtttgttggttttgaatatttgaccaaattttttactaagcacagatagattgaatataattttattgtccttttgacattatgataatgaaggtatctacacagaagtctgagatgagaaaaaaatgatataatatccacctactacatagtgggtagtttatatactaaagttattgttatgagaaagaatggcttaggaatattatttaaaattaattaaggggtgttaaaaataaaataccaagtgtaaaaatgacaaaggcaagaagaaacagtatataatgtgagtaaatcttaatctttccaagagaggagacagtacataatgtctaaaattgttaaaccatgaaatagaaatatagttattttattcataattaaggagataactactatagcacgaaatcgtgccaaaaatggttgcctctgggaaatgtgattatagatattataatattttggactgtaaaaatctgcttttaagactgaggaaatacaaataggacaatatttatttgaaatttgtatcctcagggagtgtaaagaaattaatgtatccacaaaataataatagctgctatttgaaaacatagttttcttgaaagttaaaatagtaatagtcttctaaaaattttgttagttttggttttctctttaatctgagttatgtagaaaagtgcttatttcaaattaggtaggcttgttttattcctttttctgtcttttttctatcaactagtgttttattgtgttcagaaaatgccatgcattaaaagactacttttgagaatttctagagattttctttgttactaaagagatttttgtaattgttacatgggattttaaaaagaatgtaaattatcctttttgtcaagtataatgatttctgaaacctagctgtgtcagaatactgtataatactgtaatagtatgt

SEQ ID NO: 37048 - DNA, 652 bp, Homo sapiens
  misc_feature (395)..(395): n is a, c, g, or t
  misc_feature (614)..(614): n is a, c, g, or t
  misc_feature (640)..(640): n is a, c, g, or t
  misc_feature (642)..(642): n is a, c, g, or t
agtctgtgagctgggagcctgttggcaggtccctctttttattttcgctgagagctttcttttactaaatgccaccatccttacctttcaaggtgtctgcgtgcctaatttttcctggttgttagacaagaacccggattttagttgaactctggagcaaaaatcctgcatcatttgtaggtgggtgtcattgtgactggctgctacctccccatgagtcttctaaaataaaacctgcaaattcacatcttccccatgcttccagagaatgcatattcttcctttgaaaaaagaaaaccaggtagtcgtacagtgtccagaaggcaaaaggacaagtatgcactgccctacttacctactttccacactgctgcacaggaaaatctgacagaggncaataacaaacatctcaccagctcatgcgttcttttttgatcctaattccgagagactcaccaaagacatgaagagaaaacaaacaatacttttcttggaaatattgtaattgctggtacatttgttgttctggcataaagtagaaattgtcaggtaaacattgcttccttttggatcaaaaagaaatttaaccaaataaatgcaagaggtatgaggcnagataatgggaaataaatgagatttnanaaatcaaaaa

SEQ ID NO: 37049 - DNA, 552 bp, Homo sapiens
agtctgtgagctgggagcctgttggcaggtccctctttttattttcgctgagagctttcttttactaaatgccaccatccttacctttcaaggtgtctgcgtgcctaatttttcctggttgttagacaagaacccggattttagttgaactctggagcaaaaatcctgcatcatttgtaggtgtctgagtagatttggaaatgcccattcagccctcagagctcctctgctttaagggtgatggacttcctgtaccactacgtagtgcatgagtgccagccactggtatctagaactgtgattagtgaggaaacactaggaggaacaaacaacccaactctttttatctaatctgttgactccaaagggaccttctgcttattccagttaaaactcaagctgcaattcaaaatgaaatcagtatcttttttctctacttttcagcaaagcaagatgctaccttataattaccacgtaacaatcaatcgcatagtggttcaacttctctttagctacatattgcctggcagctgctgacttacttgtgttttt

SEQ ID NO: 37050 - DNA, 446 bp, Homo sapiens
acatctgacttctcaatagatatgatggaagccagaattcagttgaattacatctttaaataaatggctgttaaggaaataattgttcacctagaattctattcccagaaaaactatccttcaaatgtaaaggaaaaagacattcccagacaaacaaaaactgaaagaaatcagcagcagacatgcaccaaaaataaaatgaaacaaaacaaaaataaaaagctagatacagaagaaaattattctagcaaaagaaaaacacttcccacaaaagaaaataattcaagagataaacatggaaatgtagaaaggaatgaagatgaatggggaaatatgtgaataaatatagaatactttttaggatttaaaaaacatataaatataaagcaaatactaggctagttatgaaaataatacaactatcgtaatgttagttgtgagctaaa

SEQ ID NO: 37051 - DNA, 307 bp, Homo sapiens
taaacttatagattcctttgcctatgcttttgctccagaagcaaggccagggcccctgtgaattacggggatcagtgggagcccatggctgtctacctacttgttcacctgcttttagttatctggagacattgtgcctcctgaactgtacacatatgaaaaaatgtcaaggtcatcaatatttacctcttatgaacccaaaggtcccattaaaaaggtatcagttatttgtgggaatgttttagtcacctgacatgatgggagaggaggaagagcttggaactattaacattttattgtaatctct

SEQ ID NO: 37052 - DNA, 482 bp, Homo sapiens
cagcaggagggatgagttgggtttctgtaactacaagggccaagaagagggagaggatgatctgggaaggagagtggctttgggccagcatttgggccagcaggactcagaggcgagggaggtggtaagatcccttgcttgggatgagaggcagatggggaaactgaggcttggagcagagggaggggcagggcctgggcccccagcaggtcccagttcatgatggcatgctgcttctgcatgagtgagacatgagggggtcacagacgcccggaagcatcggcatcatcagatcatccgactcgataatagaaaaattaaaatttaaagtcactgaaagtgacgagtgacagaaatgttcctagaaactggagattgggtgctcagcggatctcaggatagatgatatcagacacaatgtcccctgggctgaggtttttttttgttttttgtttttttatgtttcagaattctaaggcaag

SEQ ID NO: 37053 - DNA, 373 bp, Homo sapiens
tctataaaaaaaaaaaaaaaaaagaatagtgtgtgtgtgcacacatgcttgctcacctgcatacacatgcacttgcacttattgtatgtaccgagcatgtggtaactgtggttgtcactgaggagagcaactgaattgcataggggcaggagtgacaggaaaacttacttttaaactttatattattttgtagcttgtgaatttaaagccatgtacatgtatcacctattcaaaaaataagttgaattaaaaaaactgaaaattggggaaatgataattttcactgtgaaaaattaaattattgcttgaaacagatctgaatcattcttcaatcacagatgaatgtgcactgccctgaaaaatgtacacattc

SEQ ID NO: 37054 - DNA, 323 bp, Homo sapiens
tggttagtattactttggctatgtaggcacttttttgatccatattaattttagggttttttttctagttctgtgaagaatactggtggtattttcatggaaattgcattaaatctgtcatgaagttgttcatttgaatttttttatgtagacacttttagttataaacttttagtactgcttttactgtaaatcctaagtatttccattgtgacatattacagaaatatttcaatttatttattaatatccccattgacccactggcctttcaggagcatattgtttaaattctatgtgtttgtatagtttcaaaaatttgt

SEQ ID NO: 37055 - DNA, 660 bp, Homo sapiens
cagaacccagaagttttaaaatgacttctttggataaaatggataggtcaatgccttcagaaatggaatccagtagaaatgatgccaaagatgatcttggtaatttaaatgtgcctgattcatctctccctgctgaaaatgaagcaactggccctggccttattcctccacctcttgctccaatcagcggtccattgtttccagtggatacaaggggcccgttcatgagaagaggacctcctttccccccacctcctccaggaaccatgtttggagcttctcgaggttattttccaccaagggatttcccaggtccaccacatgctccatttgcaatgagaaacatctatccaccgaggggtttacctccttaccttcatccgagacctggattttaccccaaccccacattctgaaggtagaagcgagttcccttcaggattgattccgccttcaaaggagcctgctactggacatccagaaccacagcaagaaacctgacaatattgttgctttcttcaaaagtaattttgactgatctcattttcagtttaagtaactgctgttacttaagtgattgcacttttctcaaattgaagtttaatggaataatagttctcaggatagtatttcgtaaataaagatggtttgaatatgaat

SEQ ID NO: 37056 - DNA, 342 bp, Homo sapiens
caggtgagtccaaacacactttccaaggaacagaaaatccctatattactttagttgtatcagaaaataaaagataagaaaaagttgcccaactcatttcattctaaaagtggattgaataggtataataaataaaagtaaattatagaccaatgtttaagacataggtacaaaaatcccagactttatattatttaaaagtaattacagcaatatgtataggaattaatacatcattatcaagttcaatttattccaggtatgtaaatatacttcaactttggtacaagtttggtacaacttcagacacattatctttcaggtaatttgctaatgttacta

SEQ ID NO: 37057 - DNA, 351 bp, Homo sapiens
ttttgttcctagtatgccacccagaaaccaaccccaagggccatacgtgattccctataaactccactccctgcagaaaggtgattttgccattctccccagtgtccacagcacctccagacctctgtggtcttcctgcttgtcttgtcattgaaataggcatctcagttgacatagtgccagtgcactgcctccctccctccctctctcctaaagatcttccaaatgcaatctcctctgcaattctctggaagaaggacacaatttttatgaaaagtgggcaacagacctaacaaaagacaggcatcattttatttttaaggcatcatgtggatttatctgatttgaaag

SEQ ID NO: 37058 - DNA, 213 bp, Homo sapiens
acccccaggtgctgtgctggcaggtggggcccacactctgggacttgcctctttagcctctgcacacaatctccagcagggcaaagaggacccagccttaggtgggcaccagtttttcagggcactcttgcttgagccacaaaagttttccctgagaaaggtgacattcagagaattacttcatctttaactttccaaactatttctaccata

SEQ ID NO: 37059 - DNA, 362 bp, Homo sapiens
agtcagcaataggtagatagatggatgaaggggttaggtagaatagatgggagtatgtagctttattagcatctttgcataatttattgcttgggctatgtggggtacctgcttggggactcttcttggaaactatcaaagagcaacatgaatccctcggtcatagctgggaagcttaggaattgtgactgtgcccagaacctgggtttcccattcttataatcctcttataaacacactcactcaactttggctggcattgttttcttgcctccctgcatgccctgaaagatgcttggagttttcagtgggttggggtggcagctcctctggtctggagcaccctcttgcgccacaggtcc

SEQ ID NO: 37060 - DNA, 406 bp, Homo sapiens
ggacccagaaggccccctgggacccaggcccccaagcctctgtaagaggccttgagcctcttcctcttaaaagataaaacactagccatgcgaggatttcctgagatgcctggacatcggtcctcactaagagtcagacagttctcgatccatcttcccatgggaccagggcacagccatgggtgttggtttcaaggagtttctcaggagtgtgaaggggagcacggaccagcacaaaaacagaattctgagtctgaaataaaggattagaaaccccttcttggccattaaaacctaaataactagaagatttgtttcctactttcttttaaaacaaaactaggcattgttgtgttgttgtttgttctttttgtttttgtttgtttgtttgtttttgagacagagt

SEQ ID NO: 37061 - DNA, 586 bp, Homo sapiens
acttaaaaactgctgccaaaaactgatttcttttcaatttcttttttaaaacaattttttaatgttatatttttattgcttttcatagagatggggtctctccccatgttgcccaggctggtgttaaactcctgggctcaaataatcctcccacctaggcctcccaaagttctaggattacagatatgagccaccgtgcctgtccctctcttcagtttcttatgaatgaatgagccttcatatagtgaacacattaataataggttcagccaggttctgcttatatcttttgcttaaagacacaagctgtaaactgtaggatttggaaaactttatagcaaagcggatggtggaccatagcatagtttcatttttatttacaaaacagacgaaatttatgggattttatacccagaagtagttggaaaggatagcaataatttattttcaacaaatatttattaatctctttctctgggctggatattgctccagagctgagaatacaactctggtcaaaaagagcttctgccttccagttggcagaaacagacacccataataaaatatcatattaaaaaaaaaa

SEQ ID NO: 37062 - DNA, 462 bp, Homo sapiens
ggcatcatcaacttgtgctatcaaatatatttgagtggtaaaaatatcttgtaatatactaagacaatgaaaatattcatttttgaaaactgatacatggcaaacaaattaaatgttgaatatgtttggtatttatattcagtaaaattttatttgggtgctttaaatatgtgtcaaggccaagcgcagtggctcctgcctgtaatcccagcactttgggaggccaaggcaggcagagcacttgaggccaggagttcaagaccaacctggccaacatgacgaaacccatctctactaaaaatacaaaaattagccaggcatggtgacacacacctgtattcccagctacttgggaggctgaggcaggagagttgcttgaacgtgggaggaggaggtcgcagtgagccaagatcttgctactgcactccagcctgggtggtagagtaagactccatctcaaaa

SEQ ID NO: 37063 - DNA, 358 bp, Homo sapiens
ccaaatgtcaagataacgacctaataatactcactggggatataaatagtgtggtctgggccacatagatccatttaccaccagtttaggaatttaccatcagtttaagaatttaccagttctttctccttaaggggcatctttggacagccttgaattggaagaaatggctgtctggagtctagcccaaagggccaggttggaggaagcagagaaggtggttattaaaatcaacaacattcgcaggagattggatcacttgctttcttcagtaaacagaaagagtagagctttggctgtgaattttttggtggttaatttttgctgtttttttctgccagcccctattgccaatctc

SEQ ID NO: 37064 - DNA, 573 bp, Homo sapiens
ccccctcttgctgcacagcacaccctctccagcatctcaggtgactttcactgctctacccattcccagaaaagctcctgtgtatcagcaaggctagcccagtatggcccaaacactcacattcaaggctcccaagtcatacaaatggtcccagggatattgactctagggccttggtggaaaatgcctactcacccacaggagtgggttgctgggatcatctgaagggcctgttattaccaagagaattctgtctcatatggattcatagtagatatggaattagcccagagtttcagacctggtcctgtcctgggtttcctgtcacctgtttaagtaccccacaggctctacacaacaggaggcctaggaaagcaccaaggtttggggtgggagcacaagtgcagggactaaagcagaagtttcccaagcccctagaggtgttcaaaagtagtcaaggtggcccatgagcccttttcaatatttcaaagaaatggtgctgaaaagaacacctttacctgtaataagcctgcctgagttaataaaaatatcactttttttttgctttaaact

SEQ ID NO: 37065 - DNA, 348 bp, Homo sapiens
ttgagatggagtcttgcttcttcacccaggctggagtgcagtagcgtgatcttggctcaccacaacctccatctcctgggttcaagcaattctcctgcctcagcctccccagtagctgggattacaggcaccaccacctatgcctggctaatttttgaatttttagtagagatggggtttcaccatgttggccaggctggtcttgaactcctgacctcaagtgatccgcctgccttggcctcccaaagtgctcgattacaggcttgagccatcacgctcagcctatgattttgttttcaatgaaaattaaacacaccagtttactcaagataaaagttttcagtcata

SEQ ID NO: 37066 - DNA, 211 bp, Homo sapiens
gagatgaagtcttgctatgttgctcaaggtggccacaaagtcctgggcttaagccatcctcccgcctcagcctcctgagtagttggaatataggtactcataaccacgtgtgggtgattattattagtttttaaacaaaaatggggctgggcgcagtagctcacgcccgtattcctaacactttgggaggctgaggcagcagatcacttga

SEQ ID NO: 37067 - DNA, 469 bp, Homo sapiens
tcctgtttgaatacccactagacatttaaagttctacaataaacccatcgaagatgcaaaaaaaagcgccctctgcaaaaacaaaaaaaccccacaatcaagcatccatcgactccccccaagtaaacaaaatggtaatatcaaaaaaacagataaagctgtcatcccacccaaaaaagcggagctgccgaccctggggtcccactaaagaagctgacacagttagctaaaaaaagcctaaaaaaacaagggtaatacaaactctagaaaatatactggttacagctttgataattgtatcaacggtggtaagtctcctcatgtctgcagaaacagctgcagctaattatacttactgggcctatgtgcctttcctgtccttaatttgggcagtcacatggataaataatcctattaaagaatatgttaataatagtgcgtgggtaccaggccccacagatgatcgttg

SEQ ID NO: 37068 - DNA, 495 bp, Homo sapiens
agaattgagctccttaaggtcctttatttgtctattttatttaatattttgccttttctccttttgaaaaaaattacaccaaacagattttaataccatactacatattaagataggaatatttgaatcaaatacccacagtatatttcttttatggatatgttttaaaaatctcttttcactgattctggggaaccaagtaaaatttgccactgtctcagtcataatagagtcaatgtggccaaccttgttcactgcctatgggaggatgtatgcagaccattattatttccaatcttgctccatggtttgcctgagcagccatcacacctaaaaggtttccaagatttgctacatatttatatatgtagttttccatatttgctacatatttatatacctttcttgaatataaaatccataacataaagtgtgttattgaactgaaagttcccaactgtcttgtggaaaggtataggtaaaatttaaagaaga

SEQ ID NO: 37069 - DNA, 133 bp, Homo sapiens
aaaagaacaaatttatgtgttgtgcatttggcgtaaaaaataaagtctatggtcataaaataattccaaaagggtatagaaaattgaagcttgtagggattttgtcaagtgacttgatcattttcattttctc

SEQ ID NO: 37070 - DNA, 361 bp, Homo sapiens
cacgatctcggctcactacaacctccacctccctggttcaagtgattctcctgcctcagcctcccgagtagctgggattataggcatgcaccaccacgtctggctaatttttgtgtttttagtagagacgaggtttcatcatgttggtcaggctagtctcgaacttctgacctcgtgatccacctgccttggcttcccaaagtgctgggattataggcgtaagccaccgcgcctggcctttcttcccttttcttttccttcctgctagtatgtgaatgtattatccctccccaggcctcatgcgctatccattggttaatttattcaagcaaatacttggtactaggatcaatataaaggc

SEQ ID NO: 37071 - DNA, 364 bp, Homo sapiens
attcatataccttctcgacgacctctgatttgttcagtacattttcagaatcactaacagtatacgggtctattaaagtgttaaatttgggtcactggctcatgtctgtaatcctggcacttcgggaggccaaagcaggagggttgcttgagaccaggagtttgagatcagcctggacaacatagccagaccccatctctataaaaattaaaaagttaaccaggcatagtggcacacgcctgtagtcccagctgttccagaggctgaagtaggaggaccacttgagcccaggtattcaaggttacagtgaactgtgattgaccggtgcactccagcctggggaacaaagtaagaccctgtctct

SEQ ID NO: 37072 - DNA, 648 bp, Homo sapiens
ggagggaattcgcaagtgccgccgacatcgcagctaaatctacaatcaaaagagttatgtggttacatctacctttcttcttcattcatatttaattacctgttggttattgagtcacgcaaatgccacaaggtcttactcatccttacaaactcaaggtcgccaagctgcacacactgggccgctgtggctgaaggtgcatagtcgcggatcataaacagagccatcttcgtgattgttaggctgagtctggatcttaaatagaagattttcctttaagtgaagtggctggaaggattggaccttctgtccggccaagatctgtttgccaaaaatgtgtcagtgcccccaggccaggctgtgcaggggaggcccttgggcccctgcaagcaggcgctgtggaggggcaggtctcggggcttcctgcttggcaccactgccggttaaccccttcagcaggctcgtgtggcccacaggcctcactctggggtgttcaccgtctgaccaggagagttttgttccgggtgaggatgcaccctttgtgtttaccgaggattataaatcagggaaatttcaaaacatgatggggctggcctccagctttctctcagaggaggctcatgttgttgattttgctttataaattat

SEQ ID NO: 37073 - DNA, 655 bp, Homo sapiens
gaatccatgagaaacaatcatagaagcatctgcttctgcttctaagacacatcaaaggtggtgagaaaaaagatgtcattgaaggagctctttccttagtgtattttatttgtaggcaggatagaagtatcctgctaaagtcataaaatagaatagtattttagaattagaaggagcttgactagtccagccccttcttgctttacagatgaggaaactgaggtcccaaaatgtggagtgatgtcacattgtgctggggatgtggagaggggtgtttgtcatcacgtggatggccacgtggctggctggggggcctcagaggggaccttctattccctctttatacaggagcccctgtctgtcttaagcacatggcttgcttcttgaaagctttcctggactccccaggcagtatttcctttgtgcattttaaactaaattttgactaaattaaaagcaatgaaatccaggcctcctggaagggtatttagttttcctttttagcagaacagttaagctaatgacagtgttagaagcctcaaccaccccatccagtgattgatatacatgcccccaaatttttgtagtgaaatataaaaacagtctataatctgattttgtaatcaaggtctagccaattacagtacatctcaaa

SEQ ID NO: 37074 - DNA, 541 bp, Homo sapiens
tcgtcgacatgaaatctggagattttcttgtacatttagctttctatgaaaaagacataaattgttaacccatgaattcatatcacttaataaattgacagccagaatgatatttctgaggcatttttacaataagaactcattggttaaaaagtcatgtaccttaggtgagataaaagtactaagtaaaggacctggggagacttggtaaagaaatcgttagaaaataaaggtggagccaggcgcagtggctcatgcctgtaatcccagcactttgggaggccgaggtgggtggatcatggggtcaaaagatcgagaccatcctggccaacatggtgaaattctgtctctactaaaaatacaaaaaattagccaggcatggtggcacccgcgcctgtagtcctagctacttgggaggctgaggcaggagaatcgcttgaacctgggaggcagaggttgcagtgagccgagatcgcgccactgcacactccagcctggcgacagattaagactctgtctgaaaaaaaaaaaaaaaaaaagg

SEQ ID NO: 37075 - DNA, 271 bp, Homo sapiens
gtaaacattagggctctttaaataagttatgactctctccagttggtgtttcaggattattcaattatccatggtgaaaggatacaactgtcattacctaacacaggcaaaatgcattattatttataaaaatattttcagaaacaaatttattattatttcctcaatcagcaaatttctaacctggcattaactatattcttgaaatattcaaacaaatccaaagaaaaatggttaactgctatccataaagattcctgaaataaacaga

SEQ ID NO: 37076 - DNA, 1092 bp, Homo sapiens
tttgcaaccagccagaatctctagtttaaactggcagttataacaaaagagaccctcaaatattagacagctgcagtgcagctttctgggtgcaggtgtcactctctgccacctatcactattctttttctgttcagtttttctctcaggtgtttgctgggaaattaacactggaactgacccttttctggcagtgaatgtaagctctagctcccccatctactataaagaaatgtcttcgagatgtagaaataaggaatattctgaaaataaaaattatacagtagtaaagataattcagaaagaaaaagctacctgttagaatttccagtctaaatggcacagggtagttacggagaaaaggggatggagaaggagaaactatgactaaagatgagaggtatgaacgagttgtcaggttcctatgggcttaagctaggacaatcaggccctaaactccaaatttggataaaatatctctttgcattcttcttggccacctgcatagtctgacacatacgtatgtacagttagacttgcaggctgcaggagtgccctgcattgttttcttttaattagaaataaaaagtattagtctaaatgtggttctggtgctggtgccctgtatatatgtaacaatataggacccctccaaataggttttgcttctggtgaatcttggtcattgggttagtatatgactgtctataatattttccatttgtattattatattggggaaaacattttttatcattttctattaagaaaatggaaaacttaaatatggtgttaaaaatggaaatatatgtgatatttgcattattaaacccctttgcagatctaaagtctcagggttccactattagtggttaaagtactgaataatgtctgggtctatttccatctgtaaaataagaatatttgtctcacgtgtctgtcatgaatagcaaatgagaaaatgtatataaaagcactttgtaaattgtaaaagtagtacagatgtgagcttctatttgtttagaagcataaatgtgaattatatacagtttgaattttgcataaattttttgtgtctaattttaaaaaaaa

SEQ ID NO: 37077 - DNA, 944 bp, Homo sapiens
tttgcaaccagccagaatctctagtttaaactggcagttataacaaaagagaccctcaaatattagacagctgcagtgcagctttctgggtgcaggtgtcactctctgccacctatcactattctttttctgttcagtttttctctcaggtgtttgctgggaaattaacactggaactgacccttttctggcagtgaatgtaagctctagctcccccatctactataaagaaatgtcttcgagatgtagaaataaggaatattctgaaaataaaaattatacagtagtaaagataattcagaaagaaaaagctacctgttagaatttccagtctaaatggcacagggtagttacggagaaaaggggatggagaaggagaaactatgactaaagatgagaggtatgaacgagttgtcaggttcctatgggcttaagctaggacaatcaggccctaaactccaaatttggataaaatatctctttgcattcttcttggccacctgcatagtctgacacatacgtatgtacagttagacttgcaggctgcaggagtgccctgcattgttttcttttaattagaaataaaaagtattagtctaaatgtggttctggtgctggtgccctgtatatatgtaacaatataggacccctccaaataggttttgcttctggtgaatcttggtcattgggttagtatatgactgtctataatattttccatttgtattattatattggggaaaacattttttatcattttctattaagaaaatggaaaacttaaatatggtgttaaaaatggaaatatatgtgatatttgcattattaaacccctttgcagatctaaagtctcagggttccactattagtggttaaagtactgaataatgtctgggtctatttccatctactaaataagatattcgacgtggagtaactctagt

SEQ ID NO: 37078 - DNA, 1675 bp, Homo sapiens
ccagccacaaagtaaacttcattttcaggcagtgtttctgggggaggttatggagggaagaaaaaagaaaaatcgatagtgagtgactgattgcttcattttatcaggcgggcccattgtgaaagagctcaggggaaatgtggaggttaaatatatttccagagttgtccagcagaaagaaagtggcactttgaagagaactagggaagtacatatcttcagatatccctatatagttctctaccttcagttttagtaacaattatgaagaattatttgtgctgacagcagcagttaaactttgtttctctaatagctttttttttacataaaaaaagacccaggaacttaatagtgtatgcataagactgtgttttttagcacacagatacccacagcatacactgacgatctccacgcagtagacaggttttgtcttcactagctcatttgtttatcaagtcatatttagggtcccacaccctcttttcctgtaatttattgcagaatacaccactttgacttggacagctttctgccccctctttcactaaggaaggcaaatgaagtgaaaaaaaaaaatgccattttcaatccttcctttctcccctttgttaatagtttaagtgaatttttgaccttatcttaatggaaaacggttaactccaaacacaaaagactctactggaaagtgtaggtgaaaaaacttgtaactgtattgaaaataaataccattaaactgtgatcagttaaaatttaaaagaaaaatcagcacaaaagggcgctaaaagggaaaacactttttattaatcttaaaagttgggggttttttccagttaggtattagataaatttttattttaaaaaatgaaagtctcactaccataaaattatggttcagcatcagattagcattgcactcagtagtctttaaggttttaggaaatatgctttatattgtcttttcaaacacctgtgattgtttcattttccatgtttttgcaagataaatggtgacttataatgggcatatttatttgcctgtatttcatttcccccaatgaatgtcacaaggagatgggcacggagctgcttcgggtgcatcacgctgctcgttcctgaggtatgggaactggcctttagtgaagctatccagagcagggcaaatagccactggtaaagggaggaaatgaatttccagatacttattaccaagtaggtaaggtcagaagctggagttcagagaatgtgtctacagcttctctgactcttataggtttactaagatgaaagttaccactgaaccttaccactatgtatatatgtttaatatctgtcttttgaaatgcagaaatagtttaaatgtttctttgtctatttttctttttttttaatgctacccagggaaatattttcatatcatttttaagtggcctgcctcaatgtatatttatttcttttgaaacaaaaaggttctggaaactgtttttctgtagctttaaatgaataggtgagcaaaatctatatgggatgtaatttttttgttcagtctcttaaaaaatactttgttttggtacatttggttgtgcttgtggggaaaataaaaacgcagagatccttatatatttatgttaaagtaatattttattatctacataaaacagaaatgcacaat

SEQ ID NO: 37079 - DNA, 969 bp, Homo sapiens
  misc_feature (15)..(15): n is a, c, g, or t
  misc_feature (80)..(80): n is a, c, g, or t
  misc_feature (89)..(89): n is a, c, g, or t
  misc_feature (96)..(96): n is a, c, g, or t
  misc_feature (105)..(105): n is a, c, g, or t
ccagggtatgctgcnattcacattataaccttttaaatacctatgccccttggatatgaggcattcactaaccctggaancatggatcntaaacangataatatngaatatctgaaccattggacttgtcctttagagtatatggcctttagttcttgtggaactaaatacagtgattctaagatcaaaagtcttagtgtttggggtttttttttcctctttttggatatggggtgtttttttttgtttttttgttttttttttttaagcataatgctgtaaaaactgtccaagcttatgttttgctggtgattggtttaaaactgatttttatgtatccaaatgctagcataaattagattgactatcctggtgactgtagtagttaatgtaacacattttgtataaagtacagtttatatagtatttaaactaattcagatgaagttttatttcttgaaaacagttatttcctttttgtttattagcatgtgtataaacacaaatcacatgttcataaataaagttaacattcttttagccttgtgtgttccggcatgtctgtattacatttataagaagcagtttatttaagcttatttaggtttctcttttcttttcttttttttttaatactttaaaattggctttaatttttaggtagaattatctgaaatagagatattagataaccttgttgtccccatcatttatttgcttggggtacatttgctggcatttaagatgagaatatattcatcaagcataattagtgcccatcttaggagatttagagtcacgtggattgtacacattcacaaaagcaaagtaaatagaggcgctaagccaaatttttcttatcctgattagtaaagtaaatgtatagttttggtaatggaagcgaactctaatcaagaatggatggctgtttccatatttcccagtcttgtttttagtcatccatccatg

SEQ ID NO: 37080 - DNA, 413 bp, Homo sapiens
gatgcacctaacatgtcacgagggatgaatgtttcttgctgggagctggtagggcagggccttgcagaatagttgagctttaaacatgtgacaacctgaggatggaggagtagtagaaggaattctaatggggaggaatggcctgagcaaatgcagaagtcaaaacaaaggtcagggtacgcagagaggagagaaggtggtatactctagctggatggacaagagaatgtgatggggagtagtaggagccgaggtgtggaaggcaagatgacattagactgtcaaggtccctgaatgcctggctttggggttagagccttactcactcagcagagaaaagccaaggaggggatttggagtgggagaatcataggtcagaggtgcactcaggaacatggattttgttgttgggt

SEQ ID NO: 37081 - DNA, 401 bp, Homo sapiens
tttttaatatggagtctcagtctcttgccagtctgaagtgcagtggtgcagtctcggctcactgcaacctctgcttcctgggttcaagcaattctcctgcctcagcctcccgagtaagtgggattacaggggtgctctaccacacctggctaatttttgtatttttagtacagacagggtttcaccatgttggtcaggctggcctcgaactcctgacctcgtgatccacccgcctcggcctcccaaagtgctgggattacaggcatgagccactgcgcctggccaaataaaacatatttttaacgaataaaaattaaggacaaagaagagcattccttatagaatgataaaggacacaattcaaccagaagacctagcctaaatatgtacacacccaacat

SEQ ID NO: 37082 - DNA, 295 bp, Homo sapiens
tttagaggagcgcaggatctggcagttaggattcatgtaggctaaactggagaaggaagagatctccagtgtatatttcagtgtgacttcccactaccgttcagtacttaatctggacagagagataatgggcattcaacaaattcctatggaattaataatgaggcagaaataacgatctggtagaaacactggggccaaagcattgttgacaatgagttggaggcttataaatttgagatggaggtaataattgaaattacaagggaatgaaaacttgaagaaaaaagagaaa

SEQ ID NO: 37083 - DNA, 552 bp, Homo sapiens
ggctttgaacaaacaagcagcggaaacatgcagaatgcctgcagaaaaactgaggcacaggcagcggcacaaggaattttatttttagagtccaccctgtgaacagggtcttgtgatgttcatgggcaggatggtaggtgtgctgggagtcactgcattcctctactcccagctcaaagaaggggagaaagagccattcagtggggagcgttcccagcatcctcctccctgccacagcagccagaggcagggagctggccggcctttcctttaactctttgagtgccctgacaaaaccttttttctaggtcacgtcagtgttcttgtattttcaaaaagtgtattcgtgtgttgagagttgaacatggagagaaaattaattttcttcccaacaatttgtgttggtgaaatacatgattatatttatcccatttttaatactctgatataggaaagggaaaaatagtcatcttcgtctattcaatttaaaggaacttttctaaacaagatacataatagatgccgaagctccaattaagttgctcaaaaaaa

SEQ ID NO: 37084 - DNA, 2227 bp, Homo sapiens
cagcggagcacagcagtgacgacacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggtcacattcactaaatgtctatatgcacaattggtgcaacaaaggtttgtgccagaccggcggagtggatacaggctgcctcctccatctgatccccagtaccgagcccatgaattgggcatgaaattggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaaccagcacatttagcttctcttttttctttttaaataaatattgaatatgattctgttca

SEQ ID NO: 37085 - DNA, 681 bp, Homo sapiens
aacagtgttcatagaaccatctaaaagagttcagatgttacttctgcattgttctatgtggtttatattttggaactttaaacatagttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggtaaggctcttttacttgtttggattagtgtgacttttaatgttatcctgacaacagtgatgtgtaatagtccacgcttcattcagtgttgccaggaagagattaatacacaaaaaaaatcatattaatgaaaactttctaaatttgccttaggaattagcatatactaaacattattaaactcatggctattcttttgaactttagttactacactatgccataatgtatctaagtatctatactaaatattttgtatttttagtagagatggggtttcaccatgttggccaggctggtctcaaactcctgacctcagatgatctgcccaccttggcctcccaaagtgttgggattacaggcatgaaccaccatg

SEQ ID NO: 37086 - DNA, 3099 bp, Homo sapiens
cagcggagcacagcagtgacgacacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggtcacattcactaaatgtctatatgcacaattggtgcaacaaaggtttgtgccagaccggcggagtggatacaggctgcctcctccatctgatccccagtaccgagcccatgaattgggcatgaaattggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaaccagcacatttagcttctcttttttctttttaaataaatattgaatatgattctgttcatttctagtttagattactcatttagtaaaaatgtttcttcattacaagttttacagattgacttctccatgagccccaaatgtggccctcttggcacaagtctttgtgatctcagctgtgggttatacacaggttttgaactcggcagggtagaatctagcccctagacaaccttgagatgaaattcacacacttcatgctaaagacataccctaccacaatatacccttggagtaattctaaatatttaaatttctcccttactgctattcatcctcagatcaaaatttcaagttgacaaatttggatttgaaaactcattcactttttcaatttttttaatgaggcataacatgcatatggttaagtgcacaaatcttaagtgtacagtcagtgaatttttgcatgtatgtatgtacctgaagcaagatatagaacttatttacttgtaaataacagctatattgatatgtcacataccaaaaaatttaccctttaaattatacaattcagtggtttttagtatatttacaaaattgtgcaaccatccctaccatctaattctagaatattagaaaccccatactcactaatagtctctcattcccttctactcccagcccctagaaaccactagtctactttctgtctctatggatttgcctattttggatatttcatacctgatactgtacttaattgttttaattaattaattggtttgatatttaatataactgatatatcttttgctaagatgaaatgtttatttcttaaaatgatgctcatattcctcctaaaataaatcaagtattatctatatatcataaaattcaccattaaaagcaaaaaaaaagtcttctttacagaca

SEQ ID NO: 37087 - DNA, 2164 bp, Homo sapiens
ggctggtacggtccgaaggtcgttagatgtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggtcacattcactaaatgtctatatgcacaattggtgcaacaaaggtttgtgccagaccggcggagtggatacaggctgcctcctccatctgatccccagtaccgagcccatgaattgggcatgaaattggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaaccagcacatttagcttctcttttttctttttaaataaatattgaatatgattctgttca

SEQ ID NO: 37088 - DNA, 2173 bp, Homo sapiens
  misc_feature (25)..(25): n is a, c, g, or t
acgggctaggtgagccggcggtgantcggccgaggcggccaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggtcacattcactaaatgtctatatgcacaattggtgcaacaaaggtttgtgccagaccggcggagtggatacaggctgcctcctccatctgatccccagtaccgagcccatgaattgggcatgaaattggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaaccagcacatttagcttctcttttttctttttaaataaatattgaatatgattctgttca

SEQ ID NO: 37089 - DNA, 2120 bp, Homo sapiens
cagcggagcacagcagtgacgacacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaatggcattgtggcagtgctaaagcagcgccccagattggtggctgcagcagtccaggcattttacctacgagaccctattgacctgcgagcttgtcgtgttttcaagacattcttgcctgaaacacgaataatgacatcggtcacattcactaaatgtctatatgcacaattggtgcaacaaaggtttgtgccagaccggcggagtggatacaggctgcctcctccatctgatccccagtaccgagcccatgaattgggcatgaaattggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaaccagcacatttagcttctcttttttctttttaaataaatattgaatatgattctgttca

SEQ ID NO: 37090 - DNA, 3045 bp, Homo sapiens
cagcggagcacagcagtgacgacacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggtcacattcactaaatgtctatatgcacaattggtgcaacaaaggtttgtgccagaccggcggagtggatacaggctgcctcctccatctgatccccagtaccgagcccatgaattgggcatgaaattggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaaccagcacatttagcttctcttttttctttttaaataaatattgaatatgattctgttcatttctagtttagattactcatttagtaaaaatgtttcttcattacaagttttacagattgacttctccatgagccccaaatgtggccctcttggcacaagtctttgtgatctcagctgtgggttatacacaggttttgaactcggcagggtagaatctagcccctagacaaccttgagatgaaattcacacacttcatgctaaagacataccctaccacaatatacccttggagtaattctaaatatttaaatttctcccttactgctattcatcctcagatcaaaatttcaagttgacaaatttggatttgaaaactcattcactttttcaatttttttaatgaggcataacatgcatatggttaagtgcacaaatcttaagtgtacagtcagtgaatttttgcatgtatgtatgtacctgaagcaagatatagaacttatttacttgtaaataacagctatattgatatgtcacataccaaaaaatttaccctttaaattatacaattcagtggtttttagtatatttacaaaattgtgcaaccatccctaccatctaattctagaatattagaaaccccatactcactaatagtctctcattcccttctactcccagcccctagaaaccactagtctactttctgtctctatggatttgcctattttggatatttcatacctgatactgtacttaattgttttaattaattaattggtttgatatttaatataactgatatatcttttgctaagatgaaatgtttatttcttaaaatgatgctcatattcctcctaaaataaatcaagtattatctatatatcataaaattcaccattaaaagcaaaaaaaaagtcttctttacagaca

SEQ ID NO: 37091 - DNA, 2139 bp, Homo sapiens
cagcggagcacagcagtgacgacacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaaggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggtcacattcactaaatgtctatatgcacaattggtgcaacaaaggtttgtgccagaccggcggagtggatacaggctgcctcctccatctgatccccagtaccgagcccatgaattgggcatgaaattggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaaccagcacatttagcttctcttttttctttttaaataaatattgaatatgattctgttca

SEQ ID NO: 37092 - DNA, 2452 bp, Homo sapiens
cagcggagcacagcagtgacgacacacaaggtttcggggactgagtgggtttcagactttctctcaggatttccgctggcttcaggttccggtcaggcgtcgggacagagcctgatccaggcttcggcggccggtggcagctctcgatcagctctcgcagtcggagaggcggctaaggaaaggtgccacagcagagacgcgaaggagaggccctagaaccttttcaaagaagaatggaagaaaccatgaagcttgctacgatggaagacacagtggagtactgcctgttcctgataccagatgagtcaagggactcagataaacataaagagattcttcagaagtacattgagagaataatcactcggtttgcacctatgctggtcccctacatctggcagaatcagcctttcaatcttaaatataaacctgggaaaggaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggtcacattcactaaatgtctatatgcacaattggtgcaacaaaggtttgtgccagaccggcggagtggatacaggctgcctcctccatctgatccccagtaccgagcccatgaattgggcatgaaattggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaaacggagtctctctctgttgcccaggctggagtgcagtggcgctatcttggctcaatgcaagctccacctcccgggttcacgccattctcctgcctcagcctcctgagtagctgggactgcagcgcccgccaccatgcccggctaattttttgtattttttagtagagacagggtttcaccgtgtcagccaggatggtctcgatctcctgatcttgtgatccacccgccttggccccccaaagtgctgggattacaggtgtgagccactgtgcccggccgagttaaatatatttctaacatagta

SEQ ID NO: 37093 - DNA, 1955 bp, Homo sapiens
  misc_feature (25)..(25): n is a, c, g, or t
acgggctaggtgagccggcggtgantcggccgaggcggccaggcgtcgggacagagcctgatccaggcttcggcggccggtggcagctctcgatcagctctcgcagtcggagaggcggctaaggaaaggtgccacagcagagacgcgaaggagaggccctagaaccgaggtgttcctgctcatatgtttggcgtgacaaagtttggggataacattgaggatgaatggtttattgtttatgtaataaagcagatcacaaaggaatttccagagttagtagcaaggattgaagacaatgatggtgaattcttgttaatagaagctgctgactttctccctaaatggctggatcctgaaaatagcaccaatagggtatttttctgccatggggaattgtgtattatccctgcaccaagaaaatctggagcagaatcttggttacccaccacacccccaacaattccacaagcattgaatataatcacagcacattcagaaaaaatacttgcttcagaatctatacgagctgctgtgaataggcgcatcagagggtacccagaaaaaattcaggcctcacttcatcgagcacactgcttccttccagctggcattgtggcagtgctaaagcagcgccccagattggtggctgcagcagtccaggcattttacctacgagaccctattgacctgcgagcttgtcgtgttttcaagacattcttgcctgaaacacgaataatgacatcggtcacattcactaaatgtctatatgcacaattggtgcaacaaaggtttgtgccagaccggcggagtggatacaggctgcctcctccatctgatccccagtaccgagcccatgaattgggcatgaaattggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaaccagcacatttagcttctcttttttctttttaaataaatattgaatatgattctgttca

SEQ ID NO: 37094 - DNA, 1143 bp, Homo sapiens
ggaagtgacaatgaagaaaagaagcatcttgctgcaagtaaccaacaagccattaactgaggctcatggatttgagatcttatgctccaaatgtagcccacatttttctgactgcaagaaatcccttgtgactgcctcaccactctgggccagtttccttgaaagtctgaaaaagaatgattactttaagggactgatagaaggttctgctcagtaccgggaaaggctagaaatggcagagaattacttccagctctcagtagactggccagaaagttctcttgctatgagccctggtgaagaaatcttaaccttattacagacaataccatttgatatagaagaccttaagaaagaagcagctaatcttcccccagaggatgatgaccagtggttagatctctcaccagatcagctggaccagctgctgcaggaagctgttggcaaaaaagaatccgagtctgtttccaaggaggagaaggagcagaactatgacttaactgaagtctcagagagcatgaaagctttcatatccaaagtctcaacccacaagggagcagagctgcctcgagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaaccagcacatttagcttctcttttttctttttaaataaatattgaatatgattctgttca

SEQ ID NO: 37095 - DNA, 615 bp, Homo sapiens
tgcacagctatggtcccagctactggggaggctgaggtgggaagaaccttctgaggctccaatcacttttgatgcagattcttttcttaattattttgataagattttagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaaccagcacatttagcttctcttttttctttttaaataaatattgaatatgattctgttca

SEQ ID NO: 37096 - DNA, 521 bp, Homo sapiens
cttgggatctgtgtagggccaaggcctaatgagtcagattctgatgatctggatgatgaagactttgaatgtttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggaacctgtatcccagactaccgataacaattcagatgaggaagattctggtacgggagaatctgttatggcaccagtagatgtagacctgaacctggtttcaaatatattggaatcctatagctcccaagctggactggcaggacctgcttccaatcttttacaaagcatgggagtgcagctgcctgacaacaccgatcacagaccaacaagtaagccaacaaaaaattaaccagcacatttagcttctcttttttctttttaaataaatattgaatatgattctgttca

SEQ ID NO: 37097 - DNA, 433 bp, Homo sapiens
tttttttttggcacagggtcttgctctattaacccaggctagagtgcagtggcatgatcacagctcactgtagccatgactgcccaggctcaagtgatcctccccaattcagcttcccaagtagctgggactacaggtgtgcaccagaatccctggctaaattttttgttgttgttttttgtagagacaggatctcgctatattgcccaggctgatctcgagctcctggccttaagcaatcctcccaccttggccacccaaagtactgggattacaggcaggagcaatgcactcagctcagtttttttttttttttggggggggggttccagcggtatattttatttctttagaacatcggttgcaaagctgtttagatctttcaaaaacatcaactcttctttttgacgacaaaatggtgaataaattcaga

SEQ ID NO: 37098 - DNA, 213 bp, Homo sapiens
caacccttaacagagctatcctcatgcaacagagaggcgtggaagagagtggttaagaatacggatttggtcgggtgtggtggctcacacctgtaatcccagcagtttggaaggctgaagtgggaggattgctggagcccaggagtttgagaccagcctgggcaacatagcgagaccctgtctctactttcaaattttttttaaataacaatt

SEQ ID NO: 37099 - DNA, 1892 bp, Homo sapiens
  misc_feature (1257)..(1257): n is a, c, g, or t
  misc_feature (1858)..(1858): n is a, c, g, or t
  misc_feature (1879)..(1879): n is a, c, g, or t
  misc_feature (1887)..(1889): n is a, c, g, or t
  misc_feature (1892)..(1892): n is a, c, g, or t
acggcgtcggttgcccgggcaatgggccgcacgctacgaggcccacacacccagaaggtggagccccggccgggttacgaggaccacccagctgtctggagagatgaagaaaatgaggttcaaagagatgaagtctcttgcctaaagtcagtgacagaaagtgacagagctgggatgtgaatcctggtctgactctacagtcccacatggtagatggaacctccgagcaacacctaaacaaagggagttgatgcctccgaacagagtaatgtcgctggagacactaagcatcgtcggcccctggcaggagctccctaaatatgtgttggatggatggaagaaaggatggatagttcagagtacttcagccttgattcctccgcaacagacacctgaaacttgaccctacattggttcttggccatcgtgatcttccttggacagaatcacctttcagctccggtcatcagactttcccagggccctcagaaagcccttcagagttgttactcacaggcaggctgagggattccttacggggtctgcagctctcctcacctcatccacaagtaggaccgtggcctgttcctcactactgccccaggatcactctgttcccagcccagtccagcaatcacttgtctagctttctggaaccttgagtactttcttgaaccatgagtcctgtgaccaccctagcagctctaaccctcccttatctgaaaggaagtgtgaggtgaccttgcaggtcccagagttgattgaagaccccatccagaaagaaggcaccctgtgggagagattgcaaggcctaggtctgaatccggaagcttccaccccatggagaagggctggcaccagcctggggctggcagtggagctgagctttggagccaaggactgtactgcagtgcagggagagtgaggccagaaaggctgagacaactcagggaaagaaaacctcccttctggctaatagtcaagcaccgcctgagtagaccaacactctcctgtccacaggggcagcagatgaagacacaaccagagaggactaacaggccccctcagctctcagtcagagggcagagcaacacagaatagacattaaaggaacagactttgaggccaggcagccttgggtgtgcatctgtccctactaagccatgtgacattaaacaagtgagtccacctctctgagcctcaggttcctcatctgtaaaatggggattataagagttcttgtttctcagggacaangtgaggattaagtgagatgatacacatagagaatgtggtgcagtactgggcacatggcaaagatcagtgatgctagctaccacttatcattagtgttcctgtagaccaggacttctcaaccttggcactattcaccttttgggccagaaagttttttttgttgttgttgtggggagctgtcctatgcatttgaggatgtttaacagcacccctggcctctacccactagatgccaatcacaccacacccccagtttcaacaaccaaaaatgtctgcagatggtgccgaatgtcttctggagggtgaaatcactccccagcagttgaaaagcaccaccctaaacaatctggactgaatttgaatgtcacagatcccaagctcacagctccatgtaaaggccacaaggcaggcaggcctacttgcagatgaaggaacggaaagagcaacaattacagatcaagcggctagctccggtgtagactaagaggcgggatctgtagtctgctctaggagctaacaaggcctctgtgactcagtaggtgacctcagtgtcactctttaattatatgcaaagtggtcttgtgttaactcttaattattntagggctccaaacaagaaaanaggtagtnnntan

SEQ ID NO: 37100 - DNA, 1874 bp, Homo sapiens
  misc_feature (1239)..(1239): n is a, c, g, or t
  misc_feature (1840)..(1840): n is a, c, g, or t
  misc_feature (1861)..(1861): n is a, c, g, or t
  misc_feature (1869)..(1871): n is a, c, g, or t
  misc_feature (1874)..(1874): n is a, c, g, or t
acggcgtcggttgcccgggcaatgggccgcacgctacgaggcccacacacccagaaggtggagccccggccgggttacgaggaccacccagctgtctggagagatgaagaaaatgaggttcaaagagatgaagtctcttgcctaaagtcagtgacagaaagtgacagagctgggatgtgaatcctggtctgactctacagtcccacatggtagatggaacctccgagcaacacctaaacaaagggagttgatgcctccgaacagagtaatgtcgctggagacactaagcatcgtcggcccctggcaggagctccctaaatatgtgttggatggatggaagaaaggatggatagttcagagtacttcagccttgattcctccgcaacagacacctgaaacttgaccctacattggttcttggccatcgtgatcttccttggacagaatcacctttcagctccggtcatcagactttcccagggccctcagaaagcccttcagagttgttactcacaggcaggctgagggattccttacggggtctgcagctctcctcacctcatccacaagtaggaccgtggcctgttcctcactactgccccaggatcactctgttcccagcccagtccagcaatcacttgtctagctttctggaaccttgagtactttcttgaaccatgagtcctgtgaccaccctagcagctctaaccctcccttatctgaaaggaagtgtgaggtgaccttgcaggtcccagagttgattgaagaccccatccagaaagaaggcaccctgtgggagagattgcaaggcctaggtctgaatccggaagcttccaccccatggagaagggtggcagtggagctgagctttggagccaaggactgtactgcagtgcagggagagtgaggccagaaaggctgagacaactcagggaaagaaaacctcccttctggctaatagtcaagcaccgcctgagtagaccaacactctcctgtccacaggggcagcagatgaagacacaaccagagaggactaacaggccccctcagctctcagtcagagggcagagcaacacagaatagacattaaaggaacagactttgaggccaggcagccttgggtgtgcatctgtccctactaagccatgtgacattaaacaagtgagtccacctctctgagcctcaggttcctcatctgtaaaatggggattataagagttcttgtttctcagggacaangtgaggattaagtgagatgatacacatagagaatgtggtgcagtactgggcacatggcaaagatcagtgatgctagctaccacttatcattagtgttcctgtagaccaggacttctcaaccttggcactattcaccttttgggccagaaagttttttttgttgttgttgtggggagctgtcctatgcatttgaggatgtttaacagcacccctggcctctacccactagatgccaatcacaccacacccccagtttcaacaaccaaaaatgtctgcagatggtgccgaatgtcttctggagggtgaaatcactccccagcagttgaaaagcaccaccctaaacaatctggactgaatttgaatgtcacagatcccaagctcacagctccatgtaaaggccacaaggcaggcaggcctacttgcagatgaaggaacggaaagagcaacaattacagatcaagcggctagctccggtgtagactaagaggcgggatctgtagtctgctctaggagctaacaaggcctctgtgactcagtaggtgacctcagtgtcactctttaattatatgcaaagtggtcttgtgttaactcttaattattntagggctccaaacaagaaaanaggtagtnnntan

SEQ ID NO: 37101 - DNA, 156 bp, Homo sapiens
ttactgaccatattggcttatgaatacagatgcaaaaattctgaataaaatattcagtagcatatgaaaagaatgtgaacatgaacagtttgttttagaaaggccagaatgagtttgatcagaagatcttttagggtaataaattaaaggaggaaa

SEQ ID NO: 37102 - DNA, 353 bp, Homo sapiens
cctgccccttgttctaaaagttaactattaaaccatgtgcggttcatcctgatttggtttactcaattctagaaacaaggacatgctgatcagattgccctgggcaattgaatacctactgaagcctttgggaagacagtgttcttcccaccacccctacttaaaaggcttctgttaccagactatcaattctgtgttactggtgaaggatagaaagtatcttcttttgaaggacaagtttttcactcactgagttttctgctttgggtatatactcaacatgttaagtgcttaatcttttttcccccattcccctttttctactgtagtgtgttttgtttgtttgttttttg

SEQ ID NO: 37103 - DNA, 707 bp, Homo sapiens
tttcggcacaggggacacaaatccaaaccatattagtgtacttgaaaagaatgtgttttctatattgttggtgcaatattttatggaccaagttagttaatcatgtttttcaatcttctatatcttactgatttttttcttttttgaaacagagtcttgctctgtcgccgaggctggagtgcagtggcgcgatctcggctcactgcaagctccgcctcctgggttcatgccattctcctgcctcagcctcccgagtagctgggactacaggtgcccaccaccatgcccggctaattttttgtatatttttttagtagagatggggtttcactgtgttaggccagggatggtctcaatctcctgacctcgtgatctgcctgcctcagccttcccaaagtgctggggattacaggtgtgagccactgcacccagccttactgatgtttttgtatgcttttgctatcagttactcagagaagttgttaaaatctctaactatgtaaatggaatgttatccctgtttttagttctgtcaagttctcctttacatattttgaacctgtattattaggtacatgttaattttttaatgtatacgattgttagccctcttaataaggtataatatctcttgtaatatttcttgtcttagagtctactttgttttatattaataaagcacaactgttttcttttggatagtgttt

SEQ ID NO: 37104 - DNA, 428 bp, Homo sapiens
tgacaagcacctaagactgactgtccccaaaataacctgtaaaaattattataaaatacacataacaaaatttgccatcttaatcatttctaagtgtaccattcaggagtgttaagtacatccacttttttgtacggccaatctccggaactcttttcctcttgcaaaactgaatctctatccccattaaacaacaccccatttcccccctaccccgacccctggcaaccaccattctgctttctgtctcaaaaataaaataagataagataaaaaaataaaatataaaaatatcatttaaaaaataatattttctgtttggattgtcacaacaatagttgttggaataagggtgatgttaatttccttttttagattgaatgcctacttgtataatttaatatagttttaaaatgagcaaaaaaaac

SEQ ID NO: 37105 - DNA, 1265 bp, Homo sapiens
ttgactaaacacactgtctcctagggacacagttctgtgtagttaacaggaaatatttattgagtttctatgtggcaggccctgaactaagctttcttttgtatgatttcatttgctccttaaagcaaccctgtgaaatttatatattgtcatcactcccattcgacaggtaaagcattcgaggcttggagagttcaagccactttccctcctcactcagccagtaagtggtagagccaggttcaaacccaggcctgcctccctccaaagtccactttatcatgcttccccagaagaaaatggccacttataataaaaaggtaaattagggccaggtgcagtggctcccgcctgtaatcccagagctttgggagaccaaggcaagaggatcatttgagcccaggtgttcaaggccagcctaggcaacataacgagaccctatctctacaaaaaaaaataataataataatttttctttaattagccaggcatggtggcaagctcctgtagtagtagctactcaggaggctgaggtgggaggattgctggagcccaggtcaaggctgcagtgagctgtgattgtgccactgcactccagcttgggtgacagagcaagaccctgtcccaaataaataagcattatggtttatgagtcagcctcttaagcattcagtgaccagaatgaaggaggaaatagtaaattccttgagcttacaaaacggagccccatatcctgagtgtagggtgaccccactaaggtgtagccaggttcctggtctcttcctagactctctccttaccttcctatggccagcctccgttgtcaaaagaaaaaaaaaaaaaaaaaaaaaaaaaaaaaaaaaaaaaaaaaaaaaaaaaaaaaaaaaaaaaaaaaaaaaaagaaaaaaaaaaaagaaaaaaacaaaaaaaaagagagaagagggggcggcgagcagagaaaacaacaaccgcagcgagaggccacacagatcaggccgacacacagatatcagagagacaggagaaagaaagaggcggaaatataagagagagcgcgggggcgaataaaaagcagcgcggccagagaacacgcgccagacgaaacgagcggaaaagacaccacaccgcggggggggcacagaaaggagagcaacacaacagagaagaaagcacccgcagagagagagaaacaagaggagagaagaaggcaacccacacaaaacgccgggaggagaatacggcaccgaggggataaaaaaatacgg

SEQ ID NO: 37106 - DNA, 494 bp, Homo sapiens
gggagatgaggagagaaagatcagggaggaccatattgtgaaatgcatgccttgaattgctggctaaaggttagggggctgggggttttcagtactagcttagacagtagatacgaattttagtcccgactctaaaatgtagtagtacctcatatggttagggctttgtcacttgtctgggagctgtaaaatcgagcaaataatgtgtcatatctgttttcataggttgttgtgaggctttaatgagataatgggtgaacatgaaagctctgtaaattacagtcatctctcagtatccatggggggttgattccaggacccccctcaggtaccaaaatccccaggtgctgaagtctcctgtgataaaatggcatagtatttgcatataacctacatatgtcttcccatatattttaaattatctcttgattacttgtagtaactaatacagtgtaaatagttgttatactgtattgtttagggaataatgacaa

SEQ ID NO: 37107 - DNA, 387 bp, Homo sapiens
  misc_feature (11)..(11): n is a, c, g, or t
  misc_feature (54)..(54): n is a, c, g, or t
tgagacagagntactggagtgcggttgtacaatattggctcactgcagcctctnctttctgtgcccaggaattctcttgcctgcaggagaattgcttgaacctgggaggcagaggttgcagtgtgccaagatcgtgcccctgcactccagcctgggtaacaaagcgagactctgtctcagaaaaaaaaaaagaaagttatctctaaaaataaggaattgcttaaaagcattattgtttttgattgagttactctttattaaaactaaaattttgtagttattctatttaattttaattgaatgtaatatcaaataatctaaccagtgatctgttggtgtgatggcctaatggcaaataaagtctttgcatacaagtttataatgatt

SEQ ID NO: 37108 - DNA, 785 bp, Homo sapiens
cttttagctatgaaatattttggattgcgtagggtcttgcgcagccgcgaaaagtagcgtgggccaggacagcgggaggtaagtcgccaagaaaagggttgggaagagctcagaatcggacggctaggaagaaatgaccaaaaggagcctgatagccccctattctgcacgctgttcctggaaaccgcctttgcaaagacagtgagagaaatctaacatggctcactccatcttgcttctagcctcgcaggccggctgtcttcgctcattcctgggcataaaccaagctaaccatgggagaatttatagtttaacttttaagcaaggatgatcatagtcccttccttaaacagggcccctccttgtttgggggctgaaactgcctttataaaactaatgaaagaccgggaggttaggattatgaggggagaattctgctaaaatgtagtaaacgataaccagccattgtttcggaggacatcggatgtgtaacttccccaattattcctgtagataacgttatcgtagcacctaagattggtcttttgaggcatttttcagactttcgcattctggcaactaactgaccccacccagactcgtgacccatgacccaaccgcttcttctgtcccactcctcccccaagaggcggactcagctgttgaggagtgtagtccacacccctgtgattgcatctccaaccaatcagcagcatccattccctagtgccctgcccacaccaaactatgaaataccctaacctctgagctgacccttcaggaaa

SEQ ID NO: 37109 - DNA, 1321 bp, Homo sapiens
tgcggccgctggcgacactaggcgcactgaagcccgagccgagccgagcccgagccgccgccgccgccgccgctgctgcgcaccgctcccgggctccctcccagcgcgccggccggggtgtggggggcggcgggccggaggggcgagggcgggccagggggcgcacacgggggttggcgcggaagacaggaccctcagcctcgagggagcccctaggtgaccaggcaaaatggcagttccttccagctggtcctcagatgggcacatctattagcctctgctcttgtaagaagttagctgcagaacccacatgtgaatccttgtaggactctggagaagatcaaatgggagcttagatgtggaagctctttggaaaccaagaaacactctgaaaatgaaaagggaacagtttgtggacttgcgctggcccttggaccacacttcgagtgacattgttatagatgacacggtctcttataggaaaatgcacagtctttcttagattctctacctccctcttccatctcattcccaacatagatctgggtacatgagtggggtcttattataatcttgtgacacccttggatcatgcactaccctctaaataatcaatagtttctactatagagaggctcaatttatcttctccctggaattgggaccactgaaatataactagaacccaactgatcttttgagatgttgtgtgcttgcccttactgctactgccgtagttctgaacatttccccaagcatcaaaaaggccccatggcctcttttcccctagacctctgccagtccaccaacactctcagtggggaagtaagaagcctggtggatcctgcttcccacacaaaggccatgatgagacagatgctttctaagtccgatatatctacccactttctgctgtcacctctgtacctcctgagtcacatggaatgtggtgctgagccaaatggtcagtcttctagaagcagtggaatgttggaggcagcttataccttagctgattcttaaattttcaggaattttgtgagccagtttttaaacacagccattgttgaaaattaaacaatataaacttataatcaaatatattaaaaataaagataatgccctcaactcaaaaaaaaaaaaaaccaacacaaaaaaactacaacaacaaccacaacaaccatcaccgcacccacagcgaaccacacagccgaaacagcaaaacaaagacgcacgcataaagcaccataaccaccataatgcaagatactcacaagtggcgggtctcgcccaacccacccgggcgtcgcctcatctccgt

SEQ ID NO: 37110 - DNA, 616 bp, Homo sapiens
tgcggccgctggcgacactaggcgcactgaagcccgagccgagccgagcccgagccgccgccgccgccgccgctgctgcgcaccgctcccgggctccctcccagcgcgccggccggggtgtggggggcggcgggccggaggggcgagggcgggccagggggcgcacacgggggttggcgcggaagacaggaccctcagcctcgagggagcccctaggtgaccaggcaaaatggcagttccttccagctggtcctcagatgggcacatctattagcctctgctcttgtaagaagttagctgcagaacccacatgtgaatccttgtaggactctggagaagatcaaatgggagcttagatgtggaagctctttggaaaccaagaaacactctgaaaatgaaaagggtggaagagtaaactgttcctgtttctccatcttgacaggaagcagaagttctccttagctgatttttcttcttgccttatactgggttctttaacaccagaacaaaaataaataaataaaagaatcttccagaaattcatgaagagacttcaggtcaggaaagcctgaactttctcatccaacacccgttcaagtcggaggatgctgattaa

SEQ ID NO: 37111 - DNA, 763 bp, Homo sapiens
tgcggccgctggcgacactaggcgcactgaagcccgagccgagccgagcccgagccgccgccgccgccgccgctgctgcgcaccgctcccgggctccctcccagcgcgccggccggggtgtggggggcggcgggccggaggggcgagggcgggccagggggcgcacacgggggttggcgcggaagacaggaccctcagcctcgagggagcccctaggtgaccaggcaaaatggcagttccttccagctggtcctcagatgggcacatctattagcctctgctcttgtaagaagttagctgcagaacccacatgtgaatccttgtaggactctggagaagatcaaatgggagcttagatgtggaagctctttggaaaccaagaaacactctgaaaatgaaaaggcataagaatgtttatcacagcatggcatatattggaagtttagtaaatgaagatacatccaatctgacattctattcacaaccacaaagagataatgtagaaacatatttagtaatgtgagaaaatactaaatattaagtgaaaaaggtggaagagtaaactgttcctgtttctccatcttgacaggaagcagaagttctccttagctgatttttcttcttgccttatactgggttctttaacaccagaacaaaaataaataaataaaagaatcttccagaaattcatgaagagacttcaggtcaggaaagcctgaactttctcatccaacacccgttcaagtcggaggatgctgattaa

SEQ ID NO: 37112 - DNA, 193 bp, Homo sapiens
ccaaaatgctgaaaattacctttttaaagtgctctattgctgcgatttgtagcagacctttttctcctcaggcaaattgatgggtggaagctgagaaatgtatggtaaatgtcacagagctacaaccattcacagacaccaaatctttaggagaataaaaagcacattatctttttctatcagaaaaaaacaa

SEQ ID NO: 37113 - DNA, 487 bp, Homo sapiens
atttgcatttctctgatgaccagtgatgttgagcaccttttcatatgtctgctagccatttgtttgtcctcttttgagaaatgtctattcaaatattttgcccattttttgattggattattatattttttccaatggagttgtttgagttcctcatatattctgattcttaatcccacttcagatgggtagtttgcagatattttcttctgaaagcacttttattatgatattaaacctactgaggaaggtggagccctcatggcctaatcacctcttaaaggctccatctcccaaggattagttggcctttctgagttaatgataatacaggatcctggaagaaaaatataaatgaatggtgtctgctatgggttaaatgtttgttccccccaaaactcacgttgaaatttaattgccaatgtaatggtattgggagatggagcctttaagaggtgatgtcgacgcggccgcgaatttagtagta

SEQ ID NO: 37114 - DNA, 490 bp, Homo sapiens
cccttctcttggttctgtttactaaaacatatcagtgcctgactatgcctgaatgatccatcttccttaaggctgctacaccataactaggagctttaaaaaaaaggggggggcatttactctctgaggcactcaaaaaagcacatgcttttaattgagggatgggggtgacaatggatcattctgttgattttaactatctcatatttgttaacagcatcatttccatggatagctttctgaaagactgcctatccacttagaggtgaggagaagtaataggggaggaaaccctgccgagctgcaaaaagttctaaatccagtcctttaattatcttgcttaaaattctttattggctctttgataccctcagaataaagcaaactgcttaaacatgacttacaaagtaattgctatagtttgaatattgtcccccaaatcacatgttgaaattgattcctagtgtcagaggcggggactgtgagaggt

SEQ ID NO: 37115 - DNA, 456 bp, Homo sapiens
gtactccactggtctcagcctcctaagtagctaggactacaggtgtgtgccaccatgcctggctaatttttaaattttttatggagaagggtcttgctatgttgcccaggctgttctcaaactctggccttcagtaatcctcctgccttagcttcccaaagtactgggattatagacatgagctactgtgcccagccactagacagtcttgaagagaaacaaaatgagcagacttgttttaccagatatctaggcctgctagaaagctgagtaattgggacagtgtgggtgtttgttcaggaatgcaacattagaccctcagaactgaacagaaaacccagaaatagacccaaggcatccacatctacttaatggactcagaggtagtattgcaggccagtgaggaaggatggctactgaataaatgatgcaggctaactggtcatccatatgaaa

SEQ ID NO: 37116 - DNA, 523 bp, Homo sapiens
cagtgcttatttgaaatggacacacacaaacacacacacacacacacacacacacacacacagagattcttatagtctaacacatgaacttgaaccaaatatgtttgagagtcagaagtagttcttatatacaagacactccattgataatcttttgaattatatctctctcctccatccagaccagatatagaaatgagattgggtgaaagcaggtgctgataaaattgtattgaaaatgttggtcaggcatggtgactcagggctgtaatctcagcactttgggaggctgagttgggcagatcacctgaggtcaggagttcgagaccagcctgacagacaagttaaaaacctgtctctactaaaaatacaaaattagctgggcatggtggcacgtgcctgtaatcccagctactcaggaggctgaggcaggagaattacttgaatctgggaagcggaggttgcagtgagctgagattgtgccattgcactccagcctaggcaaaaagcaaaactccatctc

SEQ ID NO: 37117 - DNA, 308 bp, Homo sapiens
ctgtctgatgaaaaatgctaaaggatctaacatatcttttgctggaatcccatacatcttatcttctgcttagctttttgccgccacactattgatccttcatttatagcagggcttagcagattatttgcttttatatggtttacaagctgagaatttgtgttcttaaaaagttgtgaaaatagttgggcacggtgactcataccagtaatcccagcactttgggagagtgagacgggaggatcgcttgagcccaggagtttgagaccagcctgggccacatagcaagacactgtttctaccaaaaa

SEQ ID NO: 37118 - DNA, 164 bp, Homo sapiens
aggccgcccaaagcactggaattataggcatgagccactgcacctggcctgcttgcctttcttaaatgacctcatgtcattgtccagtgaggaatttgtttcagctgaccctgagtgttggtcccgaagttccagccacagctcctctccccaccactgactgt

SEQ ID NO: 37119 - DNA, 432 bp, Homo sapiens
atgaatttctctctgaattccacataattgtcttaaaattatgcaccatttattgttaagagtgaaagattatgtgtcatttattgtagtggtagaagaaaataaaaccaaaacagaatccaatccaaaagcttaggtttttgttgctactacagtaattacatcttcatatacgaaggacagcacattattactgtccaagaatggtgcctcggacaactggttgcttacactgttttcagagatgaaataggaacataagcaggaagatttttgtctaaatatgaagcaagaaaggcttaaatgtctttattcaggggattaggcatcataagtttttttttttttggagaaattgttttcatgatatttcctatctccttttgtcactttgcttttgtcggtaaattttacaactaaataaggattacc

SEQ ID NO: 37120 - DNA, 856 bp, Homo sapiens
cgttcctttaaacttcactggcagacgtttttataattattcacccatagatctgaaatttaaactgctgtaaagtctcctggttactatagactgtagcaatagctgctcctcagcagtaagaacaacatgcctgaaagaaaaatggcctgtagtgatctctttataaaacttcttaagtagttagaaaaatacattactttcaagtactatctataaatgtgttgttgtttcttcttcatatacatttgaacttcaccgtgtcttaaaagtgaatttacacagagctcttcagtttccgttttttaaacattctactccatagtaaactagttaaatgttttttaagaagtttaatcatttttttttcttagtataagatataggactgggcactgtggctcactcctgtaatcccaacactttgggaggctgaggcaggaggattgcttgaggctgggtgtttgcgaccagcctgggcaacatagtgaggcccccctccccatctctaccaaaaaaaaaaaaaaagatataatggaatctcacctcagaaaagattagttttgaaagtcagaaagtgaggcaaaagttgtataaagttaaaattaccctagaaatccctgaggtcatccacaaactacaataatacatgatttagtgcatacaattacatatggcagttcttatgcattttaaaatttaactactgagctgtacttagaaggcagaatggagaattggcattgtaaaaaaatccagaaattaaaatctgctgtttaatataactacaaaatctcatgtagtgaactagggagttggagagaattcagaagtacttttacttcgtgtaagattt

SEQ ID NO: 37121 - DNA, 607 bp, Homo sapiens
ggagtctcactctgttgctaaggctggagtgcaatggcatgatcttggctcactgcaacctctgcctcttggtttcaagtgattctcctgtctcagcctcctgaatatctgagattacaggtgcccaccaccatgcccaggtaattttttgtatttttactagagatgggatttcaccatgtgaaccaggctggtctcaaactcctgacctcaagtgatccacccacctcagcctcccaaagtgctgggattacaggcatgagccccactgtgcccaacctttttctctttccatactacttgttttctttctttatagctggctcacatttcctttccaatttaaaggagtgtatttaacattgcatcttaagacaatgcaatagccatgaagtctttatgagagcaaggtaagaaggaagttaatctataatgaaagtcagcagtgcagagggaagcaatcttccctggcacccttcaataatttgtataacatgttagaaaacaatgcgtgtggctgggtgcagtggctcatgcctgtaatcccatactcacatttttttaaggctcacagtaatttggaattccaacaacttacattttaaat

SEQ ID NO: 37122 - DNA, 1043 bp, Homo sapiens
tctgccttggtccattgaaagaaatatttagtttcatataatgtgaacaaaaaccttaattttgaatgaacatttgatacataggaactcattcaaatcattgattttctggttaactttgttagtagtttgtttttttctgagtcttttgttttaatccagatagtcagtctttttctcctttttacatgcttgaaatgggtaaaaatgaaatatttttacttattcttaaaaatatttccagaatgtcttacacacacatacacttaggaaacaaatacaaatatatagtgatattctctcacattttacagagaaaagcgtagtatacatactttgttttttaatttcacagtagatcttagaggtcttttaatattagcatactgagaactttctcatttttttcataatagtattgtttattccattgtgatgaatatgctattgtttttgaaactagtcccatattggtggacatttaggttgtttccaggtccactattacagataatactacagtgaataagtttgtacatgtatcatttcatatgtatgccaatatttctgcaggataatttcccaaaagtgaaattgctgaatcaaaagatatatccacctgaaatttgattacccatatttttaagcataaaggaagagataaagggaaataaatagaaaaaaaagaaactatagattttcaaaaactttgtttatagatgaaaaaatggaggattagaacttttaagtaattgtccatggtcatgcactccacagaggactgggcatggtgggattcggtggggggggcggggggctgtgtcaggatgctaacccaggtgttcctgattttaaataagctgctatccttcctgttatattcatactgcatgttatgagcaaaaggggagagaagtcgccaactttttggagaaaaagaataaaatcccagactttatttttgggatcatctgaggtgggaagatggcttgggcccaggagtttgagaccagcctgggcaacatgaagagaccccctgtctc

SEQ ID NO: 37123 - DNA, 1355 bp, Homo sapiens
aatatttctggaagaaaatttaatctggcaatatagactaaaaaaaaaaagataagagtatcttgcacagcaggtgcaggtttcccagcagctcaggcaagagtccgatgtttgtgccatctgatcctgatgtctggagagatagccatgtgtgagcctgaatttggcaatgacaaggccagggagccgagcgtgggtggcaggtggcgagtgtcctggtacgaacggtttgtgcagccatgtctggtcgaactgctgggctctgctctcttcatcttcatcgggtgcctgtcggtcattgagaatgggacggacactgggctgctgcagccggccctggcccacgggctggctttggggctcgtgattgccacgctggggaatatcagtggtggacacttcaaccctgcggtgtccctggcagccatgctgatcggaggcctcaacctggtgatgctcctcccgtactgggtctcacagctgctcggggggatgctcggggctgccttggccaaggcggtgagtcctgaggagaggttctggaatgcatctggggcggcctttgtgacagtccaggagcaggggcaggtggcaggggcgttggtggcagagatcatcctgacgacgctgctggccctggctgtatgcatgggtgccatcaatgagaagacaaagggccctctggccccgttctccatcggctttgccgtcaccgtggatatcctggctgggggccctgtgtctggaggctgcatgaatcccgcccgtgcttttggacctgcggtggtggccaaccactggaacttccactggatctactggctgggcccactcctggctggcctgcttgttggactgctcattaggtgcttcattggagatgggaagacccgcctcatcctgaaggctcggtgaagcagagctcgtgggattcctgctgctccaggtgtcctcagctcacctgtcccagactgaggacaggggagttcctgcatttcctgccagggcagaggcccagaggagcgaccccctgcttccactgcttgggcctgctttctcagatagactgactgctgaggaggctctaggttcttggaattcctttgtgctcatcagagaccccagcctggggaacacgctgcccgcactgcccagagagcagtgcaaacaccacaacacgagcgtgtttcttgagaggaatgtccccgagttggacaaggaggctgtttctgcacatcagctcatttcccgcaccccatttctttcttgattgctttgttgggggcctggccacttccttgcttctcaagctgacaattctcactttgcaataaatagtccagtgtttccttcca

SEQ ID NO: 37124 - DNA, 669 bp, Homo sapiens
  misc_feature (36)..(36): n is a, c, g, or t
tcttatctttagtgacatcacccagggaaaaaaaantccaccctagggccctgtgtctggaggctgcatgaatcccgcccgtgcttttggacctgcggtggtggccaaccactggaacttccactggatctactggctgggcccactcctggctggcctgcttgttggactgctcattaggtgcttcattggagatgggaagacccgcctcatcctgaaggctcggtgaagcagagctcgtgggattcctgctgctccaggtgtcctcagctcacctgtcccagactgaggacaggggagttcctgcatttcctgccagggcagaggcccagaggagcgaccccctgcttccactgcttgggcctgctttctcagatagactgactgctgaggaggctctaggttcttggaattcctttgtgctcatcagagaccccagcctggggaacacgctgcccgcactgcccagagagcagtgcaaacaccacaacacgagcgtgtttcttgagaggaatgtccccgagttggacaaggaggctgtttctgcacatcagctcatttcccgcaccccatttctttcttgattgctttgttgggggcctggccacttccttgcttctcaagctgacaattctcactttgcaataaatagtccagtgtttccttcca

SEQ ID NO: 37125 - DNA, 673 bp, Homo sapiens
  misc_feature (39)..(39): n is a, c, g, or t
cccaccatcctcccccctatcgcgatgcgggacaagacngacgccctgagggccctgtgtctggaggctgcatgaatcccgcccgtgcttttggacctgcggtggtggccaaccactggaacttccactggatctactggctgggcccactcctggctggcctgcttgttggactgctcattaggtgcttcattggagatgggaagacccgcctcatcctgaaggctcggtgaagcagagctcgtgggattcctgctgctccaggtgtcctcagctcacctgtcccagactgaggacaggggagttcctgcatttcctgccagggcagaggcccagaggagcgaccccctgcttccactgcttgggcctgctttctcagatagactgactgctgaggaggctctaggttcttggaattcctttgtgctcatcagagaccccagcctggggaacacgctgcccgcactgcccagagagcagtgcaaacaccacaacacgagcgtgtttcttgagaggaatgtccccgagttggacaaggaggctgtttctgcacatcagctcatttcccgcaccccatttctttcttgattgctttgttgggggcctggccacttccttgcttctcaagctgacaattctcactttgcaataaatagtccagtgtttccttcca

SEQ ID NO: 37126 - DNA, 678 bp, Homo sapiens
ataacatctaatattatttattaattaataaatgttataacattgtcatctaaggggccctgtgtctggaggctgcatgaatcccgcccgtgcttttggacctgcggtggtggccaaccactggaacttccactggatctactggctgggcccactcctggctggcctgcttgttggactgctcattaggtgcttcattggagatgggaagacccgcctcatcctgaaggctcggtgaagcagagctcgtgggattcctgctgctccaggtgtcctcagctcacctgtcccagactgaggacaggggagttcctgcatttcctgccagggcagaggcccagaggagcgaccccctgcttccactgcttgggcctgctttctcagatagactgactgctgaggaggctctaggttcttggaattcctttgtgctcatcagagaccccagcctggggaacacgctgcccgcactgcccagagagcagtgcaaacaccacaacacgagcgtgtttcttgagaggaatgtccccgagttggacaaggaggctgtttctgcacatcagctcatttcccgcaccccatttctttcttgattgctttgttgggggcctggccacttccttgcttctcaagctgacaattctcactttgcaataaatagtccagtgtttccttcca

SEQ ID NO: 37127 - DNA, 658 bp, Homo sapiens
cccccacctctacgccgcaaaggcaccccccttcgggccctgtgtctggaggctgcatgaatcccgcccgtgcttttggacctgcggtggtggccaaccactggaacttccactggatctactggctgggcccactcctggctggcctgcttgttggactgctcattaggtgcttcattggagatgggaagacccgcctcatcctgaaggctcggtgaagcagagctcgtgggattcctgctgctccaggtgtcctcagctcacctgtcccagactgaggacaggggagttcctgcatttcctgccagggcagaggcccagaggagcgaccccctgcttccactgcttgggcctgctttctcagatagactgactgctgaggaggctctaggttcttggaattcctttgtgctcatcagagaccccagcctggggaacacgctgcccgcactgcccagagagcagtgcaaacaccacaacacgagcgtgtttcttgagaggaatgtccccgagttggacaaggaggctgtttctgcacatcagctcatttcccgcaccccatttctttcttgattgctttgttgggggcctggccacttccttgcttctcaagctgacaattctcactttgcaataaatagtccagtgtttccttcca

SEQ ID NO: 37128 - DNA, 1633 bp, Homo sapiens
  misc_feature (1362)..(1362): n is a, c, g, or t
  misc_feature (1364)..(1364): n is a, c, g, or t
aatatttctggaagaaaatttaatctggcaatatagactaaaaaaaaaaagataagagtatcttgcacagcaggtgcaggtttcccagcagctcaggcaagagtccgatgtttgtgccatctgatcctgatgtctggagagatagccatgtgtgagcctgaatttggcaatgacaaggccagggagccgagcgtgggtggcaggtggcgagtgtcctggtacgaacggtttgtgcagccatgtctggtcgaactgctgggctctgctctcttcatcttcatcgggtgcctgtcggtcattgagaatgggacggacactgggctgctgcagccggccctggcccacgggctggctttggggctcgtgattgccacgctggggaatatcagtggtggacacttcaaccctgcggtgtccctggcagccatgctgatcggaggcctcaacctggtgatgctcctcccgtactgggtctcacagctgctcggggggatgctcggggctgccttggccaaggcggtgagtcctgaggagaggttctggaatgcatctggggcggcctttgtgacagtccaggagcaggggcaggtggcaggggcgttggtggcagagatcatcctgacgacgctgctggccctggctgtatgcatgggtgccatcaatgagaagacaaagggccctctggccccgttctccatcggctttgccgtcaccgtggatatcctggctgggggccctgtgtctggaggctgcatgaatcccgcccgtgcttttggacctgcggtggtggccaaccactggaacttccactggatctactggctgggcccactcctggctggcctgcttgttggactgctcattaggtgcttcattggagatgggaagacccgcctcatcctgaaggctcggtgaagcagagctcgtgggattcctgctgctccaggtgtcctcagctcacctgtcccagactgaggacaggggagttcctgcatttcctgccagggcagaggcccagaggagcgaccccctgcttccactgcttgggcctgctttctcagatagactgactgctgaggaggctctaggttcttggaattcctttgtgctcatcagagaccccagcctggggaacacgctgcccgcactgcccagagagcagtgcaaacaccacaacacgagcgtgtttcttgagaggaatgtccccgagttggacaaggaggctgtttctgcacatcagctcatttcccgcaccccatttctttcttgattgctttgttgggggcctggccacttccttgcttctcaagctgacaattctcactttgcaataaatagtccagtgtttccttccaaaaaaananaaaactggctccgtggcctccctggggaactctgcggccgcttcctttcatggaggttaatcaatgacctcctccctgcctcatggcctggcccgccggttgagggaccgtgtcaactcctcacggggggaaccggttccccacataggggcatccccgaacaactccaccaaaggcctcacggccgaaccggaaaggcgcgctgtggcgtatttctagtctcccccctgaagaaatacgaataccatctcagctgaggggcgaccccc

SEQ ID NO: 37129 - DNA, 381 bp, Homo sapiens
ttttgagctggagtctcgctcttggtgccccaggctggagtgcaatgatgcgatcttggctcactgcaacctccgcctcccgggttcaagagattctcctgcctcagcctcccaagtagctgggactacaggtgcgcgccacactcccggctaatttttgtatttttagtagagatgatgtttcaccatgttggccaggatggtcttaatctcttgacctcgtgatccacccgccttggccttccaaagtgctgggattacaggcatgtgccaccgtgcctggccaagagtttttattattctacagcggcttttaaaaattgtaaatattggtcaggtttggtggctcatgcctgtaatccagcactttggaaggcagac

SEQ ID NO: 37130 - DNA, 402 bp, Homo sapiens
  misc_feature (354)..(354): n is a, c, g, or t
  misc_feature (357)..(357): n is a, c, g, or t
gttgaccaaagcatcattatgaggcatatgactatatcttctctgccatcatgcctggagaaaacagattttcatcatctctcaaaccctaaacacttccctggaattattactctgcaaattcatttgaattcacctgaaaggagaaataagactaaaagcttttagagttgggtttatacacacctatactgagcataaactctttccatatggcaaacatcttattgaacgctctagagtaggaataaagtctatatcatgcctaccattcaggcatcttggggatgggaaattaggatttgtgtgtacccaacctattaaatatttcaagggcctggctggtattcaatncanggcccctggtttttacaatttactttttccctggttattaaattt

SEQ ID NO: 37131 - DNA, 431 bp, Homo sapiens
agtttcagtatagtttgggctactaggtagaaatagaattgttaaaatattgaatgtaaatattcttaaaacaggttttaactaaataggcatatagttatgatgtacactaacaaatttaactatatatgtcagtattttgaagacttaaattcaccaaagctttcacaaaacaagatgtgaacagtcatagggatagcatccattggcttatgaaataatcttagcctagtgattgacagttaacttttattcatagattctgaaactgctttacaaatgtttgttccactttgtaaaaccatctgctatgtagtagagagtcttaattttaatgtacctgtctttaaataattgaaaactaaagcagtttattattctgaagtagcaacacagatcattttgtatctcagacttttcttttttttttt

SEQ ID NO: 37132 - DNA, 394 bp, Homo sapiens
gataaatgtacatggctcaaagcccaccattgactgatcacacattttcaccatatcatctagtgattattgttccacccatgtttataatttcctcttcatcatcactataaccctcatgattatctgtatttaaaaccatttctgggccaggcgcagtggctcacgccggtaatcccaacactttgggaggccaaagcagtaggatcgcttgaggccaggagttcaagactagcctggacaacattgcaagacctcatccctacgaaacagttttaaaaatcagcttagcattctggcatgcacctgtagtcccagctactcgggaggctaaggtgggaagattgcttgagcccaagaatttgaggcttcagtgagctcccatcacatcctt

SEQ ID NO: 37133 - DNA, 423 bp, Homo sapiens
aaaaatgtatttatatttacccacataattaatattttggttcacttttatctttcctgcatcttcatctatttgttttgaataatatttcattcatttgaagaatatctgctgcttaaaacttgttcaacatttgtttaaaatgtgtttcactctcattctagatggatatttttgttgagtgtacatctacattttgttctttttttaagatatttttctttttttttctttcatagctgaactgtgtgtgcctgggtggattaattttttgaaaagaaattttctgcttgggattatcaggcttattgaatctgtcacttaataaatatatttcacaatttctcaaaattgcccatacataatatcttacaaggttacttttgtcccatctttccctctcctcctttcaaaaagatgtgt

SEQ ID NO: 37134 - DNA, 306 bp, Homo sapiens
gtgtgagatagagattaaggcttacttttttccacatggatgtcagttatctttttactatttgttcaaaagactttccatcctcttttggactgtctaggcacttttgtaaaatattaaatgactataaatgtgggtctctttgttagactccttaatctgttgcattgatctatttgttgatccttaagccagtaccatactgtttagattactcagcccatgctatgttttgaagtcagattgtgtaacttctacagctttccaagcttttttgggatgttttagatccttcacatttccata

SEQ ID NO: 37135 - DNA, 727 bp, Homo sapiens
gcattcacgtgtccgtgcgaatcacaatatagaagcagctgccatccatagatcgctaaggtggtatttaattttgtaattcagctgagggtcactgggagctttgtttccatttctgctcttaacgcgttaaactttgaagagttattcagcagactgttattttcaagttccctacataagatttcatgctttattggctaccattttctattattaagtcattttgctattcaatataccttggaagttagataaattttgagaaggaaaataaaattagatgctatcttaactttaacaaaaaactctgttgctgcatgttgaagagctgataaatgaattacactttgcagtctttgccccctcccccgccgccaccccatcattttagaggagaaaattgtacctaactagttactgatatacagaagatggcaataatccccctgggagagtttagaagggaaaaataaattgttacacctataggacagttctggcttgttaaagaatttcaagccatttgatcttgggtgactttaacataacttactaggtttttggggggtacaatagttgtatttgttaaacttgtaaatttatgagcattggaatgatgtctcctaagctggacttgttgaactaagatttttttttagccttcatcttccaccaaccataagatttcagtgcacaggtaaaaggcaatctttgaccaagtttt

SEQ ID NO: 37136 - DNA, 370 bp, Homo sapiens
accccgcctccgaggctcaagtgatcctcccacctcaggctcctgagtagctgagactacaggctaattttttgtattttttagaggtggggtttcactatgttgcccagggtgatctcgaactcgtgagctcaagcaacacgcccgcctcagcctcccaaagtgttgagattacaggcatgagccaccgcgcccagcctcaacttttctttatgcttcaaactgttcatataaaaagggtgaaaaaaaagtatcattgtgttcctatcagtatttatgagtcacagtatttctcttcaagaaaaaaaaagagacatttaatttttggaggcacaaaaaggaaaacacaagtggaaaaaaatgccttttg

SEQ ID NO: 37137 - DNA, 450 bp, Homo sapiens
ggaatgtacaaagttcattgtccatccggacacccaggaataagtgagaggtacatactaattagtattttctaacattgcttacttctgccccctgcctagtcacaggctgagagaagaatgcagcaagaagcatcttaactggaggcccattctaagtccattttgaggatgaggaaacaggccagggaggttaaacgacttgtcccaggtactgtggctggaagagaggctataccttacctactctcctgggtgcccttttacctctgtctttagaggaagtgcatagatttttctcatttggctcttgagacctgggataaacatagtgctaccctaagtcttgcagttacaagaatggaaatattctgatttaagttatagacatttgtttgaattttaccattacacattttttaaatcacagataagatttttcacttgaat

SEQ ID NO: 37138 - DNA, 340 bp, Homo sapiens
tgcttcctctactctatgtttattttatgtaaagtgcagatttactgagcagaagacaaatacataattgactgttccctctacccctccttttgtagtgcaacatgtggattcagtgagccgtatcaaaaccttgaaagaatgtgaccataccctccctcttttttttcctttttcccctttcccctcctgcccacttttccacatttaaatattgaatacttcaaaatcctatttggaaaaaagtacaggtcacagatcctacaatcctactgtggcttgtgtctctttttccgaggcacatcctcaaccttggaaaaataaacttttaaattgattg

SEQ ID NO: 37139 - DNA, 504 bp, Homo sapiens
cagcgtgttgctagttagtaggaaatgatcgtgtgtgctgttgctttaattgcccgggtaaataattctgcctcggtgttagtgagcattttaaagcacttgatgccaatagactagaaacaaacaaaaattaaccttgattatgcaacaccttagcatagaaagttacaaaggtatgtcttttttaaagtttgcattctatcatgcaaatattatctaaatatgcatgtgctgactactcatctactgtattttaggaaatacaattaggctgcctttctcttcccctatgtagactgtaaataactgtagatctttctcttgtttccctatgtaaatatatgtaaatactaacaagctatgcatgctgctattctaggcaatttcaggtacttttataatatgaaggcatgtacttgaactcgtttgttaacagaggggaaaaaactctctcaaactctttaaagctgaatagaaattaaagatttcttcctagactgttgt

SEQ ID NO: 37140 - DNA, 849 bp, Homo sapiens
cttcggctaggtcgaggctcggtggttaatcggccgagggcccagagcttcgctcttgctgctcccctgaggtgaactgaagccagcagccccgcatcatgtcaaagctcggccgggccgcccggggcctcaggaagcccgaggtcggcggtgtgatccgggcgatcgtgcgggcaggcctggccatgcccgggcccccactaggcccagtgctgggtcagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttaccc

SEQ ID NO: 37141 - DNA, 1279 bp, Homo sapiens
caagcaaatgaatacttttattaacatggtaagtttttgtttgttttaacatggtagggttttgacctcaaatatttgttaggtctgctactcaaatgaacttacagctggacaacgtatgaaccttgaagatgcctcttctagtccagtttagggtccaatgcagacagttccatactctcatccccaagcccctcaagggcctttgccaatctttcattttatgccaagtcctctaaaacgcatcagggtattacatcaacttgtacagaatatcaagatcttatcttctattttaggttccatgtcaaataaagctgagttaggttgtccaaacaaactcaccagacaggttacataagatagtgtaccacaacaaatttaaattttgaacaaaacacatctctcctcctttggtctcacacagaaattaaagtctccaaatacagacaatactatccattctccagctcttctccagattcacgagtcccagccaggtcggcccatccacactcccccttgacctctggcccaagatggtggcgcccagagcttcgctcttgctgctcccctgaggtgaactgaagccagcagccccgcatcatgtcaaagctcggccgggccgcccggggcctcaggaagcccgagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttaccc

SEQ ID NO: 37142 - DNA, 1357 bp, Homo sapiens
caagcaaatgaatacttttattaacatggtaagtttttgtttgttttaacatggtagggttttgacctcaaatatttgttaggtctgctactcaaatgaacttacagctggacaacgtatgaaccttgaagatgcctcttctagtccagtttagggtccaatgcagacagttccatactctcatccccaagcccctcaagggcctttgccaatctttcattttatgccaagtcctctaaaacgcatcagggtattacatcaacttgtacagaatatcaagatcttatcttctattttaggttccatgtcaaataaagctgagttaggttgtccaaacaaactcaccagacaggttacataagatagtgtaccacaacaaatttaaattttgaacaaaacacatctctcctcctttggtctcacacagaaattaaagtctccaaatacagacaatactatccattctccagctcttctccagattcacgagtcccagccaggtcggcccatccacactcccccttgacctctggcccaagatggtggcgcccagagcttcgctcttgctgctcccctgaggtgaactgaagccagcagccccgcatcatgtcaaagctcggccgggccgcccggggcctcaggaagcccgaggtcggcggtgtgatccgggcgatcgtgcgggcaggcctggccatgcccgggcccccactaggcccagtgctgggtcagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttaccc

SEQ ID NO: 37143 - DNA, 2119 bp, Homo sapiens
caagcaaatgaatacttttattaacatggtaagtttttgtttgttttaacatggtagggttttgacctcaaatatttgttaggtctgctactcaaatgaacttacagctggacaacgtatgaaccttgaagatgcctcttctagtccagtttagggtccaatgcagacagttccatactctcatccccaagcccctcaagggcctttgccaatctttcattttatgccaagtcctctaaaacgcatcagggtattacatcaacttgtacagaatatcaagatcttatcttctattttaggttccatgtcaaataaagctgagttaggttgtccaaacaaactcaccagacaggttacataagatagtgtaccacaacaaatttaaattttgaacaaaacacatctctcctcctttggtctcacacagaaattaaagtctccaaatacagacaatactatccattctccagctcttctccagattcacgagtcccagccaggtcggcccatccacactcccccttgacctctggcccaagatggtggcgcccagagcttcgctcttgctgctcccctgaggtgaactgaagccagcagccccgcatcatgtcaaagctcggccgggccgcccggggcctcaggaagcccgaggtcggcggtgtgatccgggcgatcgtgcgggcaggcctggccatgcccgggcccccactaggcccagtgctgggtcagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttacccactgtcatcttctatcttgggacctcagggaagggaaccagtactggtggtagccaatatgggcagacattaggaaattggggtcttcatactgcttctcagatgtgcaaactgaggttcagccaagcaaagtaacttgcccaggtccttttttttcttttttaagttataattttgttttattgcccaggttctgaattggtgccagaggtaggaatagaacccaggccttctcatttgaaatcctgtgttcttcccctccccagggtgggaactatggttgctagggctgaggtgtattgcttacttcttccatcaaaaatctcttttatctctgaacaacttgccacctctgcagaaacaagtccctgtggagatctcagttcagccccaggcagggttactacatggagtacccagatcccaggggctacttcaggcccttctactaagctcctgaccctggctctgggtcagatgttggctgaacatgaactattgtagggctgacagctacagaccacagaaagagcaaagcttcagtaggttcctgcctgatggagaagtcctcgggaagcccttggccttctatttcctcattgtcctttcagagaagagagcaggagttgggggagaaaggagattcgcatttactgaccatctgttatgtgctagacacttcattttacactgagaaaatatggaaagcatagataaacacctaaaagaaaataaaaacctcatgttatcccaccacccaga

SEQ ID NO: 37144 - DNA, 1207 bp, Homo sapiens
caagcaaatgaatacttttattaacatggtaagtttttgtttgttttaacatggtagggttttgacctcaaatatttgttaggtctgctactcaaatgaacttacagctggacaacgtatgaaccttgaagatgcctcttctagtccagtttagggtccaatgcagacagttccatactctcatccccaagcccctcaagggcctttgccaatctttcattttatgccaagtcctctaaaacgcatcagggtattacatcaacttgtacagaatatcaagatcttatcttctattttaggttccatgtcaaataaagctgagttaggttgtccaaacaaactcaccagacaggttacataagatagtgtaccacaacaaatttaaattttgaacaaaacacatctctcctcctttggtctcacacagaaattaaagtctccaaatacagacaatactatccattctccagctcttctccagattcacgagtcccagccaggtcggcccatccacactcccccttgacctctggcccaagatggtggcgcccagagcttcgctcttgctgctcccctgagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttaccc

SEQ ID NO: 37145 - DNA, 1397 bp, Homo sapiens
  misc_feature (1379)..(1379): n is a, c, g, or t
  misc_feature (1383)..(1383): n is a, c, g, or t
caagcaaatgaatacttttattaacatggtaagtttttgtttgttttaacatggtagggttttgacctcaaatatttgttaggtctgctactcaaatgaacttacagctggacaacgtatgaaccttgaagatgcctcttctagtccagtttagggtccaatgcagacagttccatactctcatccccaagcccctcaagggcctttgccaatctttcattttatgccaagtcctctaaaacgcatcagggtattacatcaacttgtacagaatatcaagatcttatcttctattttaggttccatgtcaaataaagctgagttaggttgtccaaacaaactcaccagacaggttacataagatagtgtaccacaacaaatttaaattttgaacaaaacacatctctcctcctttggtctcacacagaaattaaagtctccaaatacagacaatactatccattctccagctcttctccagattcacgagtcccagccaggtcggcccatccacactcccccttgacctctggcccaagatggtggcgcccagagcttcgctcttgctgctcccctgaggtgaactgaagccagcagccccgcatcatgtcaaagctcggccgggccgcccggggcctcaggaagcccgaggtcggcggtgtgatccgggcgatcgtgcgggcaggcctggccatgcccgggcccccactaggcccagtgctgggtcagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttacccaaaaaaaaagaaaaaaaacaanaaanaacaaacacacaaa

SEQ ID NO: 37146 - DNA, 2041 bp, Homo sapiens
caagcaaatgaatacttttattaacatggtaagtttttgtttgttttaacatggtagggttttgacctcaaatatttgttaggtctgctactcaaatgaacttacagctggacaacgtatgaaccttgaagatgcctcttctagtccagtttagggtccaatgcagacagttccatactctcatccccaagcccctcaagggcctttgccaatctttcattttatgccaagtcctctaaaacgcatcagggtattacatcaacttgtacagaatatcaagatcttatcttctattttaggttccatgtcaaataaagctgagttaggttgtccaaacaaactcaccagacaggttacataagatagtgtaccacaacaaatttaaattttgaacaaaacacatctctcctcctttggtctcacacagaaattaaagtctccaaatacagacaatactatccattctccagctcttctccagattcacgagtcccagccaggtcggcccatccacactcccccttgacctctggcccaagatggtggcgcccagagcttcgctcttgctgctcccctgaggtgaactgaagccagcagccccgcatcatgtcaaagctcggccgggccgcccggggcctcaggaagcccgagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttacccactgtcatcttctatcttgggacctcagggaagggaaccagtactggtggtagccaatatgggcagacattaggaaattggggtcttcatactgcttctcagatgtgcaaactgaggttcagccaagcaaagtaacttgcccaggtccttttttttcttttttaagttataattttgttttattgcccaggttctgaattggtgccagaggtaggaatagaacccaggccttctcatttgaaatcctgtgttcttcccctccccagggtgggaactatggttgctagggctgaggtgtattgcttacttcttccatcaaaaatctcttttatctctgaacaacttgccacctctgcagaaacaagtccctgtggagatctcagttcagccccaggcagggttactacatggagtacccagatcccaggggctacttcaggcccttctactaagctcctgaccctggctctgggtcagatgttggctgaacatgaactattgtagggctgacagctacagaccacagaaagagcaaagcttcagtaggttcctgcctgatggagaagtcctcgggaagcccttggccttctatttcctcattgtcctttcagagaagagagcaggagttgggggagaaaggagattcgcatttactgaccatctgttatgtgctagacacttcattttacactgagaaaatatggaaagcatagataaacacctaaaagaaaataaaaacctcatgttatcccaccacccaga

SEQ ID NO: 37147 - DNA, 1319 bp, Homo sapiens
  misc_feature (1301)..(1301): n is a, c, g, or t
  misc_feature (1305)..(1305): n is a, c, g, or t
caagcaaatgaatacttttattaacatggtaagtttttgtttgttttaacatggtagggttttgacctcaaatatttgttaggtctgctactcaaatgaacttacagctggacaacgtatgaaccttgaagatgcctcttctagtccagtttagggtccaatgcagacagttccatactctcatccccaagcccctcaagggcctttgccaatctttcattttatgccaagtcctctaaaacgcatcagggtattacatcaacttgtacagaatatcaagatcttatcttctattttaggttccatgtcaaataaagctgagttaggttgtccaaacaaactcaccagacaggttacataagatagtgtaccacaacaaatttaaattttgaacaaaacacatctctcctcctttggtctcacacagaaattaaagtctccaaatacagacaatactatccattctccagctcttctccagattcacgagtcccagccaggtcggcccatccacactcccccttgacctctggcccaagatggtggcgcccagagcttcgctcttgctgctcccctgaggtgaactgaagccagcagccccgcatcatgtcaaagctcggccgggccgcccggggcctcaggaagcccgagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttacccaaaaaaaaagaaaaaaaacaanaaanaacaaacacacaaa

SEQ ID NO: 37148 - DNA, 2213 bp, Homo sapiens
caagcaaatgaatacttttattaacatggtaagtttttgtttgttttaacatggtagggttttgacctcaaatatttgttaggtctgctactcaaatgaacttacagctggacaacgtatgaaccttgaagatgcctcttctagtccagtttagggtccaatgcagacagttccatactctcatccccaagcccctcaagggcctttgccaatctttcattttatgccaagtcctctaaaacgcatcagggtattacatcaacttgtacagaatatcaagatcttatcttctattttaggttccatgtcaaataaagctgagttaggttgtccaaacaaactcaccagacaggttacataagatagtgtaccacaacaaatttaaattttgaacaaaacacatctctcctcctttggtctcacacagaaattaaagtctccaaatacagacaatactatccattctccagctcttctccagattcacgagtcccagccaggtcggcccatccacactcccccttgacctctggcccaagatggtggcgcccagagcttcgctcttgctgctcccctgaggtgaactgaagccagcagccccgcatcatgtcaaagctcggccgggccgcccggggcctcaggaagcccgaggtcggcggtgtgatccgggcgatcgtgcgggcaggcctggccatgcccgggcccccactaggcccagtgctgggtcagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggaacgttgttctgcaaatgttctaagaaatggaaagatctccatgaaggatccaagtgggagaagttcagtgtgacctgggtctgtcgtcctagagcctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttacccactgtcatcttctatcttgggacctcagggaagggaaccagtactggtggtagccaatatgggcagacattaggaaattggggtcttcatactgcttctcagatgtgcaaactgaggttcagccaagcaaagtaacttgcccaggtccttttttttcttttttaagttataattttgttttattgcccaggttctgaattggtgccagaggtaggaatagaacccaggccttctcatttgaaatcctgtgttcttcccctccccagggtgggaactatggttgctagggctgaggtgtattgcttacttcttccatcaaaaatctcttttatctctgaacaacttgccacctctgcagaaacaagtccctgtggagatctcagttcagccccaggcagggttactacatggagtacccagatcccaggggctacttcaggcccttctactaagctcctgaccctggctctgggtcagatgttggctgaacatgaactattgtagggctgacagctacagaccacagaaagagcaaagcttcagtaggttcctgcctgatggagaagtcctcgggaagcccttggccttctatttcctcattgtcctttcagagaagagagcaggagttgggggagaaaggagattcgcatttactgaccatctgttatgtgctagacacttcattttacactgagaaaatatggaaagcatagataaacacctaaaagaaaataaaaacctcatgttatcccaccacccaga

SEQ ID NO: 37149 - DNA, 1451 bp, Homo sapiens
caagcaaatgaatacttttattaacatggtaagtttttgtttgttttaacatggtagggttttgacctcaaatatttgttaggtctgctactcaaatgaacttacagctggacaacgtatgaaccttgaagatgcctcttctagtccagtttagggtccaatgcagacagttccatactctcatccccaagcccctcaagggcctttgccaatctttcattttatgccaagtcctctaaaacgcatcagggtattacatcaacttgtacagaatatcaagatcttatcttctattttaggttccatgtcaaataaagctgagttaggttgtccaaacaaactcaccagacaggttacataagatagtgtaccacaacaaatttaaattttgaacaaaacacatctctcctcctttggtctcacacagaaattaaagtctccaaatacagacaatactatccattctccagctcttctccagattcacgagtcccagccaggtcggcccatccacactcccccttgacctctggcccaagatggtggcgcccagagcttcgctcttgctgctcccctgaggtgaactgaagccagcagccccgcatcatgtcaaagctcggccgggccgcccggggcctcaggaagcccgaggtcggcggtgtgatccgggcgatcgtgcgggcaggcctggccatgcccgggcccccactaggcccagtgctgggtcagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagggaaagaggtggcaggcctggtgaccttgaagcatgtgtatgagattgcccgcatcaaagctcaggatgaggcatttgccctgcaggatgtacccctgtcgtctgttgtccgctccatcatcgggtctgcccgttctctgggcattcgcgtggtgaaggaacgttgttctgcaaatgttctaagaaatggaaagatctccatgaaggatccaagtgggagaagttcagtgtgacctgggtctgtcgtcctagagcctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttaccc

SEQ ID NO: 37150 - DNA, 2086 bp, Homo sapiens
caagcaaatgaatacttttattaacatggtaagtttttgtttgttttaacatggtagggttttgacctcaaatatttgttaggtctgctactcaaatgaacttacagctggacaacgtatgaaccttgaagatgcctcttctagtccagtttagggtccaatgcagacagttccatactctcatccccaagcccctcaagggcctttgccaatctttcattttatgccaagtcctctaaaacgcatcagggtattacatcaacttgtacagaatatcaagatcttatcttctattttaggttccatgtcaaataaagctgagttaggttgtccaaacaaactcaccagacaggttacataagatagtgtaccacaacaaatttaaattttgaacaaaacacatctctcctcctttggtctcacacagaaattaaagtctccaaatacagacaatactatccattctccagctcttctccagattcacgagtcccagccaggtcggcccatccacactcccccttgacctctggcccaagatggtggcgcccagagcttcgctcttgctgctcccctgaggtgaactgaagccagcagccccgcatcatgtcaaagctcggccgggccgcccggggcctcaggaagcccgaggtcggcggtgtgatccgggcgatcgtgcgggcaggcctggccatgcccgggcccccactaggcccagtgctgggtcagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttacccactgtcatcttctatcttgggacctcagggaagggaaccagtactggtggtagccaatatgggcagacattaggaaattggggtcttcatactgcttctcagatgtgcaaactgaggttcagccaagcaaagtaacttgcccaggtccttttttttcttttttaagttataattttgttttattgcccaggttctgaattggtgccagaggtaggaatagaacccaggccttctcatttgaaatcctgtgttcttcccctccccagggtgggaactatggttgctagggctgaggtgtattgcttacttcttccatcaaaaatctcttttatctctgaacaacttgccacctctgcagaaacaagtccctgtggagatctcagttcagccccaggcagggttactacatggagtacccagatcccaggggctacttcaggcccttctactaagctcctgaccctggctctgggtcagatgttggctgaacatgaactattgtagggctgacagctacagaccacagaaagagcaaagcttcagtaggttcctgcctgatggagaagtcctcgggaagcccttggccttctatttcctcattgtcctttcagagaagagagcaggagttgggggagaaaggagattcgcatttactgaccatctgttatgtgctagacacttcattttacactgagaaaatatggaaagcatagataaacacctaaaagaaaataaaaacctcatgttatcccaccacccaga

SEQ ID NO: 37151 - DNA, 1324 bp, Homo sapiens
caagcaaatgaatacttttattaacatggtaagtttttgtttgttttaacatggtagggttttgacctcaaatatttgttaggtctgctactcaaatgaacttacagctggacaacgtatgaaccttgaagatgcctcttctagtccagtttagggtccaatgcagacagttccatactctcatccccaagcccctcaagggcctttgccaatctttcattttatgccaagtcctctaaaacgcatcagggtattacatcaacttgtacagaatatcaagatcttatcttctattttaggttccatgtcaaataaagctgagttaggttgtccaaacaaactcaccagacaggttacataagatagtgtaccacaacaaatttaaattttgaacaaaacacatctctcctcctttggtctcacacagaaattaaagtctccaaatacagacaatactatccattctccagctcttctccagattcacgagtcccagccaggtcggcccatccacactcccccttgacctctggcccaagatggtggcgcccagagcttcgctcttgctgctcccctgaggtgaactgaagccagcagccccgcatcatgtcaaagctcggccgggccgcccggggcctcaggaagcccgaggtcggcggtgtgatccgggcgatcgtgcgggcaggcctggccatgcccgggcccccactaggcccagtgctgggtcagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagatgtgtatgagattgcccgcatcaaagctcaggatgaggcatttgccctgcaggatgtacccctgtcgtctgttgtccgctccatcatcgggtctgcccgttctctgggcattcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttaccc

SEQ ID NO: 37152 - DNA, 2012 bp, Homo sapiens
caagcaaatgaatacttttattaacatggtaagtttttgtttgttttaacatggtagggttttgacctcaaatatttgttaggtctgctactcaaatgaacttacagctggacaacgtatgaaccttgaagatgcctcttctagtccagtttagggtccaatgcagacagttccatactctcatccccaagcccctcaagggcctttgccaatctttcattttatgccaagtcctctaaaacgcatcagggtattacatcaacttgtacagaatatcaagatcttatcttctattttaggttccatgtcaaataaagctgagttaggttgtccaaacaaactcaccagacaggttacataagatagtgtaccacaacaaatttaaattttgaacaaaacacatctctcctcctttggtctcacacagaaattaaagtctccaaatacagacaatactatccattctccagctcttctccagattcacgagtcccagccaggtcggcccatccacactcccccttgacctctggcccaagatggtggcgcccagagcttcgctcttgctgctcccctgaggtgaactgaagccagcagccccgcatcatgtcaaagctcggccgggccgcccggggcctcaggaagcccgaggtcggcggtgtgatccgggcgatcgtgcgggcaggcctggccatgcccgggcccccactaggcccagtgctgggtcagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagagggaaagaggtggcaggcctggtgacctctgggcacttcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttacccactgtcatcttctatcttgggacctcagggaagggaaccagtactggtggtagccaatatgggcagacattaggaaattggggtcttcatactgcttctcagatgtgcaaactgaggttcagccaagcaaagtaacttgcccaggtccttttttttcttttttaagttataattttgttttattgcccaggttctgaattggtgccagaggtaggaatagaacccaggccttctcatttgaaatcctgtgttcttcccctccccagggtgggaactatggttgctagggctgaggtgtattgcttacttcttccatcaaaaatctcttttatctctgaacaacttgccacctctgcagaaacaagtccctgtggagatctcagttcagccccaggcagggttactacatggagtacccagatcccaggggctacttcaggcccttctactaagctcctgaccctggctctgggtcagatgttggctgaacatgaactattgtagggctgacagctacagaccacagaaagagcaaagcttcagtaggttcctgcctgatggagaagtcctcgggaagcccttggccttctatttcctcattgtcctttcagagaagagagcaggagttgggggagaaaggagattcgcatttactgaccatctgttatgtgctagacacttcattttacactgagaaaatatggaaagcatagataaacacctaaaagaaaataaaaacctcatgttatcccaccacccaga

SEQ ID NO: 37153 - DNA, 1934 bp, Homo sapiens
caagcaaatgaatacttttattaacatggtaagtttttgtttgttttaacatggtagggttttgacctcaaatatttgttaggtctgctactcaaatgaacttacagctggacaacgtatgaaccttgaagatgcctcttctagtccagtttagggtccaatgcagacagttccatactctcatccccaagcccctcaagggcctttgccaatctttcattttatgccaagtcctctaaaacgcatcagggtattacatcaacttgtacagaatatcaagatcttatcttctattttaggttccatgtcaaataaagctgagttaggttgtccaaacaaactcaccagacaggttacataagatagtgtaccacaacaaatttaaattttgaacaaaacacatctctcctcctttggtctcacacagaaattaaagtctccaaatacagacaatactatccattctccagctcttctccagattcacgagtcccagccaggtcggcccatccacactcccccttgacctctggcccaagatggtggcgcccagagcttcgctcttgctgctcccctgaggtgaactgaagccagcagccccgcatcatgtcaaagctcggccgggccgcccggggcctcaggaagcccgagagaggcgtttccatcaaccagttttgcaaggagttcaatgagaggacaaaggacatcaaggaaggcattcctctgcctaccaagattttagtgaagcctgacaggacatttgaaattaagattggacagcccactgtttcctacttcctgaaggcagcagctgggattgaaaagggggcccggcaaacagagggaaagaggtggcaggcctggtgacctctgggcacttcgcgtggtgaaggacctcagttcagaagagcttgcagctttccagaaggaacgagccatcttcctggctgctcagaaggaggcagatttggctgcccaagaagaagctgccaagaagtgacccttgccccaccaactcccagatttcaaaggaggtagttgcaaaagctgtgcccaaggggaggaaggaggtcacaccaatatgatgatggttttcatgactttgaatgatatatttttgtacatctagctgtatcgaggcatcaggcctgaataaacatcctttcttacccactgtcatcttctatcttgggacctcagggaagggaaccagtactggtggtagccaatatgggcagacattaggaaattggggtcttcatactgcttctcagatgtgcaaactgaggttcagccaagcaaagtaacttgcccaggtccttttttttcttttttaagttataattttgttttattgcccaggttctgaattggtgccagaggtaggaatagaacccaggccttctcatttgaaatcctgtgttcttcccctccccagggtgggaactatggttgctagggctgaggtgtattgcttacttcttccatcaaaaatctcttttatctctgaacaacttgccacctctgcagaaacaagtccctgtggagatctcagttcagccccaggcagggttactacatggagtacccagatcccaggggctacttcaggcccttctactaagctcctgaccctggctctgggtcagatgttggctgaacatgaactattgtagggctgacagctacagaccacagaaagagcaaagcttcagtaggttcctgcctgatggagaagtcctcgggaagcccttggccttctatttcctcattgtcctttcagagaagagagcaggagttgggggagaaaggagattcgcatttactgaccatctgttatgtgctagacacttcattttacactgagaaaatatggaaagcatagataaacacctaaaagaaaataaaaacctcatgttatcccaccacccaga

SEQ ID NO: 37154 - DNA, 868 bp, Homo sapiens
agaaaactgaccagatcctggatctgagctgcctgctccaggcctagaaatccccaaaggctggcactgagctgtgactgctttaacagcccccaagatttggtcagtttgaggtggtggagactcagatttgttgctgaaagttcagtaacacagtcctggtctttggccctagagaaactttttatatgagaagtgttctctatatacatgtttgaggtgactctggaatggattatgaggtcatatctcaaaatgtcagaaaacgttatagagcactcgaacttttgtatttgctgcttaacctcaatattacagccacaaacaaggggtaccaagacaaagtataactgagcataagcagaaaatgttaaccctccaggtttctttcttaagcacaataaaagtgggagcgaacaacacaaggatatttttacatttgacccgtctcaaaagtagcacaccctatccttgtgccattatttgtacaaggaaatatatgattagaaggaatagaacccccagttgtcatcagcttttttagacaccacaggttgtagcagtttgaacaaactgaaaactttatacttctgtgtgagctgaactcaagtttcagaataatcatcgccatgtgggaggctttttgttaaatgcagaagaaatttcaaaatattgtatttatatctgccttccactgctgccaatttagtaagcatctcctatacaatcgacaataaacagcaaatgatgcagttcatagagtattttgcacttggggaaaaatatgtatctgaattgtaaaaagaaatgtttggattttgtatgtcttttttattattattaaaatactaaatgaaactcctcagcc

SEQ ID NO: 37155 - DNA, 611 bp, Homo sapiens
gtagacgcttgaagttgcatttctaagaagctcccagattatgtggatgtggctgggtcaggaatcacaccaagtggcaagagtgtacagcacatgctttgtacttaataaatatctgttgaatgagtcctcttctgtcctaacccccaggaatttgaaacctcccgtgaagtcacatccttcttctttgttcttctctgggtgagactgtcaggaatttttactttcttggaagttaaaaaacaaaacaaacaacaacaacaacaacacacacaaaaaaaccccaaaaaactttctggctttctgaaaagcagactctagcaagtgattgtattttgcatatttccacccctcccgataatctaccacatggaggcagaacccagggctgtttttccatgtagaaaacatcagtgtgtgcaccctgctctgctcactctttcccagcacaatctgacagatttaacagcttctgcccagcagagatgtcccactggggctgcaaaccagcatcaggggccaagccatggaggggaaatggtggcttctcctgcaagaccacattctcctcagagccatcagctcctttcccactctgggttagtgacttg

SEQ ID NO: 37156 - DNA, 422 bp, Homo sapiens
ttttttttgagacggagtttccctcttgttgcccaggctagagtgcaatggcatgatctcagctcactgcaacctctgcctcccgggttcaagcaattctcctgcctcagcctcccgagtagctgggattataggcgcctgctaccatgcctggctaatttttgtatttttagtacagacgaggtttcaccatgtcggtcaggctggtctcgaactcctgacctcaggcaatctgcccgtctcggcctcccaaagtgctgagaatacaggcatgagccaccacgcccagccatgtttctgaatattctatatgtcacactacataatcattaaacaaactcaaaattttatgaagcatagaaataactttatagaaagtaaaataattacatacaggcaaatccaaattaagatgggacacc

SEQ ID NO: 37157 - DNA, 519 bp, Homo sapiens
cccctactcatttcttgcaatttaatgggtcatgcagctccacccactcaccccttttgatctctcccctcctccgtcctgtgaaaattccagtcccgcatccttctgagcccgggacccccagtcaattcctgggtcaggtgtctccttaaccctcccgatttacagtgcttaaccctcatttctgctttttggggtctcccaatggattgtcagtcctcctacccctctcgtattctgggtacctcaggggtttcttcgcacatactgggaccctcaccccacttgctgcgtaccaggtcctggtatttgtcccagtggactccagggaaatcatcctcctccctgaaacccctcactcatgtgcctgggccccccagcacctccttccatgcgtaccccgaggtcctttgagcccctccccctgcagccccgccgagccacccggcccgtggccgctgtttacaaggacacgcgcttcctgacagtgacgcgagccgcctcctccccttccccacg

SEQ ID NO: 37158 - DNA, 616 bp, Homo sapiens
atcagactatcttttatccagggacagaatcgcttctctctcctttcagtacagtatccctctgttggtggggtaaaggacatctcttccaggtttttgtcaactgaatgtagtatttggagttggcagatgtaacaaaaagatggaagttatccttaggaagggaaaaaaagattattcaccttgactgatgtatggcagtttgacttgatgggaagaatttggcctgtttctccattgtttgtttgtggtttttaactcacatctttaaatgtgttgtagttcccctcctgtggattagttatggaatcattaaaggtcattgccacatatgggatttgtgtgggctcactctgtattggggaagagaacccgtgtggaactgtagttctttctccttgaaactttgttagcaagaatcaatgtggaaatgcaaaaagaaaataaaaaagaagtgagacccactaacaaggttgtaaaattcctgaactaggacaaactaggagggtaatccttccctggaatatttgtttacctcttctagaaagctcatactgattcagttgcctaggagatttttaggattattaaccttgtagtctctgttcaagacttc

SEQ ID NO: 37159 - DNA, 630 bp, Homo sapiens
aagcctagcccctttcctcaaattgattcaattctcaatggttatctcagctctagggcttggctgaggcctgggttgcaactgcattgtgagtcagtttttatttctggccaatcctgtcagaaacaccagtttcctacagatgtgtctcccactcctgcatgaaattcagcatctcagaatctgtttccagggaaaccaatctgagaccaaaaccatatggccttgatgttttctcagtagaagccttttaataattgattcaatttatttaacagttgaccagttaatttatttaactattgaatagttaataattgtataaccattcaaattttctatttcttgtatcagttttggtaaattgtgctttccaaggactttttccttggaaaatctctatttttagtttgttgacataaggttgttcatagtatcttttcacatttttaatgtctgtaggatatgtagtgatatcccttattttattcataaagatgacaatttgtgttttctttgttatggattagttgctaggagtttatcaattttattattcttctcaaaaaatcaattcttgtctttgtggattttttccagcatagatttatttttgatatcattgatttt

SEQ ID NO: 37160 - DNA, 498 bp, Homo sapiens
tttgttgactcttggcatatagaaatcctactgatttgtatatgttgattttgtattctgcaaatttactcaagttattacttctaatagttttttggtggatgtattaggccattctcacattgctataaaaaataatcagtgactggttaatttataaagaaaataggtttaattggctcatggttctacagggtatacagaaagcatagcactggcttctgcttctggggaagcctctgacaactgacaaggtgaaaaataaatctggtgcttgcacatcacatggtaagtgtgagggcaggggggaggtgctacacacacttgtagataaccaactctcatgaaagctaactattgtgggaatggcaccaaaggaaatgatgccaaactgttcttggaaatcctgctgtcatgattcaatcacctccccactaggcccacttccaacattgaggattacatttcaatataagatttttgtgggaacacacaccc

SEQ ID NO: 37161 - DNA, 167 bp, Homo sapiens
taaactgtaacaggaaacaccgcagatgctagcttttcaagaagcgtaatgctgaacgggacacgctacaggagtatgttacaaataggctgaaggagcaaataaggtctgttgaatgaagaagggatgagtctcacctagcactcaggactgggattattatttat

SEQ ID NO: 37162 - DNA, 422 bp, Homo sapiens
tgttcctgtgttagtttgctaaggataacaacagcctccagctccatccacgttcccacgaaagacatgaacctgttcttttttatggctgctctcaggtttaaaaattagagaaagagaataattttttttgtgcttctgaatggaagttgtaattcatggaaaatagaatataatgtatgccactgacaatatacagtcagtatatatgacacacctttgaacacaagaccagtcaatggtaaatgaacactgctccttcacattgtcttctgatggctctgtcaaagtacagaagcatgctgagatgattcgagatggaagatgcacgttggcattaaatagcagtaaaccacatactgaacaagctattcccttttcaattctttcagtccttcgaaggaggaaatttaaattggtgc

SEQ ID NO: 37163 - DNA, 428 bp, Homo sapiens
tttggaattgggcatgtattccatgagagtaaaatgtagacagcctgtttccttattaaaaggagagatgggggagacgtgaagagattatgtgacagagagagaggaaaaaatacagaaagggtgctatagtgaaggaggtgaaggaatttaacactctgtagacatttgtgagtgtccttatcaccgcactgtaacatcaaaaaattctaaaatctgcaggtcctctttccatgacccacagaggcaaaaagcaattccagaaatgcagatctggacaaatgctagacattttatggtttatttttgtattctgtgaatacattagagatttttaaaattgtttcttgatttctttttccatcccattttaatgcattattgtatctctcgtttcccccaatacctctgaaaatgtataatcagga

SEQ ID NO: 37164 - DNA, 590 bp, Homo sapiens
gcaggagtttggggaagattaagttagacccaggaacaggattgagaacgagggggctgaatcaacagtccagttcaatattcacaaatccaaggggtagtgggacagctcatgaccagaggccaatatccatgggactggatgtccatggactggccaaagtccacagtgatcacttgctctgaacacttcataatgtaggtacaagctcagttcaccatcagagcagccataagcctaatgtaaacactattcactgcacaatgggtaggcaggagatctcaccaggtcaaatccccagcctaactcaggaaaagtgaatcctaggggttagtttaagacaaacagaccaacccccggcaaaacagttctcctggtagaaccatacagttggactgagtcttggattggtaaagtctcagtggagtaaatcttatttgggtattaatagggagaaagttaaagaccagtattccttacctcaattctggagggatattgtattattctaaatgtaatacaggtccataatgtttagttgttttaggattcttggggtcagatgttttttagaattcagaactttgtga

SEQ ID NO: 37165 - DNA, 372 bp, Homo sapiens
ctcatttaacttttttaatgggtctcaaaattctgtgacaaatttttggtcaagttgtttccattaaaaagtactgattttaaaaactaataacttaaaactgccacagagtagtacagcatatttacaatagctgtagttgataaaggatttgaatctagaattcaatagtagttaggtgttgctacataacaaattacccccaaaacagtgatctcataatcttggtgggtcaggaatctcggtacaacttagctgggtacttctggcacaagatctctcatgaggttgtagttaagctgccagctatagggcagtgggttcatctgaagacccaagcgagggatccactttcaagcttcctcatgtagt

SEQ ID NO: 37166 - DNA, 349 bp, Homo sapiens
tcacttgagcccaagaggttgagggtgtatatatatatatatgaggggggaaaagtagcatgcattttttaggcctcattacactttattatttttgagtattatttctcctgtggataattatattaagaaactgtagctgtaaaaataagcacagtgctaggttcatgtcatggcagagtggattgatggtgtatttcctaattttgcaaagaatgtgtgatttctgagctggacacagtgacttatacttgtagtcccagctactcaggaggctgaggttggaggaccactttggcccaggaattcaagtccagcctgggcaacgtagtgagacccagtctcttta

SEQ ID NO: 37167 - DNA, 636 bp, Homo sapiens
ataagtgtataaggaatgtgctcttgagtctgattgtacttgtgggccgttgacgctaccccgagtgctgccattgagccctgtccctctcctgcagatctgagaagtgctccattgtcacctcaattcttgagcttatctgggtatctccagcgcaccctgtttatgtcttcttctgtgcccggggctactctgaaagttgtcctgcacctgagtgtccggcggccctgcctgagacaccccctccttgtggagcagcttaacaattgcatcagctttctcctgtgctgattcttcatgagaacgttgccaaggcgctgtggagacaccgtttctctagttgtgcagctgcaaggtcacagacagagaaactcaagtcgtaaaacatgtttttccttcaaaaggaagaaatgatgtaaggaatgtctcaattcattgaatcactgtctttgtttctcgcttctgtaacatgcttccccctgcaccgatctccccccaccccgcgaaatgcttaaaaggtaacttaactctttgttcagagctcagtcctttggatgttaacccgactgggctggtgcacctaaataataaatatcctcctcatcctgaaccatatatgggcctcgttggcctcac

SEQ ID NO: 37168 - DNA, 701 bp, Homo sapiens
ctgaattatctagcattaaaaaacctcctctttttacatcgaaacctctcattcagttggcatgcctttggctgtagcgagagaggtgatgatccagccttatcctgttctctccacagtgctccacggcggctgccagtgagccctgtccctctcctgcagatctgagaagtgctccattgtcacctcaattcttgagcttatctgggtatctccagcgcaccctgtttatgtcttcttctgtgcccggggctactctgaaagttgtcctgcacctgagtgtccggcggccctgcctgagacaccccctccttgtggagcagcttaacaattgcatcagctttctcctgtgctgattcttcatgagaacgttgccaaggcgctgtggagacaccgtttctctagttgtgcagctgcaaggtcacagacagagaaactcaagtcgtaaaacatgtttttccttcaaaaggaagaaatgatgtaaggaatgtctcaattcattgaatcactgtctttgtttctcgcttctgtaacatgcttccccctgcaccgatctccccccaccccgcgaaatgcttaaaaggtaacttaactctttgttcagagctcagtcctttggatgttaacccgactgggctggtgcacctaaataataaatatcctcctcatcctgaaccatatatgggcctcgttggcctcac

SEQ ID NO: 37169 - DNA, 474 bp, Homo sapiens
tggcacctgggtgtctcccgaaagcctcctcagagctgtctttgatgagcaccacctgctgcctgtcagtccaactgcggtggagatggttggggtcaaatccccattgtcaaggtgataggagagacctcagtgtgctttgtggatgcagaggatgaaaatcagcaaaactgaatgagctgtgtgctgttcttagaggaagcactaggtaaactattccagtacaattctgtttattcttttctgtgcaaacccaaatttagtgtacccaatacacatgcatatgaatacataccacatagaaatgcacagacatcacacacacccacaacactcagacacagggatgtgagtgtatgcatgaacacatactcacactcacacaccattgtaaggcttgtcctcatcctaagagtttaacgtaatagcttttttaaaaaaattgaataaatgaatgaatgaaatcaaaattta

SEQ ID NO: 37170 - DNA, 889 bp, Homo sapiens
  misc_feature (881)..(881): n is a, c, g, or t
  misc_feature (886)..(888): n is a, c, g, or t
tgaaaatctactctatcagctgctgtggttgccaccattctcaggaccctcgccatgaaagcccttatgctgctcaccctgtctgttctgctctgctgggtctcagctgacattcgctgtcactcctgctacaaggtccctgtgctgggctgtgtggaccggcagtcctgccgcctggagccaggacagcaatgcctgacaacacatgcataccttggtaagatgtgggttttctccaatctgcgctgtggcacaccagaagagccctgtcaggaggccttcaaccaaaccaaccgtaagctgggtctgacatataacaccacctgctgcaacaaggacaactgcaacagcgcaggaccccggcccactccagccctgggccttgtcttccttacctccttggctggccttggcctctggctgctgcactgagactcattccattggctgcccctcctcccacctgccttggcctgagcctctctccctgtgtctctgtatcccctggctttacagaatcgtctctccctagctcccatttctttaattaaacactgttccgagtggtctcctcatccgtccttcccacctcacacccttcactctcctttttctgggtcccttcccacttccttccaggacctccattggctcctagaagggctccccactttgcttcctatactctgctgtcccctacttgaggagggattgggatctgggcctgaaatggggcttctgtgttgtccccagtgaaggctcccacaaggacctgatgacctcactgtacagagctgactccccaaatccaggctcccatatgtaccccatcccccatactcacctctttccattttgagtaataaatgtctgagtctganaaaannna

SEQ ID NO: 37171 - DNA, 328 bp, Homo sapiens
gtgggtcttagatttggttttagggggctttgggggaatatctctgccccacaatagccctccagcaatgtgaagcagcgttgtgtcttgtaaatcttttcttccctgggtagacagccccagtcccatcagctgatagtctggaaactcctcttcaccctgtggagcacaggacctgaaatagatgttgtcaaagatttgatccccagttgactttctcactttcttatcctgtaagcctctgaagagctgcaaaattgctctaaaagagacagtacaaaccagactaaattggaagcccattagaagctgtcatctagccaatttc

SEQ ID NO: 37172 - DNA, 411 bp, Homo sapiens
gtagagacggggtttcaccatgttgaccaggctggtctcaacttctgaccttgtgatccgtccgccttggcctcctaaagtgttaggattacaggtgtgagccaagatcaggaacaagacgaggatgcccactctctactttcattcaacatagtactggcagtactagccagactggttaagcaagagaaagaaaaagcatccaaataggaaaggaagaagtgaaattgtctctctttgccaacaacatgatcttatattagaaaaaaccctaaagacttcaccaaaaagctgttagaactaaagtgacaagaaacaaaatcaacaaacagaaatcagtaacatttctgtacactaacaaactatctgaaaaagaaatcaagaaaaaggcagaaataaaaaactgaattc

SEQ ID NO: 37173 - DNA, 184 bp, Homo sapiens
cattttggacaccaggggaaatggaaatgctgctttcaaaacttagtttcctttccatttcttcctagtctggcctttgacacaaatctggtagaaagaagcctgataaattgagggcacttgtaccctccctgtgcccccagaaggttcttggagagaagtgcaagaatttgtgaacacggcg

SEQ ID NO: 37174 - DNA, 445 bp, Homo sapiens
aagcttattttggtgtcacggtatgaaacagcaggatgtatccttctttaccatggacagcaacaggatttgggatgatctcagggcaaaggaggattttattcgtcatttgacctacatagtcacaattatgataggtcctaccttttgtctaccagaagggatgctggtgatgacactagtcagattattcacaaccaaacttcgtgtgacctaaaccgaaaaagagttcctgttatttgagggcataagtttaagatttagaaaaaaaataataaagttcttatttgtgtctttagtttctttaatttaaaactttttataaatggaaaataaactgtttcttttttaaagccataaccatttgcaaaatggaggttttaaaattttttgtatttatttttttttgagacggggtctcactctgtctcccaggctggagtac

SEQ ID NO: 37175 - DNA, 572 bp, Homo sapiens
actctgatcctgttattcagaataaagtagcatttctgccatgagctatctcagagcatcacggtgaggtataaggaacatctctttggtacacatagcattcattcataaggcttttacttataacagctttcaatataacctgaagagcagggaagtaaaaaaaaaatttaaaaataaattcaataagatgccattccaataacagggagatagctttttgattaccaccttaatctatgaataaattttagaacctatccttcttagggcaaaactccacaaatattatttctcccaattagtcgttgaataggaattcaagtgcagatacttcaaagttatacttaccaatgattatctggagagcaattactctatgtggccacaagtataaagccatattctccaaagattagcacatctttgcctaatgttaacatcctttcaatgaatactaaggccttgacaaggtgcacactgaaagagaaggacaccacactctgttccagtttgagctgatgggaataaacagcatcacaggacatgggcctgcttttcccaaaagacca

SEQ ID NO: 37176 - DNA, 230 bp, Homo sapiens
aaacaaaaacctaaccctttggttggtctttgtgttctcatgtttacttaagtttaacaagacctattgtgcatcatggccttgagccctgaggttcagggaggggatatatccccaatgctaaatgacgagttgatgggtccagcacaccaacatggcacatgtatacatatgtaacaaacctgcatgttgtgcacatgtaccctaaaacttaaagtataataataata

SEQ ID NO: 37177 - DNA, 689 bp, Homo sapiens
tggcaccaaaagaaattagaaaaaaattgttgcaaatgtcagtgaaatcttttaaaaaactgttgtacttagaagtgcctcaagtgactaatggaggcttaggactctgaatggtgtcacaaggaaccttatgcacagggacactgacatcagcctgtactgctggtaatgtcagagtgaagcaaatcccacctgaaggcactctcttgcttgaccgtgaagtcacactgagtggttcaccatgtgcctgcactcatgcaaggataagccaggtctctaggcatgggcagaaggatccctgcttcccttctcttccctttcagagcaacactttcagccatttccatgagtctgggctcttgttacccagctgaaatactgtttcctgaaactcacaaatttgctctctaccaaagcccaccttatgccctgcctttccatgaagcctgtcaagaaaattccaagaaagaaaatttgatattcctatatcaaagcgtgtgtctttcctctcctaatccctcttagctgccacagtaggtgcaatgtcattttagcttttgcagatgcattacctggtggtttcctagtatttctttcacttgcctcgattgctagattagaaatttactggggacagacatctttttaatatctttctcctactacttaacatatagagcatcaaggga

SEQ ID NO: 37178 - DNA, 393 bp, Homo sapiens
gtgccctatcccaataccctggaattacttttcctcttttacttactcaagtcctgcaaaagccagttccattatgctggtctcactgacctctttctacatatttctggtaagaatgaattactttctcctgaaatacctctgccatattgtttaaaaattgccatatggtgctggacatgagtatgtgttcacatgtttattatctactctagtctcaatttctaaggtcttgaatataggaaccaatttattcatcaccttattccagacatgatggaactcagctttattgagaatcaagtgattatagtaggatagtgaccatcctgagtatgttcatgtgttacataacaatgttttggtcaaccaaggactgcatataggaaggtg

SEQ ID NO: 37179 - DNA, 458 bp, Homo sapiens
  misc_feature (276)..(276): n is a, c, g, or t
cttctttactgttttaggtaccatgttggcttggtagtagaacacttaatcttgtcagttccagaaaatttactgacttttagtctaacattttgtcccttagtagggagggggtggtaattaatgagccaaatgaggattctagaagaatcctatgtggcttgcagcctttcagtttatgccccagcctttcaagggggctgcttgggaatcttctgttctgcttggggatcttctctgagctttctgttatcctgctgcttctgggggctggcnttgggatcctggtgctgctgctctctttcctctctttgacaagggatggagccctctttttcctctgggtgggtgatggtattacattaccctgcattcatccactccatggtttagatcatgtgggtcctccaggatttggtgctttatactgaatccaacctcttgaattaaaaaaagaa

SEQ ID NO: 37180 - DNA, 2054 bp, Homo sapiens
ggggttgttttagagctaggtggtccaccactgtagccactggtcacatgtgactatttaaatgaaaattaaataaaataaaaaattcagctttccactcatagtaggcacatttcaagtgctcagtggtcacatggctgctgaattggactgttatatctttgtaagaagttctgttgggcagagctgctctgaagttttgaactttcaacagagtgaattatggcaaggcagatttcagctcatttctaacaaaactgttctattaattttaactgttcagtgccagagctgttgaactggctgcctcaaagaatagtaagctttctgtcatttgaagtactcagacagagactagattcctactttttggagtgatgtagaagagtttcctacccagaaccttagggtgtttaagtgggaagaagactcagcaattcaatgtttcttttactgcagatgaagacacagactcagagtcagacagttttgcccaaagacccacaactggttaatggcaaatgctagctgtcctcatgaatcctagcttagtacttttcccattccacccattggctaatgttttaacaacaaggtcctcgcggttcttgttgagcaacacatttccgcttctggcattcaccagcttttccacttattctctcccactcttctgcagtgaaaactacactgcagccaagctgaactggctatattgaaatacgttattctgattcctgcctctgcgtctttgctattgctttgccctttatcaaagtgacatttcttcacaaacttaattctacttattttctaacttctcctcaggtctcagaatattcaaacccataccatctcttctctttgctaaactaccttgttacaatgcactcagacatttatactctctgtgatgattatattttgtcttatccctttgatgagcttcttaaagactgtgattactattttcatgcatatatcctttttctgtctccctcactagaatataagttcctcaagggcagggactatagctgtctttttcaccataccttactatccagttgctatccagcaagtgtcttagcaccataataggtgctcaacaaatatttattgaatgagtgaatcaatttttctcttcccaagcatgctattattctccttaagtttgccatgaattctcaataaatacttttctaagcaaacatttctgtttctataaagtaagtattgaaaataggaatatgaaaaaaacaaagtaaggcactccagcatgtaaagtgcttgggagtcctcactcccttccaaacctgagcaagtaaaacttggtaagttttcctggaactgtcagcaatctcagggcaaatcacttgccaccccaaaatctgaagaaataggtacattcagacagtcacagctaagatttgcttacctacagcagaagcaactggaaccatagactagaagggccatttaaatagtaattttgatgaattgctggaggctaagtgttgactagcttgagagtggaactcctaggcgcaggagtctgagaaagggtctcacacgtacatggattttacctcccggaaacccgtcaggttttcacagcaaagagccaagatagaccctgtcctggctctggcaaagggaaggggaaagtaatgactttgaagtgcgctcagaatgttctctatgataaagacttactctccaaggaaaagggctttaccagagtcttatcccatctggggagaagatagttctctgactcgaggcacctctagattcctgtgtcaactaaggaaggaggaaaaaggttaagaaacatttgtaaaggtcacagtacagcaacataggcccaccaaaagattgagatgtaatcctaagaaaatggaatgcttcccttccccactccttaccaccacagcaacagggctccttataataacagtggattacagctgaaagagctgcaagatgcagacagacaccggctggccaaggagagggggtctcaggaaagtccaaagacaacaggagagatg

SEQ ID NO: 37181 - DNA, 1613 bp, Homo sapiens
cgagctcggtaccccaagcagttaatacagactcagagtcagacagttttgcccaaagacccacaactggttaatggcaaatgctagctgtcctcatgaatcctagcttagtacttttcccattccacccattggctaatgttttaacaacaaggtcctcgcggttcttgttgagcaacacatttccgcttctggcattcaccagcttttccacttattctctcccactcttctgcagtgaaaactacactgcagccaagctgaactggctatattgaaatacgttattctgattcctgcctctgcgtctttgctattgctttgccctttatcaaagtgacatttcttcacaaacttaattctacttattttctaacttctcctcaggtctcagaatattcaaacccataccatctcttctctttgctaaactaccttgttacaatgcactcagacatttatactctctgtgatgattatattttgtcttatccctttgatgagcttcttaaagactgtgattactattttcatgcatatatcctttttctgtctccctcactagaatataagttcctcaagggcagggactatagctgtctttttcaccataccttactatccagttgctatccagcaagtgtcttagcaccataataggtgctcaacaaatatttattgaatgagtgaatcaatttttctcttcccaagcatgctattattctccttaagtttgccatgaattctcaataaatacttttctaagcaaacatttctgtttctataaagtaagtattgaaaataggaatatgaaaaaaacaaagtaaggcactccagcatgtaaagtgcttgggagtcctcactcccttccaaacctgagcaagtaaaacttggtaagttttcctggaactgtcagcaatctcagggcaaatcacttgccaccccaaaatctgaagaaataggtacattcagacagtcacagctaagatttgcttacctacagcagaagcaactggaaccatagactagaagggccatttaaatagtaattttgatgaattgctggaggctaagtgttgactagcttgagagtggaactcctaggcgcaggagtctgagaaagggtctcacacgtacatggattttacctcccggaaacccgtcaggttttcacagcaaagagccaagatagaccctgtcctggctctggcaaagggaaggggaaagtaatgactttgaagtgcgctcagaatgttctctatgataaagacttactctccaaggaaaagggctttaccagagtcttatcccatctggggagaagatagttctctgactcgaggcacctctagattcctgtgtcaactaaggaaggaggaaaaaggttaagaaacatttgtaaaggtcacagtacagcaacataggcccaccaaaagattgagatgtaatcctaagaaaatggaatgcttcccttccccactccttaccaccacagcaacagggctccttataataacagtggattacagctgaaagagctgcaagatgcagacagacaccggctggccaaggagagggggtctcaggaaagtccaaagacaacaggagagatg

SEQ ID NO: 37182 - DNA, 383 bp, Homo sapiens
ccttaaacaagtgatgcatattgtgccttggctattaccagagccatgtggaagctagaaatgagtagtgtgaaagaacctaggtcctagcccacccacttttcctagccctttcttttgatgttgaactttaaatacagtaaactttaaaataagcagtcaaatcatacataagaaatgtaagtagttatgtaagtgttttggcactgacttttttaaattatgaaaatgaaacatgacattgtaaattcaaacagtaagtgtaatgacaagtgagtttctttatcactagctgctaagctccatgccctagagaccacccttcacaatttcttacattaatatgaccctctagaaatttttcatgcatacacatgtgtata

SEQ ID NO: 37183 - DNA, 550 bp, Homo sapiens
caggctcctggctgagcacccagctgacaggcagcacaaacctgccagtcactcaggtgagttctttggggagtatattctccaactccagcagaggccaagaggagcagaatgagccattaccactgagctctgcccacattattgatttgtgagaaaactgaatgattgtggttgctttaagcacaaagtttgggggtagttttttatgcagcaatagatggacagaacaagtgctaaggcctttacacgttatctttattcctcacaatgatcttatgaagaagctattatccttacctcaagatgacaaagctgaggctcagtgagttggcataataatccaggtctgtcaactccagcttgatagatatttctcctgataaatcttacttcactttatgatccatcttattcacagctgttgagtcaggcacgactaaggttaaatcttagttctgcccttattggctatatgaccttggataaatagaaggtaagtttgttacttcacaggactgtgaagattccaaggatacatataaagaaa

SEQ ID NO: 37184 - DNA, 1679 bp, Homo sapiens
tagagatggggtctcactatgtcgcccagggtagtctcaaactcctcggtcttggcctcccaaagtgttgggattacaaacgtgagaaccgtattttcaaatgtattcaataacactacagcgtttccaattttaagaggaagcaattgccacaaaatcactgcccctggtctgggcaaggggcagttggtgaacttgctgcctccagagaaccttccctggtgtggaggcagccagggacccaggatgctccggacctgttacgtgctctgttcccaagctggtcccccctccaggggctggcagtccctgagctttgatggcggggccttccaccttaagggcacaggagagctgacacgggccttgctggttctccggctgtgtgcctggcccccactcgtcactcacgggctgttgctccaggcctggtctcggcgactcctgggctcccggctctcaggcgcatttctccgagcatccgtctatgggcagtttgtggctggtgagacagcagaggaggtgaagggctgcgtgcagcagctgcggaccctcagcctccgaccactgctggcagtgcccactgaggaggagccggactctgctgccaagagtggtgaggcgtggtatgaggggaacctcggtgctatgctgcggtgtgtggacctgtcacggggcctcctggagccccccagcctggctgaggccagcctcatgcagctgaaggtgacggcgctgaccagtactcggctctgtaaggagctagcctcgtgggtcagaaggccaggagcctccttggagctgagccccgagaggctggctgaagctatggactctgggcagaacctccaggtctcctgcctcaatgctgagcagaaccagcacctccgggcctccctcagccgcctgcatcgggtggcacagtatgcccgggcccagcacgtgcggctcctggtggatgcggagtacacctcactgaaccctgcgctctcgctgctggtggctgccctggctgtgcgctggaacagcccgggtgaaggcgggccctgggtgtggaacacctaccaggcctgtctaaaggacacattcgagcggctggggagggatgcagaggctgcgcacagggccggcctggccttcggagtgaagctggtacgaggtgcatatctggacaaggagagagcggtggcccagctccatgggatggaagaccccactcagcctgactatgaggccaccagtcagagttacagccgctgcctggaactgatgctgacgcacgtggcccgccatggccccatgtgccacctcatggtggcttcccacaatgaggaatctgttcgccaggcaaccaagcgcatgtgggagctgggcattcctctggatgggactgtctgtttcggacaacttctgggcatgtgtgaccacgtctctctagcactggggcaggccggctatgtagtgtataagtccattccctatggctccttggaggaggtaatcccctacctgatccggagggcccaggagaaccggagcgtgcttcagggtgcccgcagggaacaggagctgctcagccaagaactgtggcggcggctgctgccaggatgccgaaggataccccactagcacccctgagggggtcatgtggtcaataaaagtccttaggtgctgcctaa

SEQ ID NO: 37185 - DNA, 437 bp, Homo sapiens
aagagagaaaaaaaaaagtttgctccaggacttttagctttttcagttagaaattttatccaactcacttaatctgccatgttctcagaaacagaagtctctgttccaggtggggactggggagtgtccccccagcccaagcccatacctctgtctcagaaaaacaccaaaaacgaaaaaacaaaacccactctccctgcagggcaggccggctatgtagtgtataagtccattccctatggctccttggaggaggtaatcccctacctgatccggagggcccaggagaaccggagcgtgcttcagggtgcccgcagggaacaggagctgctcagccaagaactgtggcggcggctgctgccaggatgccgaaggataccccactagcacccctgagggggtcatgtggtcaataaaagtccttaggtgctgcctaa

SEQ ID NO: 37186 - DNA, 1851 bp, Homo sapiens
tagagatggggtctcactatgtcgcccagggtagtctcaaactcctcggtcttggcctcccaaagtgttgggattacaaacgtgagaaccgtattttcaaatgtattcaataacactacagcgtttccaattttaagaggaagcaattgccacaaaatcactgcccctggtctgggcaaggggcagttggtgaacttgctgcctccagagaaccttccctggtgtggaggcagccagggacccaggatgctccggacctgttacgtgctctgttcccaagctggtcccccctccaggggctggcagtccctgagctttgatggcggggccttccaccttaagggcacaggagagctgacacgggccttgctggttctccggctgtgtgcctggcccccactcgtcactcacgggctgttgctccaggcctggtctcggcgactcctgggctcccggctctcaggcgcatttctccgagcatccgtctatgggcagtttgtggctggtgagacagcagaggaggtgaagggctgcgtgcagcagctgcggaccctcagcctccgaccactgctggcagtgcccactgaggaggagccggactctgctgccaagagtgggtgagtagggagccagggcccagggaggctgggaggacgcaggaaggggctttgctgttcgggccctgacacctgctggctgggcagtgaggcgtggtatgaggggaacctcggtgctatgctgcggtgtgtggacctgtcacggggcctcctggagccccccagcctggctgaggccagcctcatgcagctgaaggtgacggcgctgaccagtactcggctctgtgtaaggagtgcaaagacgggggtgcggggagggcgcggctgcccatcgggctcccctcaccaccccgcctaccaccccatttcagaaggagctagcctcgtgggtcagaaggccaggagcctccttggagctgagccccgagaggctggctgaagctatggactctgggcagaacctccaggtctcctgcctcaatgctgagcagaaccagcacctccgggcctccctcagccgcctgcatcgggtggcacagtatgcccgggcccagcacgtgcggctcctggtggatgcggagtacacctcactgaaccctgcgctctcgctgctggtggctgccctggctgtgcgctggaacagcccgggtgaaggcgggccctgggtgtggaacacctaccaggcctgtctaaaggacacattcgagcggctggggagggatgcagaggctgcgcacagggccggcctggccttcggagtgaagctggtacgaggtgcatatctggacaaggagagagcggtggcccagctccatgggatggaagaccccactcagcctgactatgaggccaccagtcagagttacagccgctgcctggaactgatgctgacgcacgtggcccgccatggccccatgtgccacctcatggtggcttcccacaatgaggaatctgttcgccaggcaaccaagcgcatgtgggagctgggcattcctctggatgggactgtctgtttcggacaacttctgggcatgtgtgaccacgtctctctagcactggggcaggccggctatgtagtgtataagtccattccctatggctccttggaggaggtaatcccctacctgatccggagggcccaggagaaccggagcgtgcttcagggtgcccgcagggaacaggagctgctcagccaagaactgtggcggcggctgctgccaggatgccgaaggataccccactagcacccctgagggggtcatgtggtcaataaaagtccttaggtgctgcctaa

SEQ ID NO: 37187 - DNA, 1766 bp, Homo sapiens
tagagatggggtctcactatgtcgcccagggtagtctcaaactcctcggtcttggcctcccaaagtgttgggattacaaacgtgagaaccgtattttcaaatgtattcaataacactacagcgtttccaattttaagaggaagcaattgccacaaaatcactgcccctggtctgggcaaggggcagttggtgaacttgctgcctccagagaaccttccctggtgtggaggcagccagggacccaggatgctccggacctgttacgtgctctgttcccaagctggtcccccctccaggggctggcagtccctgagctttgatggcggggccttccaccttaagggcacaggagagctgacacgggccttgctggttctccggctgtgtgcctggcccccactcgtcactcacgggctgttgctccaggcctggtctcggcgactcctgggctcccggctctcaggcgcatttctccgagcatccgtctatgggcagtttgtggctggtgagacagcagaggaggtgaagggctgcgtgcagcagctgcggaccctcagcctccgaccactgctggcagtgcccactgaggaggagccggactctgctgccaagagtgggtgagtagggagccagggcccagggaggctgggaggacgcaggaaggggctttgctgttcgggccctgacacctgctggctgggcagtgaggcgtggtatgaggggaacctcggtgctatgctgcggtgtgtggacctgtcacggggcctcctggagccccccagcctggctgaggccagcctcatgcagctgaaggtgacggcgctgaccagtactcggctctgtaaggagctagcctcgtgggtcagaaggccaggagcctccttggagctgagccccgagaggctggctgaagctatggactctgggcagaacctccaggtctcctgcctcaatgctgagcagaaccagcacctccgggcctccctcagccgcctgcatcgggtggcacagtatgcccgggcccagcacgtgcggctcctggtggatgcggagtacacctcactgaaccctgcgctctcgctgctggtggctgccctggctgtgcgctggaacagcccgggtgaaggcgggccctgggtgtggaacacctaccaggcctgtctaaaggacacattcgagcggctggggagggatgcagaggctgcgcacagggccggcctggccttcggagtgaagctggtacgaggtgcatatctggacaaggagagagcggtggcccagctccatgggatggaagaccccactcagcctgactatgaggccaccagtcagagttacagccgctgcctggaactgatgctgacgcacgtggcccgccatggccccatgtgccacctcatggtggcttcccacaatgaggaatctgttcgccaggcaaccaagcgcatgtgggagctgggcattcctctggatgggactgtctgtttcggacaacttctgggcatgtgtgaccacgtctctctagcactggggcaggccggctatgtagtgtataagtccattccctatggctccttggaggaggtaatcccctacctgatccggagggcccaggagaaccggagcgtgcttcagggtgcccgcagggaacaggagctgctcagccaagaactgtggcggcggctgctgccaggatgccgaaggataccccactagcacccctgagggggtcatgtggtcaataaaagtccttaggtgctgcctaa

SEQ ID NO: 37188 - DNA, 1593 bp, Homo sapiens
tagagatggggtctcactatgtcgcccagggtagtctcaaactcctcggtcttggcctcccaaagtgttgggattacaaacgtgagaaccgtattttcaaatgtattcaataacactacagcgtttccaattttaagaggaagcaattgccacaaaatcactgcccctggtctgggcaaggggcagttggtgaacttgctgcctccagagaaccttccctggtgtggaggcagccagggacccaggatgctccggacctgttacgtgctctgttcccaagctggtcccccctccaggggctggcagtccctgagctttgatggcggggccttccaccttaagggcacaggagagctgacacgggccttgctggttctccggctgtgtgcctggcccccactcgtcactcacgggctgttgctccaggcctggtctcggcgactcctgggctcccggctctcaggcgcatttctccgagcatccgtctatgggcagtttgtggctggtgagacagcagaggaggtgaagggctgcgtgcagcagctgcggaccctcagcctccgaccactgctggcagtgcccactgaggaggagccggactctgctgccaagagtggtgaggcgtggtatgaggggaacctcggtgctatgctgcggtgtgtggacctgtcacggggcctcctggagccccccagcctggctgaggccagcctcatgcagctgaaggtgacggcgctgaccagtactcggctctgtaaggagctagcctcgtgggtcagaaggccaggagcctccttggagctgagccccgagaggctggctgaagctatggactctgggcagaacctccaggtctcctgcctcaatgctgagcagaaccagcacctccgggcctccctcagccgcctgcatcgggtggcacagtatgcccgggcccagcacgtgcggctcctggtggatgcggagtacacctcactgaaccctgcgctctcgctgctggtggctgccctggctgtgcgctggaacagcccgggtgaaggcgggccctgggtgtggaacacctaccaggcctgtctaaaggacacattcgagcggctggggagggatgcagaggctgcgcacagggccggcctggccttcggagtgaagctggtacgaggtgcatatctggacaaggagagagcggtggcccagctccatgggatggaagaccccactcagcctgactatgaggccaccagtcagagttacagccgctgcctggaactgatgctgacgcacgtggcccgccatggccccatgtgccacctcatggtggcttcccacaatgaggaatctgttcgccaggcaaccaagcgggcaggccggctatgtagtgtataagtccattccctatggctccttggaggaggtaatcccctacctgatccggagggcccaggagaaccggagcgtgcttcagggtgcccgcagggaacaggagctgctcagccaagaactgtggcggcggctgctgccaggatgccgaaggataccccactagcacccctgagggggtcatgtggtcaataaaagtccttaggtgctgcctaa

SEQ ID NO: 37189 - DNA, 1842 bp, Homo sapiens
tagagatggggtctcactatgtcgcccagggtagtctcaaactcctcggtcttggcctcccaaagtgttgggattacaaacgtgagaaccgtattttcaaatgtattcaataacactacagcgtttccaattttaagaggaagcaattgccacaaaatcactgcccctggtctgggcaaggggcagttggtgaacttgctgcctccagagaaccttccctggtgtggaggcagccagggacccaggatgctccggacctgttacgtgctctgttcccaagctggtcccccctccaggggctggcagtccctgagctttgatggcggggccttccaccttaagggcacaggagagctgacacgggccttgctggttctccggctgtgtgcctggcccccactcgtcactcacgggctgttgctccaggcctggtctcggcgactcctgggctcccggctctcaggcgcatttctccgagcatccgtctatgggcagtttgtggctggtgagacagcagaggaggtgaagggctgcgtgcagcagctgcggaccctcagcctccgaccactgctggcagtgcccactgaggaggagccggactctgctgccaagagtggtgaggcgtggtatgaggggaacctcggtgctatgctgcggtgtgtggacctgtcacggggcctcctggagccccccagcctggctgaggccagcctcatgcagctgaaggtgacggcgctgaccagtactcggctctgtaaggagctagcctcgtgggtcagaaggccaggagcctccttggagctgagccccgagaggctggctgaagctatggactctgggcagaacctccaggtctcctgcctcaatgctgagcagaaccagcacctccgggcctccctcagccgcctgcatcgggtggcacagtatgcccgggcccagcacgtgcggctcctggtggatgcggagtacacctcactgaaccctgcgctctcgctgctggtggctgccctggctgtgcgctggaacagcccgggtgaaggcgggccctgggtgtggaacacctaccaggcctgtctaaaggacacattcgagcggctggggagggatgcagaggctgcgcacagggccggcctggccttcggagtgaagctggtacgaggtgcatatctggacaaggagagagcggtggcccagctccatgggatggaagaccccactcagcctgactatgaggccaccagtcagagttacagccgctgcctggaactgatgctgacgcacgtggcccgccatggccccatgtgccacctcatggtggcttcccacaatgaggaatctgttcgccaggcaaccaagcgcatgtgggagctgggcattcctctggatgggactgtctgtttcggacaacttctgggcatgtgtgaccacgtctctctagcactgggtatgtgaatggctcccccacccccatcaagccccaggccttactccctcccagccagagcccttctcctattcccaaccaaggcccagcctccagatccttccagagagatctgtcattccagtgtctgtgggccttccaaggctgtgtctctgtgtctgccgtctgtcatttctgctggttcttgatcatggtgtattatttcttgtgtgttttgttatctttactgtgctgctcctcagggcctgacaccaggtaattaatgtttccttctgccaggtgctaagcagaacgaaatcactttatcctaaattcatagcttgaggtttcttgaaacaccccactggcacaaatttgagctgcaaatacataagggggttaacccatagccccaactt

SEQ ID NO: 37190 - DNA, 937 bp, Homo sapiens
gggaaataggtgcccacaaaagggccctcccttcctctcctttgctcaaatgccagagatggacagaggtgttctggggagaattttaaaaatatttatagccaggcatggttggcacatgcctataatcccaacactttgggaggcgaaggtggaggattgtttgagaccagcctgggcaacacagcaagaccccatttctacaacaaattaaaaaaaaaaaaacagctgggtgtggtggcgcacacctgtagtcccagctattccggaggtggaaggatcacttgagcccaagaggttgagactgcagtgagcagtgcttgagccactgcactccagcctgggtaacaaagcaagtccctacctcttaagtcccagatggacaagacgttgccccttatttgctggggcatgaggaggtctgagggctccagggaactggctgggagtcactgggggaccttcaaggaatgcaaaggactggttattatgtatcattgagtttggaaatacttcaatgtttgaattactggagccgccatatgggtgcatagtggctgactttaagctgtagatgcagccacagtctggactgatgatgtggccttttctgtagcatgtgggagctgggcattcctctggatgggactgtctgtttcggacaacttctgggcatgtgtgaccacgtctctctagcactggggcaggccggctatgtagtgtataagtccattccctatggctccttggaggaggtaatcccctacctgatccggagggcccaggagaaccggagcgtgcttcagggtgcccgcagggaacaggagctgctcagccaagaactgtggcggcggctgctgccaggatgccgaaggataccccactagcacccctgagggggtcatgtggtcaataaaagtccttaggtgctgcctaa

SEQ ID NO: 37191 - DNA, 565 bp, Homo sapiens
tagagatggggtctcactatgtcgcccagggtagtctcaaactcctcggtcttggcctcccaaagtgttgggattacaaacgtgagaaccgtattttcaaatgtattcaataacactacagcgtttccaattttaagaggaagcaattgccacaaaatcactgcccctggtctgggcaaggggcagttggtgaacttgctgcctccagagaaccttccctggtgtggaggcagccagggacccaggatgctccggacctgttacgtgctctgttcccaagctggtcccccctccaggggctggcagtccctgagctttgatggcggggccttccaccttaagggcacaggagagctgacacgggccttgctggttctccggctgtgtgcctggcccccactcgtcactcacgggctgttgctccaggcctggtctcggcgactcctgggctcccggctctcagccaagaactgtggcggcggctgctgccaggatgccgaaggataccccactagcacccctgagggggtcatgtggtcaataaaagtccttaggtgctgcctaa

SEQ ID NO: 37192 - DNA, 155 bp, Homo sapiens
atttacagttcagaatgatccatgcaaactctttatttctgttttctcttttaaaaatcagatctgccacactgggcttatctgtctgcaaggcaccaatttgttcctcctgcatagtaccagcccctttagaccatgaatataatctcctttcc

SEQ ID NO: 37193 - DNA, 340 bp, Homo sapiens
tttgatcagtcagagcccccgcctttgcctatttacggccctgtcactcaagagcagcccagcagcagagagaggagtgttgggttgggtgtggggggcggggggtggtgcagaggggagggggagctgccgaggagaggcaggtctggggctgccagggcagtccaggctgcctaactttctgatgcaaccagcccttcagtggcaaggtgctccctggcctctgggacagcctggaagtgtgtcctgcctgcaccgacacacacttctcacagtctgctgagcagcaccttccagttgcgaactacgccagggaacagacctggctgcagagaaccgg

SEQ ID NO: 37194 - DNA, 524 bp, Homo sapiens
acactaacattcgttaaaatgtatccaatgtttgtaatatgtcataaaatgtgctaaacagttcctagttatgagcttagttaattctcagaactttgtaagcagctgacaattgatttcattagctgatttgattttagctccattttacaggtggaaaaactgaggcacagagtgagtgaattcctgaaaccgtaaagataggaaatattcaagagggaattaccatctggatgggttgactaggtttcctctctgaatcaccattgtacacagtttccagggtcaggtaaaccaaacaaaaccatgggatacctacactgttagccctcctccccaatctgcgcctcacttgtccttagcaggtgctcattagctacttgtgccctggacaagatgctgtttacacacttgtgttttctctaaaacaaggacatggcaccgacttggctagtgtttgtctaggttccataaaacacataaatttccaaacttggcttattgaggtaagaaccagtataatt

SEQ ID NO: 37195 - DNA, 166 bp, Homo sapiens
ttgatgacctattatgtgctaggcaaggttctaagttcagaggatacagtagtgaatcaaacagacaaaattccctgccttcttagagcttatgttctagttggggaaagacaaaataaataaatatgtaaaatatatattatgtcaaatagtcataagtactatg

SEQ ID NO: 37196 - DNA, 397 bp, Homo sapiens
ctttaataaaagggatatacagataatgtctttctcatgaggttgtggcagagtttaatgtaataacaggtatagtgcttagcacagggtctagcatacattatgcttgataaaatattgcccctttatttctgatgattattaaggcacattgccttaacaaaaagatgtttaagtcatatgaggagtaaaaattttaaactgccttttggttcaaatttctgcttcctcttgcctcttttatgtccccatttcatctatcattggggtattaatatattcataatccaaaggactttgggttctaaggaaaccccaaaattctctagggaaatagttgggagggtcccaaggtattcaccccaaagtagttttcacaaataatgttggtacatag

SEQ ID NO: 37197 - DNA, 237 bp, Homo sapiens
ctggaagaatttagaaaatacagttctattaatattaaatagtttacaaaatttgaaaagatagatcataaactgtccacagtggttctctggattattcaagtgggggactggagtggagggtagggtaggaaaaaaatgtttcctttctctatttttgtgttgtttgattttctttttaaaccataaaaatttattacctttagattcaatagccaaaagaaaggtatcatttta

SEQ ID NO: 37198 - DNA, 486 bp, Homo sapiens
aactgcatttctggacatgaaaagtcaaatgaatgcggggaaaagtaaattgcctatagaggtattttctgtatttccctagagggggaaatgtgtaatttctcaaaaggaagaagtcctcatttatccttctgaaccacaatcatatgaatccattcaattaatattaatcttatcttctattctccatcactctctacatctttctataattgcatcattttcttgtccgtataatacatcaaatgcagaggtgattttaagggagccacaaatcaagaagtctcaattcaataatttcgttaaaatgtaagaaatatatacggattaagaatattcttaggtaattatgttctgtttcaaatatcagtgaaaattttcatagacatttaaggggtaaaagacatttaacagatagaaaaaaatatctaccttttaaaaaatgaccttctcttttgtcctacgtgatttgttgagcagactggg

SEQ ID NO: 37199 - DNA, 321 bp, Homo sapiens
aactgcatttctggacatgaaaagtcaaatgaatgcggggaaaagtaaattgcctatagaggtattttctgtatttccctagagggggaaatgtgtaatttctcaaaaggaagaagtcctcatttatccttctgaaccacaatcatatgaatccattcaattaatattaatcttatcttctattctccatcactctctacatctttctataattgcatcattttcttgtccgtataatacatcaaatgcagaggttgcagtgagatcgcgtccatgcactccagcctgggcgacagagcatgactctatctcaaaaaaaaa

SEQ ID NO: 37200 - DNA, 395 bp, Homo sapiens
gagaactgcttgaacctgggagacagaggtttcagggagcagatgtcataccactgaactccagcctgggtgacagagcgagaatccatcaagatcaaaagtctttactgtttcctgagcagtgtgtaaacctcccagactcttacgtgacccttgagagacaagctctataaggactgtgatttaacttctccatcatggcaggcttgggggcacactgaagtcaatttaggaaatacatagaaatggacaacatggcttacacatttgagatctgatttctactggctatgcaatgttaaatccatttttttgtttccttctttcaaatactttccaccatacttaccctcatgacagacatttacacttcagcccttaggctgtgagaagca

SEQ ID NO: 37201 - DNA, 409 bp, Homo sapiens
atcatctgatcaggcagatcctatggtttgggaagtgacagtggggaaggcatgatgcagtatgaaacttatgacaagctccagtagaagattcacaacacaggcccctgtgattctgaagtgaagccaggtcatcctcagcagagagtgacatgccttgggaatcagtccctgtgcatcactgggccctgatagcattggaacacttagctatgggacagcgggtgaccatgtgtttagaacttccatttatgaactgcgttctgttaaaccttccaagtcctaaagccaatgagctcagaaagtccactctaagatgaaaatggagcatctgggatcaaattagagcaaggccagcaggcacatgtcagttgcacgagcaggtagcccaaacccccatgtcactcac

SEQ ID NO: 37202 - DNA, 713 bp, Homo sapiens
gttgaataaaatatgacagacctccttttaaatgtatagctgagcttttaatagtgtgagggaagtccacagggatcaacaattaagagagaactgcaaacaacagtagtaagcacataacctgatgctttggcaacatggaaggagaggggtgctgtttcagtaactaaaggattttaaaaagaagataaggccttaagttcaataaatttgactgttggaaactaaaatcttctcacctgcctttcaactctccatacaatagcccgaactatcttttaaaaatgtaaaccagataatgccgccctcctgcttagaatgttccaaaggcttcttattgcagatgatatacaaaacaatcttcatgccttattctgcatgcgctagatcatgcattctcaaacaggatgatattgcccccaaaagggggaaatatgattgttggtgtgagaggtggaatgatatgaagttttacaatgatttgtgtcctccaaagctcaactgtatttgataaaatcttatactttagaacttaaatcactcttgttttcttggatattacagaagcattgccattgagctcatggaagatacatgaaatgtatgcaagaccagcactacaaaatcatagcaaatagatgactttgattgtaggacttttcaatctattgctcattcttgaagtcatatgtcaagaagtggcctttgtgtac

SEQ ID NO: 37203 - DNA, 521 bp, Homo sapiens
ttacaggtgtgagccaccacacctggccaacatgtggctttcagttcttacttgaagacagctgctctagctagaaacttcctatcggcatttgagccagctggtagagggcattacctcccccacccccaagaacacttcttggaagttacacacaatacataaacttcaatttcaaacagttgcttggtcccactagccatgaagctggatgggacgtaatattctatctgggttgtcatgggccaaattaacattttgagattctgttaggaagacgagaattggataatgggcacctctaacagtgtctgtcagagttgacatacattgtgtatctcctgcaccaaagcatttttgagatcaagtgttcttccagctgagcagaaatttggaaggctattcagtgctgcttagtgtagcagctaataatgttccaacttctatatgatagtttgctttttgttttttgtttttttctagagacagagtctggccaatatggtgaaaccccatctcta

SEQ ID NO: 37204 - DNA, 1058 bp, Homo sapiens
ttacaggtgtgagccaccacacctggccaacatgtggctttcagttcttacttgaagacagctgctctagctagaaacttcctatcggcatttgagccagctggtagagggcattacctcccccacccccaagaacacttcttggaagttacacacaatacataaacttcaatttcaaacagttgcttggtcccactagccatgaagctggatgggacgtaatattctatctgggttgtcatgggccaaattaacattttgagattctgttaggaagacgagaattggataatgggcacctctaacagtgtctgtcagagttgacatacattgtgtatctcctgcaccaaagcatttttgagatcaagtgttcttccagctgagcagaaatttggaaggctattcagtgctgcttagtgtagcagctaataatgttccaacttctatatgatagtttgctttttgttttttgtttttttctagagacagagtctcgttgcccaggctggtctccaattcctgggttcaagcaatcctcctgactcggcctcctaaatgctgggattgcaggcatgaaccactgtgcccagtctatatataatagattttagaagaaatttctgccactcagtgactgctttaaattctagagacagaggctgagagaaacttagtagcctgcctgcgcatactgcaagtacagactatataacaagttgaaagagaatcaccctggtatataatatttaaaacatgaaaaaggcattactattgttctggtctaagtactctaacaggacgatgatttctaaccctagcatcatgacatgtatatagtgtgttgtaagacatttgccagctaatagttacagtactgaagcttgtgaatacgttaattgagaaaactttaagcaggttcaaagttatcccatgatagtggcattcttatttgtatatatgtgctttccttttttatttgtatcaaggcatttaaaatgaatatatgtaacatgtacctaagttttaaaagcataataaaatgaacacatctgaaacca

SEQ ID NO: 37205 - DNA, 1210 bp, Homo sapiens
gtgggtaggatttatggagcatcttatctacaaaggtcataaagactgaaaaattatgattgacccttcaacgtggatttgaactgcctgggtccacttatatgtaaactattttcaacccaacttggatcaaagacaaaatttacgagatgtgaaacccatgtatatggaagactgacttttaatatatgtgggttccacagagctgactgcaggacttgagtatgctcaaattttggtatatgtgggggtcttggaaccaatcccctgcatgtgagggacgacggtagcttcaaaaaggacttaggtgttgatgacaattcgccctaaccctgcaaagctctttcacactcatatttttcttctacctttgtaatatccttaaaatcacttcctgaggatagcgggagaggattatcatcctctggaatagattgatgcatgggttcagagaggcagattagaacgcttgtccaaagtactagagcaagcaagcagtggaagcagggtcttttttcttttccttttttttttttgagatggacactcactctgtcacccaggctggagtgcagtggtgtgatctcagcttactgcaagttctgcctcccgggttcatgccactctcctgcctcagcctccggagtagcttgggaccgcaggcgcctgccaccacgcccagctaactttttttttttttgtatttttagtagagacggagatgatgtttcactgtgttagtcaagatggtcttgatctcctgacctcgtgatccgcctgcctccgcctcccaaagtgctgggattacaggtgtgagccactgcgcctggcgggaagtagggtcttaatccacatcctctggctccaaaaccaatgctgatttaataattaaatctgttactaggtaacaagtctgccaagtatttacactttaaccttttggggttaatgtctacaagggcaaccaagctctctcatatatcaccaaagatatcaaagatatcatggagtgctgggctgaaagaatcactgatagagtcaagtaagagatctcaagttctaggccccaaacctttcccaagtgacagtctgttcacctagatgactagaggaaagacatgagctcggtacagatattgaaagcagaagtcaagaaaattcaaggctgccaaactcctcagttactgagactgaaacacaaaggaaaaga

SEQ ID NO: 37206 - DNA, 299 bp, Homo sapiens
tgagacggagtctcacgctgtcacccaggctggagtgcagtggcacgatcttggctcactacaacctccgcctcccgggttcaagtgattctcctgcctcagcctcccgagtagccgggactacaggcacgcgccaccacgccccacctctgattgcttttttttttttttaatatggaatacttcatgaattgattattcttttaaaagagttctccaatcaccaactgtatactctttcttcctcttccctatctttatttctcttctttgctcatattattatctgaaattgcatt

SEQ ID NO: 37207 - DNA, 2323 bp, Homo sapiens
  misc_feature (279)..(279): n is a, c, g, or t
  misc_feature (289)..(289): n is a, c, g, or t
tccgccgagcccgggcggcggcggcggcacatctaacgcgcgggcacccgggccgccgcggcccccgcaaataagcccagcctcggcccccgccgctcattggcgcgggccgcagccagcgcacccagaccctgcgctgccctcggacggccgggcgcggaccccagctgcggaggccgacggcacccggccccgagcgcctcgacgccgagccgcgcgcgccttctccgccaggcccggcgggcgggagcgggggcgagggagcaggagcggccagtncccccgacanccccggcccggcacccccggcccggcatcccccgccgccgccgccgccgcctcaaggccgcccgctccccgcaggtggacgcggccatgggccgaggggtgcgcgtgctgctgctgctgagcctgctgcactgcgccgggggaagcgagggcaggaagacctggcggcgccggggtcagcagccgcctcctcccccgcggaccgaggcggcgccggcggccggacagcccgtggagagcttcccgctggacttcacggccgtggagggtaacatggacagcttcatggcgcaagtcaagagcctggcgcagtccctgtacccctgctccgcgcagcagctcaacgaggacctgcgcctgcacctcctactcaacacctcggtgacctgcaacgacggcagccccgccggctactacctgaaggagtccaggggcagccggcggtggctcctcttcctggaaggcggctggtactgcttcaaccgcgagaactgcgactccagatacgacaccatgcggcgcctcatgagctcccgggactggccgcgcactcgcacaggcacagggatcctgtcctcacagccggaggagaacccctactggtggaacgcaaacatggtcttcatcccctactgctccagtgatgtttggagcggggcttcatccaagtctgagaagaacgagtacgccttcatgggcgccctcatcatccaggaggtggtgcgggagcttctgggcagagggctgagcggggccaaggtgctgctgctggccgggagcagcgcggggggcaccggggtgctcctgaatgtggaccgtgtggctgagcagctggagaagctgggctacccagccatccaggtgcgaggcctggctgactccggctggttcctggacaacaagcagtatcgccacacagactgcgtcgacacgatcacgtgcgcgcccacggaggccatccgccgtggcatcaggtactggaacggggtggtcccggagcgctgccgacgccagttccaggagggcgaggagtggaactgcttctttggctacaaggtctacccgaccctgcgctgccctgtgttcgtggtgcagtggctgtttgacgaggcacagctgacggtggacaacgtgcacctgacggggcagccggtgcaggagggcctgcggctgtacatccagaacctcggccgcgagctgcgccacacactcaaggacgtgccggccagctttgcccccgcctgcctctcccatgagatcatcatccggagccactggacggatgtccaggtgaaggggacgtcgctgccccgagcactgcactgctgggacaggagcctccatgacagccacaaggccagcaagacccccctcaagggctgccccgtccacctggtggacagctgcccctggccccactgcaacccctcatgccccaccgtccgagaccagttcacggggcaagagatgaacgtggcccagttcctcatgcacatgggcttcgacatgcagacggtggcccagccgcagggactggagcccagtgagctgctggggatgctgagcaacggaagctaggcagactgtctggaggaggagccggcactgaggggcccagacacccgctgccccagtgccacctcaccccccaccagcaggccctcccgtctcttcgggacagggccccagccgtcccccctgtctgggtctgcccactgccctcctgccccggctttccctgcccctctcccacagcccagccagagacaagggacctgctgtcatccccatctgtggcctgggggtccttcctgacaacgagggggtagccagaagagaagcactggattcctcagtccaccagctcagacagcacccaccggccccacccatcaagcccttttatattattttataaagtgacttttttattactttaattttttaaaaaaaggaaaataagaatatatgatgaatgatattgttttgtaactttttaaaaatgattttaaagagacaaaaaagaacctcaccc

SEQ ID NO: 37208 - DNA, 2184 bp, Homo sapiens
tccgccgagcccgggcggcggcggcggcacatctaacgcgcgggcacccgggccgccgcggcccccgcaaataagcccagcctcggcccccgccgctcattggcgcgggccgcagccagcgcacccagaccctgcgctgccctcggacggccgggcgcggaccccagctgcggaggccgacggcacccggccccgagcgcctcaaggccgcccgctccccgcaggtggacgcggccatgggccgaggggtgcgcgtgctgctgctgctgagcctgctgcactgcgccgggggaagcgagggcaggaagacctggcggcgccggggtcagcagccgcctcctcccccgcggaccgaggcggcgccggcggccggacagcccgtggagagcttcccgctggacttcacggccgtggagggtaacatggacagcttcatggcgcaagtcaagagcctggcgcagtccctgtacccctgctccgcgcagcagctcaacgaggacctgcgcctgcacctcctactcaacacctcggtgacctgcaacgacggcagccccgccggctactacctgaaggagtccaggggcagccggcggtggctcctcttcctggaaggcggctggtactgcttcaaccgcgagaactgcgactccagatacgacaccatgcggcgcctcatgagctcccgggactggccgcgcactcgcacaggcacagggatcctgtcctcacagccggaggagaacccctactggtggaacgcaaacatggtcttcatcccctactgctccagtgatgtttggagcggggcttcatccaagtctgagaagaacgagtacgccttcatgggcgccctcatcatccaggaggtggtgcgggagcttctgggcagagggctgagcggggccaaggtgctgctgctggccgggagcagcgcggggggcaccggggtgctcctgaatgtggaccgtgtggctgagcagctggagaagctgggctacccagccatccaggtgcgaggcctggctgactccggctggttcctggacaacaagcagtatcgccacacagactgcgtcgacacgatcacgtgcgcgcccacggaggccatccgccgtggcatcaggtactggaacggggtggtcccggagcgctgccgacgccagttccaggagggcgaggagtggaactgcttctttggctacaaggtctacccgaccctgcgctgccctgtgttcgtggtgcagtggctgtttgacgaggcacagctgacggtggacaacgtgcacctgacggggcagccggtgcaggagggcctgcggctgtacatccagaacctcggccgcgagctgcgccacacactcaaggacgtgccggccagctttgcccccgcctgcctctcccatgagatcatcatccggagccactggacggatgtccaggtgaaggggacgtcgctgccccgagcactgcactgctgggacaggagcctccatgacagccacaaggccagcaagacccccctcaagggctgccccgtccacctggtggacagctgcccctggccccactgcaacccctcatgccccaccgtccgagaccagttcacggggcaagagatgaacgtggcccagttcctcatgcacatgggcttcgacatgcagacggtggcccagccgcagggactggagcccagtgagctgctggggatgctgagcaacggaagctaggcagactgtctggaggaggagccggcactgaggggcccagacacccgctgccccagtgccacctcaccccccaccagcaggccctcccgtctcttcgggacagggccccagccgtcccccctgtctgggtctgcccactgccctcctgccccggctttccctgcccctctcccacagcccagccagagacaagggacctgctgtcatccccatctgtggcctgggggtccttcctgacaacgagggggtagccagaagagaagcactggattcctcagtccaccagctcagacagcacccaccggccccacccatcaagcccttttatattattttataaagtgacttttttattactttaattttttaaaaaaaggaaaataagaatatatgatgaatgatattgttttgtaactttttaaaaatgattttaaagagacaaaaaagaacctcaccc

SEQ ID NO: 37209 - DNA, 2257 bp, Homo sapiens
  misc_feature (206)..(206): n is a, c, g, or t
  misc_feature (208)..(209): n is a, c, g, or t
tccgccgagcccgggcggcggcggcggcacatctaacgcgcgggcacccgggccgccgcggcccccgcaaataagcccagcctcggcccccgccgctcattggcgcgggccgcagccagcgcacccagaccctgcgctgccctcggacggccgggcgcggaccccagctgcggaggccgacggcacccggccccgagcgcctcgangnngagccgggcgcgccttctccgccaggcccggcgggcgggagcgggggcgagggagcaggagcgcctcaaggccgcccgctccccgcaggtggacgcggccatgggccgaggggtgcgcgtgctgctgctgctgagcctgctgcactgcgccgggggaagcgagggcaggaagacctggcggcgccggggtcagcagccgcctcctcccccgcggaccgaggcggcgccggcggccggacagcccgtggagagcttcccgctggacttcacggccgtggagggtaacatggacagcttcatggcgcaagtcaagagcctggcgcagtccctgtacccctgctccgcgcagcagctcaacgaggacctgcgcctgcacctcctactcaacacctcggtgacctgcaacgacggcagccccgccggctactacctgaaggagtccaggggcagccggcggtggctcctcttcctggaaggcggctggtactgcttcaaccgcgagaactgcgactccagatacgacaccatgcggcgcctcatgagctcccgggactggccgcgcactcgcacaggcacagggatcctgtcctcacagccggaggagaacccctactggtggaacgcaaacatggtcttcatcccctactgctccagtgatgtttggagcggggcttcatccaagtctgagaagaacgagtacgccttcatgggcgccctcatcatccaggaggtggtgcgggagcttctgggcagagggctgagcggggccaaggtgctgctgctggccgggagcagcgcggggggcaccggggtgctcctgaatgtggaccgtgtggctgagcagctggagaagctgggctacccagccatccaggtgcgaggcctggctgactccggctggttcctggacaacaagcagtatcgccacacagactgcgtcgacacgatcacgtgcgcgcccacggaggccatccgccgtggcatcaggtactggaacggggtggtcccggagcgctgccgacgccagttccaggagggcgaggagtggaactgcttctttggctacaaggtctacccgaccctgcgctgccctgtgttcgtggtgcagtggctgtttgacgaggcacagctgacggtggacaacgtgcacctgacggggcagccggtgcaggagggcctgcggctgtacatccagaacctcggccgcgagctgcgccacacactcaaggacgtgccggccagctttgcccccgcctgcctctcccatgagatcatcatccggagccactggacggatgtccaggtgaaggggacgtcgctgccccgagcactgcactgctgggacaggagcctccatgacagccacaaggccagcaagacccccctcaagggctgccccgtccacctggtggacagctgcccctggccccactgcaacccctcatgccccaccgtccgagaccagttcacggggcaagagatgaacgtggcccagttcctcatgcacatgggcttcgacatgcagacggtggcccagccgcagggactggagcccagtgagctgctggggatgctgagcaacggaagctaggcagactgtctggaggaggagccggcactgaggggcccagacacccgctgccccagtgccacctcaccccccaccagcaggccctcccgtctcttcgggacagggccccagccgtcccccctgtctgggtctgcccactgccctcctgccccggctttccctgcccctctcccacagcccagccagagacaagggacctgctgtcatccccatctgtggcctgggggtccttcctgacaacgagggggtagccagaagagaagcactggattcctcagtccaccagctcagacagcacccaccggccccacccatcaagcccttttatattattttataaagtgacttttttattactttaattttttaaaaaaaggaaaataagaatatatgatgaatgatattgttttgtaactttttaaaaatgattttaaagagacaaaaaagaacctcaccc

SEQ ID NO: 37210 - DNA, 1640 bp, Homo sapiens
aagtctaggcgcatgtctcgtattgaattggaaggagtgcggctggccactattcctggaaggcggtggtactggttcaagcgcgagaacgtgcgactccagatacgaggaccatgcggcgcctcatgaggctcccgtgtgactggccgtcgttttacacggcacttggatcctgtcttagagctgagtagaacccctactggtggaccacatcgatgtgtcgttctatacccctactgctcctagtgatgttttgtagcgggtttcatcgaagtctgagaagaacgagtacgccttcatgggcgccctcatcatccaggaggtggtgcgggagcttctgggcagagggctgagcggggccaaggtgctgctgctggccgggagcagcgcggggggcaccggggtgctcctgaatgtggaccgtgtggctgagcagctggagaagctgggctacccagccatccaggtgcgaggcctggctgactccggctggttcctggacaacaagcagtatcgccacacagactgcgtcgacacgatcacgtgcgcgcccacggaggccatccgccgtggcatcaggtactggaacggggtggtcccggagcgctgccgacgccagttccaggagggcgaggagtggaactgcttctttggctacaaggtctacccgaccctgcgctgccctgtgttcgtggtgcagtggctgtttgacgaggcacagctgacggtggacaacgtgcacctgacggggcagccggtgcaggagggcctgcggctgtacatccagaacctcggccgcgagctgcgccacacactcaaggacgtgccggccagctttgcccccgcctgcctctcccatgagatcatcatccggagccactggacggatgtccaggtgaaggggacgtcgctgccccgagcactgcactgctgggacaggagcctccatgacagccacaaggccagcaagacccccctcaagggctgccccgtccacctggtggacagctgcccctggccccactgcaacccctcatgccccaccgtccgagaccagttcacggggcaagagatgaacgtggcccagttcctcatgcacatgggcttcgacatgcagacggtggcccagccgcagggactggagcccagtgagctgctggggatgctgagcaacggaagctaggcagactgtctggaggaggagccggcactgaggggcccagacacccgctgccccagtgccacctcaccccccaccagcaggccctcccgtctcttcgggacagggccccagccgtcccccctgtctgggtctgcccactgccctcctgccccggctttccctgcccctctcccacagcccagccagagacaagggacctgctgtcatccccatctgtggcctgggggtccttcctgacaacgagggggtagccagaagagaagcactggattcctcagtccaccagctcagacagcacccaccggccccacccatcaagcccttttatattattttataaagtgacttttttattactttaattttttaaaaaaaggaaaataagaatatatgatgaatgatattgttttgtaactttttaaaaatgattttaaagagacaaaaaagaacctcaccc

SEQ ID NO: 37211 - DNA, 834 bp, Homo sapiens
gtgcctgtaatccagctactccggaggctgaggcaggagaatcgcttgaacctgggagacagaggttatgccactggacggatgtccaggtgaaggggacgtcgctgccccgagcactgcactgctgggacaggagcctccatgacagccacaaggccagcaagacccccctcaagggctgccccgtccacctggtggacagctgcccctggccccactgcaacccctcatgccccaccgtccgagaccagttcacggggcaagagatgaacgtggcccagttcctcatgcacatgggcttcgacatgcagacggtggcccagccgcagggactggagcccagtgagctgctggggatgctgagcaacggaagctaggcagactgtctggaggaggagccggcactgaggggcccagacacccgctgccccagtgccacctcaccccccaccagcaggccctcccgtctcttcgggacagggccccagccgtcccccctgtctgggtctgcccactgccctcctgccccggctttccctgcccctctcccacagcccagccagagacaagggacctgctgtcatccccatctgtggcctgggggtccttcctgacaacgagggggtagccagaagagaagcactggattcctcagtccaccagctcagacagcacccaccggccccacccatcaagcccttttatattattttataaagtgacttttttattactttaattttttaaaaaaaggaaaataagaatatatgatgaatgatattgttttgtaactttttaaaaatgattttaaagagacaaaaaagaacctcaccc

SEQ ID NO: 37212 - DNA, 2090 bp, Homo sapiens
  misc_feature (279)..(279): n is a, c, g, or t
  misc_feature (289)..(289): n is a, c, g, or t
tccgccgagcccgggcggcggcggcggcacatctaacgcgcgggcacccgggccgccgcggcccccgcaaataagcccagcctcggcccccgccgctcattggcgcgggccgcagccagcgcacccagaccctgcgctgccctcggacggccgggcgcggaccccagctgcggaggccgacggcacccggccccgagcgcctcgacgccgagccgcgcgcgccttctccgccaggcccggcgggcgggagcgggggcgagggagcaggagcggccagtncccccgacanccccggcccggcacccccggcccggcatcccccgccgccgccgccgccgcctcaaggccgcccgctccccgcaggtggacgcggccatgggccgaggggtgcgcgtgctgctgctgctgagcctgctgcactgcgccgggggaagcgagggcaggaagacctggcggcgccggggtcagcagccgcctcctcccccgcggaccgaggcggcgccggcggccggacagcccgtggagagcttcccgctggacttcacggccgtggagggtaacatggacagcttcatggcgcaagtcaagagcctggcgcagtccctgtacccctgctccgcgcagcagctcaacgaggacctgcgcctgcacctcctactcaacacctcggtgacctgcaacgacggcagccccgccggctactacctgaaggagtccaggggcagccggcggtggctcctcttcctggaaggcggctggtactgcttcaaccgcgagaactgcgactccagatacgacaccatgcggcgcctcatgagctcccgggactggccgcgcactcgcacaggcacagggatcctgtcctcacagccggaggagaacccctactggtggaacgcaaacatggtcttcatcccctactgctccagtgatgtttggagcggggcttcatccaagtctgagaagaacgagtacgccttcatgggcgccctcatcatccaggaggtggtgcgggagcttctgggcagagggctgagcggggccaaggtgctgctgctggccgggagcagcgcggggggcaccggggtgctcctgaatgtggaccgtgtggctgagcagctggagaagctgggctacccagccatccaggtgcgaggcctggctgactccggctggttcctggacaacaagcagtatcgccacacagactgcgtcgacacgatcacgtgcgcgcccacggaggccatccgccgtggcatcaggtactggaacggggtggtcccggagcgctgccgacgccagttccaggagggcgaggagtggaactgcttctttggctacaaggtctacccgaccctgcgctgccctgtgttcgtggtgcagtggctgtttgacgaggcacagctgacggtggacaacgtgcacctgacggggcagccggtgcaggagggcctgcggctgtacatccagaacctcggccgcgagctgcgccacacactcaaggacgtgccggccagctttgcccccgcctgcctctcccatgagatcatcatccggagccactggacggatgtccaggtgaaggggacgtcgctgccccgagcactgcactgctgggacaggagcctccatgacagccacaaggccagcaagacccccctcaagggctgccccgtccacctggtggacagctgcccctggccccactgcaacccctcatgccccaccgtccgagaccagttcacggggcaagagatgaacgtggcccagttcctcatgcacatgggcttcgacatgcagacggtggcccagccgcagggactggagcccagtgagctgctggggatgctgagcaacggaagctaggcagactgtctggaggaggagccggcactgaggggcccagacaaccaatgcgagcagcggtaccttaagacacaccgacagccccggtcatcagggcgccacaggctcggagtcgtcaggacaccctcagttataccaccaccgctgcgcaacacttctttggacccctcgcgctgacgagcagccaggacgaagcgaccctcctcctcacgaaagcccgagga

SEQ ID NO: 37213 - DNA, 1585 bp, Homo sapiens
  misc_feature (279)..(279): n is a, c, g, or t
  misc_feature (289)..(289): n is a, c, g, or t
tccgccgagcccgggcggcggcggcggcacatctaacgcgcgggcacccgggccgccgcggcccccgcaaataagcccagcctcggcccccgccgctcattggcgcgggccgcagccagcgcacccagaccctgcgctgccctcggacggccgggcgcggaccccagctgcggaggccgacggcacccggccccgagcgcctcgacgccgagccgcgcgcgccttctccgccaggcccggcgggcgggagcgggggcgagggagcaggagcggccagtncccccgacanccccggcccggcacccccggcccggcatcccccgccgccgccgccgccgcctcaaggccgcccgctccccgcaggtggacgcggccatgggccgaggggtgcgcgtgctgctgctgctgagcctgctgcactgcgccgggggaagcgagggcaggaagacctggcggcgccggggtcagcagccgcctcctcccccgcggaccgaggcggcgccggcggccggacagcccgtggagagcttcccgctggacttcacggccgtggagggtaacatggacagcttcatggcgcaagtcaagagcctggcgcagtccctgtacccctgctccgcgcagcagctcaacgaggacctgcgcctgcacctcctactcaacacctcggtgacctgcaacgacggcagccccgccggctactacctgaaggagtccaggggcagccggcggtggctcctcttcctggaaggcggctggtactgcttcaaccgcgagaactgcgactccagatacgacaccatgcggcgcctcatgagctcccgggactggccgcgcactcgcacaggcacagggatcctgtcctcacagccggaggagaacccctactggtggaacgcaaacatggtcttcatcccctactgctccagtgatgtttggagcggggcttcatccaagtctgagaagaacgagtacgccttcatgggcgccctcatcatccaggaggtggtgcgggagcttctgggcagagggctgagcggggccaaggtgctgctgctggccgggagcagcgcggggggcaccggggtgctcctgaatgtggaccgtgtggctgagcagctggagaagctgggctacccagccatccaggtgcgaggcctggctgactccggctggttcctggacaacaagcagtatcgccacacagactgcgtcgacacgatcacgtgcgcgcccacggaggccatccgccgtggcatcaggtactggaacggggtggtcccggagcgctgccgacgccagttccaggagggcgaggagtggaactgcttctttggctacaaggtctacccgaccctgcgctgccctgtgttcgtggtgcagtggctgtttgacgaggcacagctgacggtggacaacgtgcacctgacggggcagccggtgcaggagggcctgcggctgtacatccagaacctcggccgcgagctgcgccacacactcaaggacgtgccggccagctttgcccccgcctgcctctcccatgagatcatcatccggaggtcagtgtccctgctccgggcagctt

SEQ ID NO: 37214 - DNA, 1161 bp, Homo sapiens
  misc_feature (279)..(279): n is a, c, g, or t
  misc_feature (289)..(289): n is a, c, g, or t
tccgccgagcccgggcggcggcggcggcacatctaacgcgcgggcacccgggccgccgcggcccccgcaaataagcccagcctcggcccccgccgctcattggcgcgggccgcagccagcgcacccagaccctgcgctgccctcggacggccgggcgcggaccccagctgcggaggccgacggcacccggccccgagcgcctcgacgccgagccgcgcgcgccttctccgccaggcccggcgggcgggagcgggggcgagggagcaggagcggccagtncccccgacanccccggcccggcacccccggcccggcatcccccgccgccgccgccgccgcctcaaggccgcccgctccccgcaggtggacgcggccatgggccgaggggtgcgcgtgctgctgctgctgagcctgctgcactgcgccgggggaagcgagggcaggaagacctggcggcgccggggtcagcagccgcctcctcccccgcggaccgaggcggcgccggcggccggacagcccgtggagagcttcccgctggacttcacggccgtggagggtaacatggacagcttcatggcgcaagtcaagagcctggcgcagtccctgtacccctgctccgcgcagcagctcaacgaggacctgcgcctgcacctcctactcaacacctcggtgacctgcaacgacggcagccccgccggctactacctgaaggagtccaggggcagccggcggtggctcctcttcctggaaggcggctggtactgcttcaaccgcgagaactgcgactccagatacgacaccatgcggcgcctcatgagctcccgggactggccgcgcactcgcacaggcacagggatcctgtcctcacagccggaggagaacccctactggtggaacgcaaacatggtcttcatcccctactgctccagtgatgtttggagcggggcttcatccaagtctgagaagacactggattcctcagtccaccagctcagacagcacccaccggccccacccatcaagcccttttatattattttataaagtgacttttttattactttaattttttaaaaaaaggaaaataagaatatatgatgaatgatattgttttgtaactttttaaaaatgattttaaagagacaaaaaagaacctcaccc

SEQ ID NO: 37215 - DNA, 397 bp, Homo sapiens
gtctcaaaaaaaaaaaaaaaaaaaaaagagggaaatgaatatacacctgctctgaaatgaaatggttggggccaaattgtgtgtgtgtgtgtgtgtgtgtgtgtgcgcacacgcaattgtctcaaaagcctcttgagtctttcccttatatctctgacaatcccactgctccaaagtacactgtgggttttcctcaacttggagctagatacctggaattctagaaaacaattccctcagtagacaattgctcccttatatgagcacaagcagcggagtgactacatggatcaagctgtatttcaccattttttttttttgctctgttgctttatgtaccacaccagccccacacaactcttcaccaaagagttgtggaattattgcataagagaaa

SEQ ID NO: 37216 - DNA, 757 bp, Homo sapiens
atttttctttttcatttacaacttggctaacaggaggcctagcttttggcctgtctcagcttttgacatatcttcaagtgaaagatgtgtgactcttcccatcacttgaatacttagaagccatgatagggttattaattggctggaattcaatactggtgtgtcttaggcaatagagagaactaagatggctggtcagtggagcaatcagaacacacacatttattgattaagatctggtatttgatagcccaacagggtgactgtagtcaaaaataatttaactgtatatttaaaaataactaagtaagcatattgtttgcaacacaaaggataaatgcatgaggtgatagatactccatttatcctgatgtgattattacacattgtatgcctgtttcaaagtatctcatgtgccctataaatgtatacacttactatgtacccacaaaaattaaaaattaaaaacaaaaacaaaatcccaaacctttattgatgaagttcgccatcttatgtaagtacagtttgtggtgctgcaaaacaattacaatagtaacatcaaagctcattggtcattgatcaccataacagatagataaattaataatgaaaaactttgaaatattgtgagaattatgaaaatataagagaaaagcacaaagtgaattcctgctgttgaaaaaatggtgccagtagacttgctaatgtagggttgccacaaatcttcaatttgtaaagaatgcagtatttatgaggc

SEQ ID NO: 37217 - DNA, 544 bp, Homo sapiens
gcttatcacctttgccgtagaatgtaacccagtcttaggagtgacatcccctcacatttgccatattctgttggttagaagcaagtcacaggtcccatgtgtactcataaggagggaattacatgaaggcatgaccaggaggcaggagactactggagttcaagtaggggtctgttcaccactgatgggatgggaagaatccacttaccaactgccacacttgcccttacccactgctaagcacttacttactgagtacttgtgagtactaagtaatgtaccctggtatttatccccgtttttcctaatttaacggtagttatcactggaaaatgggaagaaggtgcagtgctgaagagcactagaactttctgctctgcatatggtattgtttgggatctttgcagtaagcatgtattcatgtgttatgtaatttaaaaatgcaattgaaaatgaaaatcatatattcagtatggcttcaactaaaagctgctctccctccacttccagaccttcctacatacatacacattcacaattggaa

SEQ ID NO: 37218 - DNA, 514 bp, Homo sapiens
gtttccctcttcattccctactgtggcctgactctctcgtaggaagcaccttgcttcatgcgcatgttagcattgtttcggaagaccagaactgctctcccatgaagtgcagtagtagggcctttttgtacttgggtccctcacgtatgaaactggaatcttcctggttggggttgtcttctgctctacctggcgtgccaggtaaatggagaactcacattcattgcaacatcatttcttgggaaagatttgtcagccttaagctgtctcctcctaccttcaaagtgggaaatgctcaaaggtatttatgctgcactctggccatcttctttctttgtgagagggaacattattgatcttagcctccaggactctagataattttgaaaaccaagaatatctgcgatccatttagggagaaacaagtatgatttgcttcctccaaggcagcattcttcaccaacttcatttgagacacaaatggtgtgttttgtttgttcatttgccctttaaa

SEQ ID NO: 37219 - DNA, 367 bp, Homo sapiens
tgacagcaggcaatattttaacatgtcaaaagtacaatgaccattaaacatacacacgcatcattttatttttatttattcttaaaaaaaattatttttatttaagacagagtctttgtcacccaggctggagtgcagtggcacaatgatggctcactgcagccttgacctcctgggctcaagcaatccttctacctcagcctcctgtctagctggaaccagaggcatgtaccaacatgcccggttaattttttactttttgtagagacagggtctccttatgttgccttcgttggtcttgagcccagaagttcaagaccagcctgggcaacatgacaagaccccatctctacaagaagtttaaaaa

SEQ ID NO: 37220 - DNA, 469 bp, Homo sapiens
ctatcaaacaaacagcagcaaaaaaataagaaaatttctgaggaaaagtacaaaaaaaaaaaaaaagacagaaagtagacagtcaagggcacaggagctcttcagaccgcccactgcatttgaaaaataccttagcaagtagcaacatgaaacatgcaatgtctctgctaacttgctcctgattcagcagcctgtttagcaatacctacaacatttccataaccaaaggatggatgcaattttgttttccgacttgccaatttgacatatgcaaaagctataggactttacaatttctgcctgaatctgtaaacttggaagtgtctcacgtgtcccccctagttagacaaaaccaaatccttcatatgcataatacattttctagaataatacagtgatactgagatatttctcattattaaaaggccacaaaataggtttatctttctatatacatatcaaaaaacaa

SEQ ID NO: 37221 - DNA, 217 bp, Homo sapiens
acatttataaaaattgatttttaaaattacacccaaaaaatctcaattttaagttacacactctgttaacagcactaaaaataattttttagataaaaagataaaaggaaattcatctaattggaagctaaagggaaaaatgccttaaatctgggtcaaggagaaaatcgcaaccgtgattgcagatttataaactatttagaaattaatcacaatg

SEQ ID NO: 37222 - DNA, 361 bp, Homo sapiens
taaagacagagtctcgctctgtcacccaggctggagtacagtggcttgatctcggcttactgcagccttgacctcctggactcaagagatcctcctacctgagcctccaagtagctgggtagctagaactccaggtgcatgccaccccacctagctatttttttttttttttaattttagtagagacagggtctcactatattgcccagtctggtcttgaacttctgggctcatgctatccccctgccttggcctcccaaagtgctgagattacaggagtgaaccaccatgctagacagtattttttttaaatacaagaatattcagcatttggccgggcacggtggctcacgcctataat

SEQ ID NO: 37223 - DNA, 241 bp, Homo sapiens
aatggaaggatcagaaagatctgttttctatggtcttatgcaagtgcacattgtaagcattcaatatgtagatatgaaaatcactgcaataatgcttctaggagccagcactagataaccatcttcagcatcctgggcttatgtaaataatccatttagactgaactgttattttcatttttatttttttatttgtacatatttatgggtgtattagtccattttcatgctgctgataaag

SEQ ID NO: 37224 - DNA, 382 bp, Homo sapiens
acatgaatggcttcctataacctgctaaggatgtgggtattgacttaaggaaagaaaagccactttaagatgtagaataggaaagtggctatgttacatatattagaaaaatcacataagcagtagtacaatggaaatgtgatgaaattaaaagcaggaagatcatttagaaagttcttgtttgcttgtttgtttctctttggatttttgcaatcatacagatgactgctgaataagggacagtgggaatggagattacaaataaaagatggacacgaaggatatttagcatgtagagtatatagaatttgtggttggataaaggtgggatgagggacaaaagagatttaggaaataaaagaagtttgtacaggtttgtttc

SEQ ID NO: 37225 - DNA, 362 bp, Homo sapiens
ttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccaggatggtctcgatctcctgacctcgtgatccgcccgcctcggcctcccaaagtgctgggattacaggcgtgagccaccgcgcccggccaacaaggctttaaaaattaagttaactcatgtgtgctaaatgggataaattttaaatttcagaatatcaaa

SEQ ID NO: 37226 - DNA, 554 bp, Homo sapiens
acttctatttgggatttctgggtttcaacaacttgtataatttaaaaaaaaaaaaaaaccaactgtcacaatatatggattttttttaaacctgaaagatatgcaacaaatttaatgaaagatctctctgtgttggtagaattgtgggtagtttttctattctttttgtgtttatctacacttttcaatattttcaccaataaaatatggtattacagtttcataattccttatctgacacccttatggctggagatgtttcaaaattatggctagagtttttttgggtttttttttttgggtttttttttttttttggctttcagaaaggtaacaatggtgtgtgaagtgggtgacaagtcacacctattcaataaatagatactagaaataacttcagttaaggtcttgttttgttaccaaagaggtctaaaccagattttatcccctaaaggaatggcattatttagtgtaagtaaggcttccaattccgcccctactggtccaactaatttggagcttaatcactgcagactgcactcagttgggaacaa

SEQ ID NO: 37227 - DNA, 387 bp, Homo sapiens
agaaaaattcttcaggaaagagaaaattgagtgaacacattttataataaaatataaccaatatggatttaatattatataacattcaattagaattcagtatttctataaggcaactgataacattatttctagcaatgtaaatttattatatcattcatgacttagagctaatcgtgaaaatgtcattctattaagtcccaaacctcaaagtgttctcttaaagagcagcatatatttccctacttgtacatatatttttagtttaaatgtgcctacatgtacatgtgttgtagtagtctgttttgtgttgctataaaggaataactgagattgggtaatttataaagaaaggagttttatttggtacattgttctgcaggctgt

SEQ ID NO: 37228 - DNA, 480 bp, Homo sapiens
tttttttttgagacagagtcttgctctgtcacccaggctggagtgcagtggcgcgatctcggctccctgcaacctccgcctcctgggttcaagcgattctcctgcctcagcctcctgagtagctgggattacagctatgtacagcgatgtctgcaaagatagggatttaacagcactcatatcttcatgttcataaaaaagtcctacacgcgtgatgtacgtctagatctttccttttgtcacaggatatagcacggtagttacggatatagtctccgcagtgcctgggtttgactcagcttccccacgtactgtcctgcgcatattttgtgtctcagtttcctcatctttaaggtaggaatatcaatggtaactacctcttacggtggtagcaactaaccagctctgccacttctgtgatctctaagcagttttgatcatacacccagcagtaaaaattaagtatctctccagccccaa

SEQ ID NO: 37229 - DNA, 815 bp, Homo sapiens
cttttatgttgtaccaaagacagcaaagaggaggaaggaggagtaggaagaaataagagtaaatgggagaaaaatatatattttgtgagatcctgactcaaaaaaaaacagagaaaattagattttatttttgtattagtgtattattaacattaaagttaatttttaataaagccttgtaaataaatctatttaattttaattagtttgaccacaagatttttatacgtttttaaatagcctcttaaatttaaacatttttaaaattttttatttttgtttttttaattaaaaactttttaaacgtttatactaggcaaaatcttttttttttttttttttttttacaaaaacacatttttatgtgttttataaccttttttactaaaaacacattttccttttggaatatactttgcgtatggaattgtttattttaatatctagtacttttaattatatatattaattatgatagtatctcttagtaactcttacttttagtgaaaaacctaggaaataagtaattgtaactatgtgcagtgcaagacaaagaatagagctgtgaacacaatgcctggaggagttaatccttagtatggccaagagacatggttgggctagggaggacagggcctgggtgttgtccccagaccttttttgtctagacattagaatctaaagtctcaaatttacagacataagctcacagataaattaagtaagcattaaaaatattatagaagtaacagttctgtgaccttacaacatttagtagagacagtataaacctgtctgatcaatccaaccaggcc

SEQ ID NO: 37230 - DNA, 464 bp, Homo sapiens
tattagtaacagtcaaggaagctttgagggcttgtctctggtctccttccaaagcgtgggggcactgaggctgttgaggattgaccgcagcctacttgtaaccatatttctataccatgctccttccacccaatgtagtgattcctcttttgaggcaaccggacccatctgtgtgtctcttttgttaggactgtcagatccccattggcaaggatggtgatagggcctgtcttgagactgcaagcagatccttaactcagtgctggcttgctgagtgcatgcatgcctgcatgaatgaatgaacgccactgggcggtaaacaagctgttctctacagccttcatgctcttcatgggcatttcacctaataccagctctgtctacagcaacgaaagaatgaacaacctaagtaagacaccggagatttctctgtctccttataaaggcacacatcagtgctcccc

SEQ ID NO: 37231 - DNA, 178 bp, Homo sapiens
gatcaagttcccagccagtgacccagcacaaacacacagttcagcctgtgtccctacccaaacacggagcccagcctgtggcctgcccaactacaaagcacagcctgagaccaccaccaattacaaaacctagtcagtggctccatctgaatatggcattcagccagcatcacaccca

SEQ ID NO: 37232 - DNA, 450 bp, Homo sapiens
ttttaacttaaaattaccaacttttactagatagaaaataaaataatcatagattctagcaatagatatcttattatcagtatagttaggtagtagaaaatgaaaataatctgttctgaaataaatttcaaatgaatttatattttaaaaggacttttactcagccaggtgcggtggctcacacctgtaatcccagcactttgggaggccgaggcgggcggatcacctgaggtcaggagttcgagaccagcctgaccaacatggtgaaaccccatctctactaaaaatacaaaaaaaattagccgggcattgtggcatgtgcctgtaatcccagctacttgggagaactgaggcaggggaatcgcttgaacccaggaggcagaggttgcagtgagccgacatcacgccactgtactccagcctgggcgacaagagcgaaactccatctca

SEQ ID NO: 37233 - DNA, 473 bp, Homo sapiens
gatagaggcagaaagcaagcaagcgggtggagcctgttctctttagaatggcatttcctctttgtctggaaaagaatgctattcctcctgagaacttgtgggatttctcctacagtgtggtttcattacattcaaaattgtattaccttccagaataagatagcatgcccacaatcaaataaatccaggcatttaaaaataactcgcatatggcccctaacctgctctccatcttcctacaaaaagctgattgtagtttattataaaacaataatgaaagaaaatagatgaaaaataaaaacctgaatgattttatacaatctatggtctcacatgaaggaaaagtagcaacagaacagaactgactcctggaatagccactgtatcccacaaatctaagactacccttctttcaccttgactgatttttgctaaaatgaactgttacattgcaaataaattaccaaagactt

SEQ ID NO: 37234 - DNA, 148 bp, Homo sapiens
gaaaaatgaggctacttagtttgtttctttttattttaggtttggtaggttgtcttttcaggaatttgtccatttcatataagttatagaatgtattgatagtaatttgttcataatagtcctttattcacctttttatttatatatt

SEQ ID NO: 37235 - DNA, 358 bp, Homo sapiens
tagattctgtcctcagatgtttgaaagacttctaggtagatatgtatataaaccaaatataaaataaaaagtgaacctaactgtcttaaaagaagtaaagactgtctctgagaaaaataaaggagggaaagcttgcttctagctgggaaggatcccaaaagactttatttaaaaagatggttttgaattagctttgaaggatagtaatgaaatctatcactttttgatcagttattatgtgccacattcatcatgctattttctaatccttataataattccaagcagggtgtcatttcccctcctttagggatgaaatatcatccctaaagtgtcaagagagttcaaataacttgtg

SEQ ID NO: 37236 - DNA, 390 bp, Homo sapiens
atttctgcatctaatcatggaggcagctcctgatcaaagagcattgtactggtgaggcactcattctcccacatatgggctgaccccctggtgctgagtgagtgaggggctcttagatcttcggccacagactgaaggctgcactgtcagcttccctacttttgaggtttttggactcagactggcttccttgctgctcagcttgcagacggcctattgtgggacttcaccttgtgatcatgaagtagaagtgattatccacattccatagaagaagaagcggagctcagaatggtctcatctccaggcagctgtccctcttctggatctctggcaactccagttcacagcaccctttctcctcctagcctaggatccagtgcctttagc

SEQ ID NO: 37237 - DNA, 615 bp, Homo sapiens
gtgatggttaatattgagtgtcaacttgattggattgaaggatgcaaagtattgttcctgagtgtgtttgtgagggtgttgccaaaggaggtaacatttgagtcagtgcactgggagaggctaacctaccctcaatctggttgggcaccatctaatcagctgccagtgtggctagaataaaagctggccgaagttggaaaataagataagaacacgtgttgagtctgccggccttcacttttcccctgtgctggatgccttctgcccttgaatatcagactccaagttcttcagcttttggactcttggacttacaccagtgttttgccaggggctcttagatcttcggccacagactgaaggctgcactgtcagcttccctacttttgaggtttttggactcagactggcttccttgctgctcagcttgcagacggcctattgtgggacttcaccttgtgatcatgaagtagaagtgattatccacattccatagaagaagaagcggagctcagaatggtctcatctccaggcagctgtccctcttctggatctctggcaactccagttcacagcaccctttctcctcctagcctaggatccagtgcctttagc

SEQ ID NO: 37238 - DNA, 560 bp, Homo sapiens
aacattttaaaagaattatcttatttacaaatgatcaaagtaaggcatagtgaggtgacagattcctgcccttcattcgtcaaccaaatatgctcaggaacaaaaattagcacctaaaggtattgctgtcttattgtcaggtcaataactcctttcttccattaggtcaagtttcagaagtttctggatataaaaggtaaatggaagtgggtatttgtgggggaaaaattatttttttctctatacccacattcaatgcagaacacttctttggccgtgtgtgtgtgtgtgtgtgtgtgtgtgtgttttccacaccaaccaattatctgccaccagctgggtgtcttgcaatccagttcaattctgacatgatctgcctggagttagtgcagaccccatagtttaagggttcagccccacaaaacttccctcatttaagatgccagttacgggaggctgaggcaggcgaatggtgtgaacccggcaggcagagcttgcagtgagccgagaccgtgccactgcactccagcctgggcaacagagcgagacttagtctccaa

SEQ ID NO: 37239 - DNA, 228 bp, Homo sapiens
ttttttttttttagtagagagggggtttcatcattttggccaggctggtcttgaactattggtctcaagtgatccatctgcctcgggctcccaaagtgctgggattacaggtgtgagccaccatgcccggccatccttcttgaagaagtctttcattacacggctggaggtcaaaggaggaagagaaaaactaatgtcgacgctgctgcgaatttagtagtagtagta

SEQ ID NO: 37240 - DNA, 5703 bp, Homo sapiens
gagctgccaggcgggagcggcgtaggcgcggggtcgccggccagcgtgaaccgggacatggagccgcccggcgggagcctggggcccggccgcgagacccgggacaagaagaagggccggagcccagatgagctgccctcggcgggcggcgacggcggcaaatctaagaaatttctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagacttccaaagccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagta

SEQ ID NO: 37241 - DNA, 233 bp, Homo sapiens
  misc_feature (211)..(211): n is a, c, g, or t
tatttattggtttgatattgcattgcctctctctgttccttacagttgggtgcaaacatttggtgctgaaggcttggcctccttattggacattcttaaacgacttcatgatgagaaagaagagactgctgggtgaggacttccaagtctttgcaacttcaagttggagagtcacaggggacttggctatttgctcacagaatatagtctncagcactggtctttttcaatat

SEQ ID NO: 37242 - DNA, 5643 bp, Homo sapiens
gagctgccaggcgggagcggcgtaggcgcggggtcgccggccagcgtgaaccgggacatggagccgcccggcgggagcctggggcccggccgcgagacccgggacaagaagaagggccggagcccagatgagctgccctcggcgggcggcgacggcggcaaatctaagaaatttctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagacttccaaagccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagta

SEQ ID NO: 37243 - DNA, 5679 bp, Homo sapiens
gagctgccaggcgggagcggcgtaggcgcggggtcgccggccagcgtgaaccgggacatggagccgcccggcgggagcctggggcccggccgcgagacccgggacaagaagaagggccggagcccagatgagctgccctcggcgggcggcgacggcggcaaatctaagaaatttctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctgggggtgtttgcatctcctcacccccttctttacctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagacttccaaagccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagta

SEQ ID NO: 37244 - DNA, 5425 bp, Homo sapiens
actgcgctctgctatatctacatcagctaccctaccctatctacgtcaaataatcaaaacttcttgtgatccgcccgcctcggcctcccaaagtgctaggattacaagcgtgagccactgcgcccagccaacttacagatattttttaaagcagatttcactatctgttctaggtgatcatttttacaaatgatactgcagtgaacatccttgtgcatatcttctttcacatttatgcccatatgttggatacatttctagaagtagactatatgttacatgcatgagaaattgattagtactgttaaatgcccctccaaaagttgtatcaatttatacttcattgaataggggacttgatttggtatttatggacaggagcctagggatggattgtagggaatgcatttccctgaagagatggtccttagctttcagcagtttctggaaactgagtggtgagaataataatgtgagaaatccggaacactgataatgtcctgtttcctaatcggtctgtgcccctgtgtaatttactcattatacgtgtccgtgtcacagtacctggaaagttctctccgtttcctttctcttgggcaggaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctgggggtgtttgcatctcctcacccccttctttacctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagacttccaaagccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagta

SEQ ID NO: 37245 - DNA, 3465 bp, Homo sapiens
  misc_feature (18)..(18): n is a, c, g, or t
  misc_feature (42)..(42): n is a, c, g, or t
gggcttccgggaaatggnggaggtggagggattccaggaccntccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagacttccaaagccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagta

SEQ ID NO: 37246 - DNA, 5763 bp, Homo sapiens
gagctgccaggcgggagcggcgtaggcgcggggtcgccggccagcgtgaaccgggacatggagccgcccggcgggagcctggggcccggccgcgagacccgggacaagaagaagggccggagcccagatgagctgccctcggcgggcggcgacggcggcaaatctaagaaatttctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagacttccaaagccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagtaaaaaaaaatatatctccaccccccctccccacacacccaacaaaccctactaacacacatccatccatccaccccatatctacaacccccctaaatcaccctcactccccccccaccctt

SEQ ID NO: 37247 - DNA, 3224 bp, Homo sapiens
aaagcacagaggtggcttacttttaatcatgcttttctaatcttttcccttccaaagccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagta

SEQ ID NO: 37248 - DNA, 3222 bp, Homo sapiens
gtctgacctccctttatcagtgatcctccttctctgccgagcaagacttccaaagccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacaccaagtccacagatcagaagatgacgttgttacacttcttggctgagttgtgtgagaatgactatcccgatgtcctcaagtttccagacgagcttgcccatgtggagaaagccagccgagtttctgctgaaaacttgcaaaagaacctagatcagatgaagaaacaaatttctgatgtggaacgtgatgttcagaatttcccagctgccacagatgaaaaagacaagtttgttgaaaaaatgaccagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagta

SEQ ID NO: 37249 - DNA, 2411 bp, Homo sapiens
ggtcttggtcttggtcctttactccttggctgcacagctttgtgaaggatgcacaggaacagtataacaagctgcggatgatgcattctaacatggagaccctctataaggagctgggcgagtacttcctctttgaccccaagaagttgtctgttgaagaatttttcatggatcttcacaattttcggaatatgtttttgcaagcagtcaaggagaaccagaagcggcgggagacagaagaaaagatgaggcgagcaaaactagccaaggagaaggcagagaaggagcggctagagaagcagcagaagagagagcaactcatagacatgaatgcagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagta

SEQ ID NO: 37250 - DNA, 2166 bp, Homo sapiens
cttggttggaaaaggaagagggagtggtcagatgaatctgaggaggagccggagaaggagctcgcccctgagcctgaggagacctgggtagagggcgatgagacaggtgtgatggacagtcttctagaagccctgcagtcaggggcagcattccgacggaagagagggccccgtcaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagta

SEQ ID NO: 37251 - DNA, 2068 bp, Homo sapiens
tgcatcaacgcgttgggagctctcatattgtcgacctgcaggcggcgcgaattcactagtgattggagggcaggagaaagccaacaggaaggccgggtgtgcagtcacatctctgctagcttcggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagta

SEQ ID NO: 37252 - DNA, 1973 bp, Homo sapiens
gcgaattcactagtgattgagctgaggaggagctgaccaaggatgatgccatggctgctgttcctgccaaggtgtccaagaacagtgagacattccccacaatccttgaggaagccaaggagttggttggccgtgcaagctaatgtgggtcctgtgaccgcggcagctcctcagcggagccgcagactgtcctgccctgcagcatgtgcctaaaggctcaaggggatattcctctggggtggccactcccaccaccctgaccctgtctttctctctggcctgctgctctctcaacatcacatacagcttcagctgcctggaggccagaaggaaagggcagtgcaggggaggcctgagcccgacttagccagccctggctgttgtattaccaaagcagggtccatgtttgctgccttaaccctgtctcctctctgttactcagagggcctcatctcagacaaggcccagcctgctttttctcagccctgactttctaatgggctttcccccctaggtcagtcttgctggatttgtgcttttcttttgtggtttctctggccctgagaatagcatggggcttgtaaacctttgggctagatccctcctttcattgctgttgtctctgctcttccctctcctggctgtggttatttattattagtggtgtggcactgggagctgctcctaaggaagcagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagta

SEQ ID NO: 37253 - DNA, 1405 bp, Homo sapiens
ccatgcagcataatgttctatgtgcatgtgttttaagttctataagtttccctgtaatctcattctttcctaccttttttgtaaaactcaggccattcaacgcctcccggaggcgttgaatggcctagggagcaaatcccacctttaccccaccttcctgggaaaggcctccaaagcaaaggatctggaccagtttccctgctgtgctgtggcccaggccagagcctgtgggcaggcaggcagggcatagcgacagtgtgggacctgcccccagcttctgccacgctttatgcccttgcctctctggacgctctgcaccaaccccaggctactgagccaccttccctcctcatgccttccctgagctttggtgcatctcatctggactatgggttgtactgtgaccatcccaacacctcaccctctgtctacaaggaaatgggaggtggagcctcctggctgagaaattgttttgcaaatggatctatttttgtatgaaaaaaaaaatttttttaaagaaaactgttccttccccctttcccctccataatgtaagaagctttggtggcaggttacagagttctgggatttcttctcacaggcccaatcctgaatgtgcccctggaccttctggacccttgagtccaaggcagatcctctctcccagggaatccgacacaggaggaaccccttctctggttgagctgggccaggcctaagagtagcaggaactctaagaccacagagttttttataaatgtataaatgtatcaagccaaatgtgcagatgctaactggacattctggggaactgggcaccaggagtgccttcatacactgtaccccagctctcttctaaaagagaagtgggtgggcacactgaactgtttggtggccccaaccacaggaagctgcaattctctggcttagggtgatacttttgccctccttgtgcccctctcagctttccatccccagctaggaagaaagaatggcactcttgggcttggcccagaattagagttattagagcaagagagagcttaggaagcatgagggcaactatagtgaggccttattgccaggagggagggttttggttgctggcgcttgtgtataaaggggcaagagcagctcctttggactattcctgggaggactctgatgcagggcgtctgttgctcccctgggtcacctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagta

SEQ ID NO: 37254 - DNA, 3100 bp, Homo sapiens
  misc_feature (3058)..(3058): n is a, c, g, or t
  misc_feature (3084)..(3084): n is a, c, g, or t
gagctgccaggcgggagcggcgtaggcgcggggtcgccggccagcgtgaaccgggacatggagccgcccggcgggagcctggggcccggccgcgagacccgggacaagaagaagggccggagcccagatgagctgccctcggcgggcggcgacggcggcaaatctaagaaatttctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctgggggtgtttgcatctcctcacccccttctttacctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctccatttcccggaggccctggcattcctccacctccacccggaatgggtatgcctccacctcccccatttggatttggagttcctgcagccccagttctgccatttggattaacccccaaaaagctttataagccagaggtgcagctccggaggccaaactggtccaagcttgtggctgaggacctctcccaggactgcttctggacaaaggtgaaggaggaccgctttgagaacaatgaacttttcgccaaacttacccttaccttctctgcccagaccaagacttccaaagccaagaaggatcaagaaggtggagaagaaaagaaatctgtgcaaaagaaaaaagtaaaagagttaaaggtgttggattcaaagacagcccagaatctctcaatctttttgggttccttccgcatgccctatcaagagattaagaatgtcatcctggaggtgaatgaggctgttctgactgagtctatgatccagaacctcattaagcaaatgccagagccagagcagttaaaaatgctttctgaactgaaggatgaatatgatgacctggctgagtcagagcagtttggcgtggtgatgggcactgtgccccgactgcggcctcgcctcaatgccattctcttcaagctacaattcagcgagcaagtggagaatatcaagccagagattgtgtctgtcactgctgcatgtgaggagttacgtaagagtgagagcttttccaatctcctagagattaccttgcttgttggaaattacatgaatgctggctccagaaatgctggtgcttttggcttcaatatcagcttcctctgtaagcttcgagacnccagtcccagagcagaaggtcgaccnggatcctctagagcga

SEQ ID NO: 37255 - DNA, 2428 bp, Homo sapiens
gagctgccaggcgggagcggcgtaggcgcggggtcgccggccagcgtgaaccgggacatggagccgcccggcgggagcctggggcccggccgcgagacccgggacaagaagaagggccggagcccagatgagctgccctcggcgggcggcgacggcggcaaatctaagaaatttctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggatgactttaatgaagtctttcagattctcttaaacacagtgaaggattcaaaggcagagccacacttcctttccatcctgcagcacttactcttggtccgaaatgactatgaggccagacctcagtactataagttgattgaagaatgtatttcccagatagttctgcacaagaacggggctgatcctgacttcaagtgccggcacctccagattgagattgagggattaattgatcaaatgattgataagacaaaggtggagaaatctgaagccaaagctgcagagctggaaaagaagttggactcagagttaacagcccgacatgagctacaggtggaaatgaaaaagatggaaagtgactttgagcagaagcttcaagatcttcagggagaaaaagatgcactgcattctgaaaagcagcaaattgccacagagaaacaggacctggaagcagaggtgtcccagctcacaggagaggttgccaagctgacaaaggaactggaagatgccaagaaagaaatggcttccctctctgcggcagctattactgtacctccttctgttcctagtcgtgctcctgttccccctgcccctcctttacctggtgactctggcactattattccaccaccacctgctcctggggatagtaccactcctcctcctcctcctcctcctcctcctcctccacctcctttgcctgggggtgtttgcatctcctcacccccttctttacctggaggtactgctatctctccaccccctcctttgtctggggatgctaccatccctccaccccctcctttgcctgagggtgttggcatcccttcaccctcttctttgcctggaggtactgccatccccccacctcctcctttgcctgggagtgctagaatccccccaccaccacctcctttgcctgggagtgctggaattccccccccacctcctcccttgcctggagaagcaggaatgccacctcctcctccccctcttcctggtggtcctggaatccctccacctcctcctccctgctcgctgacatctggggctttgaccctttcttttttaatctacttttgctaagatgcatttaataaaaaaaaagagagagagagagaggtgtgagggacaaaatgcaaacctatttcccttgcctcataggcttctgggatgtcatcacctccagtttgttggttttgtttccaactgttaataaagcattgaaacagta

SEQ ID NO: 37256 - DNA, 1429 bp, Homo sapiens
gagctgccaggcgggagcggcgtaggcgcggggtcgccggccagcgtgaaccgggacatggagccgcccggcgggagcctggggcccggccgcgagacccgggacaagaagaagggccggagcccagatgagctgccctcggcgggcggcgacggcggcaaatctaagaaatttctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgaatgaaagggttttggaggcaatgacagaaagagctgagatggatgaagtggaacgtttccagccgctgctggatggattaaaaagtggaaccactattgcactgaaggttggatgcctacagctgatcaatgctctcatcacaccagcggaggaacttgacttccgagttcacatcagaagtgaactgatgcgtttggggctacatcaggtgttgcaggaccttcgagagattgaaaatgaagatatgagagtgcaactaaatgtgtttgatgaacaaggggaagaggattcctatgacctgaagggacggctggatgacattcgcatggagatggaatatccttttgctgactaggttcaaggcagatgagacattcattgtatttagttccctgatccctgtgtggaatggtttgggagatgatgactcagaacagagcatcaggcttatgtgtcttctcattaaataaggcaggtgtatttttattgcgctggctttacttagcttatcatagatcagggaagtcagtaaaggtgatctgagggttgttgagcatggaagccatcaaaat

SEQ ID NO: 37257 - DNA, 1410 bp, Homo sapiens
gagctgccaggcgggagcggcgtaggcgcggggtcgccggccagcgtgaaccgggacatggagccgcccggcgggagcctggggcccggccgcgagacccgggacaagaagaagggccggagcccagatgagctgccctcggcgggcggcgacggcggcaaatctaagaaatttctggagagatttaccagcatgagaattaagaaggagaaggaaaagcccaattctgctcatagaaattcttctgcatcatatggggatgatcccacagcacagtcattgcaagatgtttcagatgaacaagtgctggttctctttgaacagatgctgctggatatgaacctgaatgaggagaaacagcaacctttgagggagaaggacatcatcatcaagagggagatggtgtcccaatacttgtacacctccaaggctggcatgagccagaaggagagctctaagtctgccatgatgtatattcaggagttgaggtcaggcttgcgggatatgcctctgctcagctgcctggagtcccttcgtgtgtctctcaacaacaaccctgtcagttgggtgcaaacatttggtgctgaaggcttggcctccttattggacattcttaaacgacttcatgatgagaaagaagagactgctgggagttacgatagccggaacaagcatgagatcattcgctgcttgaaagcttttatgaacaacaagtttggaatcaagaccatgttggagacagaagaaggaatcctactgctggtcagagccatggatcctgctgttcccaacatgatgattgatgcagctaagctgctttctgctctttgtattctaccgcagccagaggacatgtatgtgactggaataatttttcttctccattttcaattttatcattttctcttagttcagaggacaattgagttggttgggtgtcctctcggtcataaatactaggtaagattgtgtttcttcccagaagtgaacactaagcatcttaaaatttaagaacaattcctaagtgatgggtgctatcctgaatgttccactggtcatcagaggtatagcaaaatgtctcctatatctccattaatatctgtattgtctaggatgagggtttctttttactattcttttttctaaacttctcttctcacttcatttcattaatttgatcttcaatcactgataccctttcttccactagatcgaatcggctactgaagcatgtgtatgtgtcatgtagttctcgcgccatggttttcagctccatcaggtcatttaaggtcttctctacactgtttattctagttaccatttgtctaatctcttttcaagtttttagcttcctgcgatgggttcgacatcctcctttagcttggagatagtcatgttagtacccacttc

SEQ ID NO: 37258 - DNA, 344 bp, Homo sapiens
ccaatacttgtacacctccaaggctgtgagtcctgggacaggtacccatgacatgggagactgtgcccttgtcttggacctgttttttttttgccaattttatgtaacattttatgtctgcatcaattctgtttcattccattatataagcctgttcactttttactgtcttatttagttaccgttcttacatacattttgcctggttaaattttcatgaagtatgtaaatatagggaatgggataggcagttctaagtctcatttatgttggtggtatgtgagatgggtatctgccctgataaacgtggcctgacatggtggcttactcctgtaatctgagca

SEQ ID NO: 37259 - DNA, 423 bp, Homo sapiens
ctccagcattgctgacttatgaatgctggctttgagaaactgccttttctctggtggtcagattacttctggtatattttgcaaaagtacccccatctcagtagctgcctctcttctcccaccatatgtttctttctgtatggtccttgagcagagtgtgggactgacaacagagtaaaagttgtttaggcttgagttgttagcgaattcccctccagctgagatgtctcttctgtctttcagaacctcattaagcaaatgccagagccagagcagttaaaaatgctttctgaactgaaggatgaatatgatgacctggctgagtcagagcagtttggcgtggtggtgagtgaggcctgtggcagtaagcggttttccacctcctgtattcccctcccctctagagagcagcctgggcatatg

SEQ ID NO: 37260 - DNA, 10006 bp, Homo sapiens
acacagtggtcctccgccggctacggcgctgcgtcactggtttgcaggcgctttcctcttggaagtggcgactgctgcgggcctgagcgctggtctcacgcgcctcgggagccaggttggcggcgcgatgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagacaaagccgttgaatgttacaggcgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactgcaaagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagagattgttgaaacttttgccaacaaaagcgggcagtctgcattatatgatgctctgttttctagtcagtcacctaaggatacatcttttcttggtagcgatgatattggaaacattgatgtacgagaaccagagcttgaagatttgactagatacgatgttggtgctattcgagcacataatggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaacgtagcaaaattgagacttctagttcagcatgaaataaacactctaagagcccaggaaaaacatggccttcaacctgctctgcttgtacattgggcagaatgccttcagaaaacgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaattcagtcatgcaggaactcgaagactatagtgaaggaggtcctctctataaaaatggttctttgcgaaatgcagattcagaaataaaacattctacaccgtctcctaccagatattcactatcaccaagtaaaagttacaagtattctcccaaaacaccacctcgatgggcagaagatcagaattctttactgaaaatgatttgccaacaagtagaggccattaagaaagaaatgcaggagttgaaactaaatagcagtaactcagcatcccctcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggcccagtctatggcatgaataggcttccaccccaacagcatatttatgcctatccgcaacagatgcacacaccgccagtgcaaagctcatctgcttgtatgttctctcaggagatgtatggtcctcctgcattgcgttttgagtctcctgcaacgggaattctatcgcccaggggtgatgattactttaattacaatgttcaacagacaagcacaaatccacctttgccagaaccaggatatttcacaaaacctccgattgcagctcatgcttcaagatctgcagaatctaagactatagaatttgggaaaactaattttgttcagcccatgccgggtgaaggattaaggccatctttgccaacacaagcacacacaacacagccaactccttttaaatttaactcaaatttcaaatcaaatgatggtgacttcacgttttcctcaccacaggttgtgacacagccccctcctgcagcttacagtaacagtgaaagccttttaggtctcctgacttcagataaacccttgcaaggagatggctatagtggagccaaaccaattcctggtggtcaaaccattgggcctcgaaatacattcaattttggaagcaaaaatgtgtctggaatttcatttacagaaaacatggggtcgagtcagcaaaagaattctggttttcggcgaagtgatgatatgtttactttccatggtccagggaaatcagtatttggaacacccactttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcactttttaaatgcaagtttgaagaagcccagagcattttaaaagccccaggaacaaatgtagccatggcgtcaaatcaggctgtcagaattgtaaaagaacccacaagtcatgataacaaggatatttgcaaatctgatgctggaaacctgaattttgaatttcaggttgcaaagaaagaagggtcttggtggcattgtaacagctgctcattaaagaatgcttcaactgctaagaaatgtgtatcatgccaaaatctaaacccaagcaataaagagctcgttggcccaccattagctgaaactgtttttactcctaaaaccagcccagagaatgttcaagatcgatttgcattggtgactccaaagaaagaaggtcactgggattgtagtatttgtttagtaagaaatgaacctactgtatctaggtgcattgcgtgtcagaatacaaaatctgctaacaaaagtggatcttcatttgttcatcaagcttcatttaaatttggccagggagatcttcctaaacctattaacagtgatttcagatctgttttttctacaaaggaaggacagtgggattgcagtgcatgtttggtacaaaatgaggggagctctacaaaatgtgctgcttgtcagaatccgagaaaacagagtctacctgctacttctattccaacacctgcctcttttaagtttggtacttcagagacaagtaaaactctaaaaagtggatttgaagacatgtttgctaagaaggaaggacagtgggattgcagttcatgcttagtgcgaaatgaagcaaatgctacaagatgtgttgcttgtcagaatccggataaaccaagtccatctacttctgttccagctcctgcctcttttaagtttggtacttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggaaggacagtgggattgcagtgtgtgcttagtaagaaatgaagccagtgctaccaaatgtattgcttgtcagtgtccaagtaaacaaaatcaaacaactgcaatttcaacacctgcctcttcggagataagcaaggctccaaagagtggatttgaaggaatgttcatcaggaaaggacagtgggattgtagtgtttgctgtgtacaaaatgagagttcttccttaaaatgtgtggcttgtgatgcctctaaaccaactcataaacctattgcagaagctccttcagctttcacactgggctcagaaatgaagttgcatgactcttctggaagtcaggtgggaacaggatttaaaagtaatttctcagaaaaagcttctaagtttggcaatacagagcaaggattcaaatttgggcatgtggatcaagaaaattcaccttcatttatgtttcagggttcttctaatacagaatttaagtcaaccaaagaaggattttccatccctgtgtctgctgatggatttaaatttggcatttcggaaccaggaaatcaagaaaagaaaagtgaaaagcctcttgaaaatggtactggcttccaggctcaggatattagtggccagaagaatggccgtggtgtgatttttggccaaacaagtagcacttttacatttgcagatcttgcaaaatcaacttcaggagaaggatttcagtttggcaaaaaagaccccaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcccgaaaaagtagaacttgtaacaggagaagaagatgaaaaagttctgtattcacagcgggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacgatgaacctgaagcctctctctggatcagatagagcatggatgtggttagccagtgatttctctgatggtgatgccaaactagagcagttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactatgatttaagggaagatgctttggatgatagtgtcagtagtagctcagtacatgcttctccattggcaagtagccctgtgagaaaaaatcttttccgttttggtgagtcaacaacaggatttaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcaaaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgactttgcaaaatatgaaagggacagaaagagtatggttgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcaacttcagaagttgaagtgtctagcacatctgaaacaacaccaaaagcagtggtttctcctccaaagtttgtatttggttcagagtctgttaaaagcatttttagtagtgaaaaatcaaaaccatttgcattcggcaacagttcagccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctttgcttcctttccaacggaagaatcttcaatcaactacacatttaaaacaccagaaaaggcaaaagagaagaaaaaacctgaagattctccctcagatgatgatgttctcattgtatatgaactaactccaaccgctgagcagaaagcccttgcaaccaaacttaaacttcctccaactttcttctgctacaagaatagaccagattatgttagtgaagaagaggaggatgatgaagatttcgaaacagctgtcaagaaacttaatggaaaactatatttggatggctcagaaaaatgtagacccttggaagaaaatacagcagataatgagaaagaatgtattattgtttgggaaaagaaaccaacagttgaagagaaggcaaaagcagatacgttaaaacttccacctacatttttttgtggagtctgtagtgatactgatgaagacaatggaaatggggaagactttcaatcagagcttcaaaaagttcaggaagctcaaaaatctcagacagaagaaataactagcacaactgacagtgtatatacaggtgggactgaagtgatggtaccttctttctgtaaatctgaagaacctgattctattaccaaatccattagttcaccatctgtttcctctgaaactatggacaaacctgtagatttgtcaactagaaaggaaattgatacagattctacaagccaaggggaaagcaagatagtttcatttggatttggaagtagcacagggctctcatttgcagacttggcttccagtaattctggagattttgcttttggttctaaagataaaaatttccaatgggcaaatactggagcagctgtgtttggaacacagtcagtcggaacccagtcagccggtaaagttggtgaagatgaagatggtagtgatgaagaagtagttcataatgaagatatccattttgaaccaatagtgtcactaccagaggtagaagtaaaatctggagaagaagatgaagaaattttgtttaaagagagagccaaactttatagatgggatcgggatgtcagtcagtggaaggagcgcggtgttggagatataaagattctttggcatacaatgaagaattattaccggatcctaatgagaagagaccaggtttttaaagtgtgtgcaaaccacgttattactaaaacaatggaattaaagcccttaaatgtttcaaataatgctttagtttggactgcctcagattatgctgatggagaagcaaaagtagaacagcttgcagtgagatttaaaactaaagaagtagctgattgtttcaagaaaacatttgaagaatgtcagcagaatttaatgaaactccagaaaggacatgtatcactggcagcagaattatcaaaggagaccaatcctgtggtgttttttgatgtttgtgcggacggtgaacctctagggcggataactatggaattattttcaaacattgttcctcggactgctgagaacttcagagcactatgcactggagagaaaggctttggtttcaagaattccatttttcacagagtaattccagattttgtttgccaaggaggagatatcaccaaacatgatggaacaggcggacagtccatttatggagacaaatttgaagatgaaaattttgatgtgaaacatactggtcctggtttactatccatggccaatcaaggccagaataccaataattctcaatttgttataacactgaagaaagcagaacatttggactttaagcatgtagtatttgggtttgttaaggatggcatggatactgtgaaaaagattgaatcatttggttctcccaaagggtctgtttgtcgaagaataactatcacagaatgtggacagatataaaatcattgttgttcatagaaaatttcatctgtataagcagttggattgaagcttagctattacaatttgatagttatgttcagcttttgaaaatggacgtttccgatttacaaatgtaaaattgcagcttatagctgttgtcactttttaatgtgttataattgaccttgcatggtgtgaaataaaagtttaaacactggtgta

SEQ ID NO: 37261 - DNA, 10692 bp, Homo sapiens
acacagtggtcctccgccggctacggcgctgcgtcactggtttgcaggcgctttcctcttggaagtggcgactgctgcgggcctgagcgctggtctcacgcgcctcgggagccaggttggcggcgcgatgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagacaaagccgttgaatgttacaggcgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactgcaaagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagagattgttgaaacttttgccaacaaaagcgggcagtctgcattatatgatgctctgttttctagtcagtcacctaaggatacatcttttcttggtagcgatgatattggaaacattgatgtacgagaaccagagcttgaagatttgactagatacgatgttggtgctattcgagcacataatggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaacgtagcaaaattgagacttctagttcagcatgaaataaacactctaagagcccaggaaaaacatggccttcaacctgctctgcttgtacattgggcagaatgccttcagaaaacgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaattcagtcatgcaggaactcgaagactatagtgaaggaggtcctctctataaaaatggttctttgcgaaatgcagattcagaaataaaacattctacaccgtctcctaccagatattcactatcaccaagtaaaagttacaagtattctcccaaaacaccacctcgatgggcagaagatcagaattctttactgaaaatgatttgccaacaagtagaggccattaagaaagaaatgcaggagttgaaactaaatagcagtaactcagcatcccctcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggcccagtctatggcatgaataggcttccaccccaacagcatatttatgcctatccgcaacagatgcacacaccgccagtgcaaagctcatctgcttgtatgttctctcaggagatgtatggtcctcctgcattgcgttttgagtctcctgcaacgggaattctatcgcccaggggtgatgattactttaattacaatgttcaacagacaagcacaaatccacctttgccagaaccaggatatttcacaaaacctccgattgcagctcatgcttcaagatctgcagaatctaagactatagaatttgggaaaactaattttgttcagcccatgccgggtgaaggattaaggccatctttgccaacacaagcacacacaacacagccaactccttttaaatttaactcaaatttcaaatcaaatgatggtgacttcacgttttcctcaccacaggttgtgacacagccccctcctgcagcttacagtaacagtgaaagccttttaggtctcctgacttcagataaacccttgcaaggagatggctatagtggagccaaaccaattcctggtggtcaaaccattgggcctcgaaatacattcaattttggaagcaaaaatgtgtctggaatttcatttacagaaaacatggggtcgagtcagcaaaagaattctggttttcggcgaagtgatgatatgtttactttccatggtccagggaaatcagtatttggaacacccactttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcactttttaaatgcaagtttgaagaagcccagagcattttaaaagccccaggaacaaatgtagccatggcgtcaaatcaggctgtcagaattgtaaaagaacccacaagtcatgataacaaggatatttgcaaatctgatgctggaaacctgaattttgaatttcaggttgcaaagaaagaagggtcttggtggcattgtaacagctgctcattaaagaatgcttcaactgctaagaaatgtgtatcatgccaaaatctaaacccaagcaataaagagctcgttggcccaccattagctgaaactgtttttactcctaaaaccagcccagagaatgttcaagatcgatttgcattggtgactccaaagaaagaaggtcactgggattgtagtatttgtttagtaagaaatgaacctactgtatctaggtgcattgcgtgtcagaatacaaaatctgctaacaaaagtggatcttcatttgttcatcaagcttcatttaaatttggccagggagatcttcctaaacctattaacagtgatttcagatctgttttttctacaaaggaaggacagtgggattgcagtgcatgtttggtacaaaatgaggggagctctacaaaatgtgctgcttgtcagaatccgagaaaacagagtctacctgctacttctattccaacacctgcctcttttaagtttggtacttcagagacaagtaaaactctaaaaagtggatttgaagacatgtttgctaagaaggaaggacagtgggattgcagttcatgcttagtgcgaaatgaagcaaatgctacaagatgtgttgcttgtcagaatccggataaaccaagtccatctacttctgttccagctcctgcctcttttaagtttggtacttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggaaggacagtgggattgcagtgtgtgcttagtaagaaatgaagccagtgctaccaaatgtattgcttgtcagtgtccaagtaaacaaaatcaaacaactgcaatttcaacacctgcctcttcggagataagcaaggctccaaagagtggatttgaaggaatgttcatcaggaaaggacagtgggattgtagtgtttgctgtgtacaaaatgagagttcttccttaaaatgtgtggcttgtgatgcctctaaaccaactcataaacctattgcagaagctccttcagctttcacactgggctcagaaatgaagttgcatgactcttctggaagtcaggtgggaacaggatttaaaagtaatttctcagaaaaagcttctaagtttggcaatacagagcaaggattcaaatttgggcatgtggatcaagaaaattcaccttcatttatgtttcagggttcttctaatacagaatttaagtcaaccaaagaaggattttccatccctgtgtctgctgatggatttaaatttggcatttcggaaccaggaaatcaagaaaagaaaagtgaaaagcctcttgaaaatggtactggcttccaggctcaggatattagtggccagaagaatggccgtggtgtgatttttggccaaacaagtagcacttttacatttgcagatcttgcaaaatcaacttcaggagaaggatttcagtttggcaaaaaagaccccaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcccgaaaaagtagaacttgtaacaggagaagaagatgaaaaagttctgtattcacagcgggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacgatgaacctgaagcctctctctggatcagatagagcatggatgtggttagccagtgatttctctgatggtgatgccaaactagagcagttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactatgatttaagggaagatgctttggatgatagtgtcagtagtagctcagtacatgcttctccattggcaagtagccctgtgagaaaaaatcttttccgttttggtgagtcaacaacaggatttaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcaaaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgactttgcaaaatatgaaagggacagaaagagtatggttgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcaacttcagaagttgaagtgtctagcacatctgaaacaacaccaaaagcagtggtttctcctccaaagtttgtatttggttcagagtctgttaaaagcatttttagtagtgaaaaatcaaaaccatttgcattcggcaacagttcagccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctttgcttcctttccaacggaagaatcttcaatcaactacacatttaaaacaccagaaaaggcaaaagagaagaaaaaacctgaagattctccctcagatgatgatgttctcattgtatatgaactaactccaaccgctgagcagaaagcccttgcaaccaaacttaaacttcctccaactttcttctgctacaagaatagaccagattatgttagtgaagaagaggaggatgatgaagatttcgaaacagctgtcaagaaacttaatggaaaactatatttggatggctcagaaaaatgtagacccttggaagaaaatacagcagataatgagaaagaatgtattattgtttgggaaaagaaaccaacagttgaagagaaggcaaaagcagatacgttaaaacttccacctacatttttttgtggagtctgtagtgatactgatgaagacaatggaaatggggaagactttcaatcagagcttcaaaaagttcaggaagctcaaaaatctcagacagaagaaataactagcacaactgacagtgtatatacaggtgggactgaagtgatggtaccttctttctgtaaatctgaagaacctgattctattaccaaatccattagttcaccatctgtttcctctgaaactatggacaaacctgtagatttgtcaactagaaaggaaattgatacagattctacaagccaaggggaaagcaagatagtttcatttggatttggaagtagcacagggctctcatttgcagacttggcttccagtaattctggagattttgcttttggttctaaagataaaaatttccaatgggcaaatactggagcagctgtgtttggaacacagtcagtcggaacccagtcagccggtaaagttggtgaagatgaagatggtagtgatgaagaagtagttcataatgaagatatccattttgaaccaatagtgtcactaccagaggtagaagtaaaatctggagaagaagatgaagaaattttgtttaaagagagagccaaactttatagatgggatcgggatgtcagtcagtggaaggagcgcggtgttggagatataaagattctttggcatacaatgaagaattattaccggatcctaatgagaagagaccaggtttttaaagtgtgtgcaaaccacgttattactaaaacaatggaattaaagcccttaaatgtttcaaataatgctttagtttggactgcctcagattatgctgatggagaagcaaaagtagaacagcttgcagtgagatttaaaactaaagaagtagctgattgtttcaagaaaacatttgaagaatgtcagcagaatttaatgaaactccagaaaggacatgtatcactggcagcagaattatcaaaggagaccaatcctgtggtgttttttgatgtttgtgcggacggtgaacctctagggcggataactatggaattattttcaaacattgttcctcggactgctgagaacttcagagcactatgcactggagagaaaggctttggtttcaagaattccatttttcacagagtaattccagattttgtttgccaaggaggagatatcaccaaacatgatggaacaggcggacagtccatttatggagacaaatttgaagatgaaaattttgatgtgaaacatactggtcctggtttactatccatggccaatcaaggccagaataccaataattctcaatttgttataacactgaagaaagcagaacatttggactttaagcatgtagtatttgggtttgttaaggatggcatggatactgtgaaaaagattgaatcatttggttctcccaaagggtctgtttgtcgaagaataactatcacagaatgtggacagatataaaatcattgttgttcatagaaaatttcatctgtataagcagttggattgaagcttagctattacaatttgatagttatgttcagcttttgaaaatggacgtttccgatttacaaatgtaaaattgcagcttatagctgttgtcactttttaatgtgttataattgaccttgcatggtgtgaaataaaagtttaaacactggtgtatttcaggtgtacttgtgtttatgtactcctgacgtattaaaatggaataatactaatcttgttaaaagcaatagacctcaaactattgaaggaatatgatatatgcaatttaattttaattccttttaagatatttggacttcctgcatggatatacttaccatttgaataaagggaccacaacttggataatttaattttaggtttgaaatatatttggtaatcttaactattggtgtactcatttatgcatagagactcgtttatgaatgggtagagccacagaacgtatagagttaaccaaagtgctcttctctagaatctttacacctcctgtgtggttacaagttaactttgtaagtagcgtaccttccttccttaaaatatctagcttcctgtgccctttcatagatattcgattaatttttacattttaaacaagttgactatttcctttaggggttttgtttcaaacttttctgtcatctgtctctactacctcagaaactgcagcttggttctgatgatagaaattgaatttttccttgtagttattgtgataaagtatgaatatttttagaaagtctataccatgttctttcgttaaagatttgctttatacaagattgttgcagtacctttttctggtaaattttgtagcagaaataaaatgacaattcctaaga

SEQ ID NO: 37262 - DNA, 948 bp, Homo sapiens
taggctaaggtacgaggcgggggggttattactaaaacaatggaattaaagcccttaaatgtttcaaataatgctttagtttggactgcctcagattatgctgatggagaagcaaaagtagaacagcttgcagtgagatttaaaactaaagaagtagctgattgtttcaagaaaacatttgaagaatgtcagcagaatttaatgaaactccagaaaggacatgtatcactggcagcagaattatcaaaggagaccaatcctgtggtgttttttgatgtttgtgcggacggtgaacctctagggcggataactatggaattattttcaaacattgttcctcggactgctgagaacttcagagcactatgcactggagagaaaggctttggtttcaagaattccatttttcacagagtaattccagattttgtttgccaaggaggagatatcaccaaacatgatggaacaggcggacagtccatttatggagacaaatttgaagatgaaaattttgatgtgaaacatactggtcctggtttactatccatggccaatcaaggccagaataccaataattctcaatttgttataacactgaagaaagcagaacatttggactttaagcatgtagtatttgggtttgttaaggatggcatggatactgtgaaaaagattgaatcatttggttctcccaaagggtctgtttgtcgaagaataactatcacagaatgtggacagatataaaatcattgttgttcatagaaaatttcatctgtataagcagttggattgaagcttagctattacaatttgatagttatgttcagcttttgaaaatggacgtttccgatttacaaatgtaaaattgcagcttatagctgttgtcactttttaatgtgttataattgaccttgcatggtgtgaaataaaagtttaaacactggtgta

SEQ ID NO: 37263 - DNA, 688 bp, Homo sapiens
  misc_feature (72)..(72): n is a, c, g, or t
  misc_feature (139)..(139): n is a, c, g, or t
ccggtgtagcagtagccagcaacacaaagtggtgttgatgcttatgcagaaacgacattcttcctctatgcnaatggtgatgttggtcagctcacagctattcagcagattgctttcagcaacagaaaagaaagaaaanctggagtgtcttcatcctggtctggaaagcaaacaatgaagcccactagaaactgtggtcggcctcgtgccgaattcggcacgagatggagacaaatttgaagatgaaaattttgatgtgaaacatactggtcctggtttactatccatggccaatcaaggccagaataccaataattctcaatttgttataacactgaagaaagcagaacatttggactttaagcatgtagtatttgggtttgttaaggatggcatggatactgtgaaaaagattgaatcatttggttctcccaaagggtctgtttgtcgaagaataactatcacagaatgtggacagatataaaatcattgttgttcatagaaaatttcatctgtataagcagttggattgaagcttagctattacaatttgatagttatgttcagcttttgaaaatggacgtttccgatttacaaatgtaaaattgcagcttatagctgttgtcactttttaatgtgttataattgaccttgcatggtgtgaaataaaagtttaaacactggtgta

SEQ ID NO: 37264 - DNA, 949 bp, Homo sapiens
acagagtaattccagaaaccaaagcctttctctccagtgcatatgcactggagagaaaggctttggtttcaagaattccatttttcacagagtaattccagattttgtttgccaaggaggagatatcaccaaacatgatggaacaggcggacagtccatttatggagacaaatttgaagatgaaaattttgatgtgaaacatactggtcctggtttactatccatggccaatcaaggccagaataccaataattctcaatttgttataacactgaagaaagcagaacatttggactttaagcatgtagtatttgggtttgttaaggatggcatggatactgtgaaaaagattgaatcatttggttctcccaaagggtctgtttgtcgaagaataactatcacagaatgtggacagatataaaatcattgttgttcatagaaaatttcatctgtataagcagttggattgaagcttagctattacaatttgatagttatgttcagcttttgaaaatggacgtttccgatttacaaatgtaaaattgcagcttatagctgttgtcactttttaatgtgttataattgaccttgcatggtgtgaaataaaagtttaaacactggtgtaaaaaaaaaaaaaaaaaaaatcggggattatatggggggggggaaaaaagaggtacggaaggcgcatggtcataaggtgttccgggaccaatttcgtggtccaagggtgaaatcgggcggctccccaaggggagcgtaaaattcgaaagcaggtaactgtagacttgtgcggaacacgggaagacaggaacaggaaccaccagcacacaaggaacaaacagcaacaacataccgacaccaacagagaagccaagcatccgagaacaagagcacgacacagccgcacgcgagacgaacagcacgagacagcacagaaaaaaacaac

SEQ ID NO: 37265 - DNA, 795 bp, Homo sapiens
cataaggaccttgttgctgaggattgactggggaggtctaggcttctggtggtgactcagatggacaggaatgtgtggcattagtcctggtagtctctgaagagagtatgagctactgcagtaatcacagatgcttttcttcacatacagttcttgaggcttagtttctgggttgtaagcaactctcagaagggatgaataaggtatataggatggtgtttttggtggcatcatcataaaactagacatagtggaatggtgctctttgggagcatgacttgtttaaaattgcacaagtgttactctaataatttttctttttcccctctaaataggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcggtctgtttgtcgaagaataactatcacagaatgtggacagatataaaatcattgttgttcatagaaaatttcatctgtataagcagttggattgaagcttagctattacaatttgatagttatgttcagcttttgaaaatggacgtttccgatttacaaatgtaaaattgcagcttatagctgttgtcactttttaatgtgttataattgaccttgcatggtgtgaaataaaagtttaaacactggtgta

SEQ ID NO: 37266 - DNA, 9809 bp, Homo sapiens
cataaggaccttgttgctgaggattgactggggaggtctaggcttctggtggtgactcagatggacaggaatgtgtggcattagtcctggtagtctctgaagagagtatgagctactgcagtaatcacagatgcttttcttcacatacagttcttgaggcttagtttctgggttgtaagcaactctcagaagggatgaataaggtatataggatggtgtttttggtggcatcatcataaaactagacatagtggaatggtgctctttgggagcatgacttgtttaaaattgcacaagtgttactctaataatttttctttttcccctctaaataggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactgcaaagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagagattgttgaaacttttgccaacaaaagcgggcagtctgcattatatgatgctctgttttctagtcagtcacctaaggatacatcttttcttggtagcgatgatattggaaacattgatgtacgagaaccagagcttgaagatttgactagatacgatgttggtgctattcgagcacataatggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaacgtagcaaaattgagacttctagttcagcatgaaataaacactctaagagcccaggaaaaacatggccttcaacctgctctgcttgtacattgggcagaatgccttcagaaaacgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaattcagtcatgcaggaactcgaagactatagtgaaggaggtcctctctataaaaatggttctttgcgaaatgcagattcagaaataaaacattctacaccgtctcctaccagatattcactatcaccaagtaaaagttacaagtattctcccaaaacaccacctcgatgggcagaagatcagaattctttactgaaaatgatttgccaacaagtagaggccattaagaaagaaatgcaggagttgaaactaaatagcagtaactcagcatcccctcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggcccagtctatggcatgaataggcttccaccccaacagcatatttatgcctatccgcaacagatgcacacaccgccagtgcaaagctcatctgcttgtatgttctctcaggagatgtatggtcctcctgcattgcgttttgagtctcctgcaacgggaattctatcgcccaggggtgatgattactttaattacaatgttcaacagacaagcacaaatccacctttgccagaaccaggatatttcacaaaacctccgattgcagctcatgcttcaagatctgcagaatctaagactatagaatttgggaaaactaattttgttcagcccatgccgggtgaaggattaaggccatctttgccaacacaagcacacacaacacagccaactccttttaaatttaactcaaatttcaaatcaaatgatggtgacttcacgttttcctcaccacaggttgtgacacagccccctcctgcagcttacagtaacagtgaaagccttttaggtctcctgacttcagataaacccttgcaaggagatggctatagtggagccaaaccaattcctggtggtcaaaccattgggcctcgaaatacattcaattttggaagcaaaaatgtgtctggaatttcatttacagaaaacatggggtcgagtcagcaaaagaattctggttttcggcgaagtgatgatatgtttactttccatggtccagggaaatcagtatttggaacacccactttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcactttttaaatgcaagtttgaagaagcccagagcattttaaaagccccaggaacaaatgtagccatggcgtcaaatcaggctgtcagaattgtaaaagaacccacaagtcatgataacaaggatatttgcaaatctgatgctggaaacctgaattttgaatttcaggttgcaaagaaagaagggtcttggtggcattgtaacagctgctcattaaagaatgcttcaactgctaagaaatgtgtatcatgccaaaatctaaacccaagcaataaagagctcgttggcccaccattagctgaaactgtttttactcctaaaaccagcccagagaatgttcaagatcgatttgcattggtgactccaaagaaagaaggtcactgggattgtagtatttgtttagtaagaaatgaacctactgtatctaggtgcattgcgtgtcagaatacaaaatctgctaacaaaagtggatcttcatttgttcatcaagcttcatttaaatttggccagggagatcttcctaaacctattaacagtgatttcagatctgttttttctacaaaggaaggacagtgggattgcagtgcatgtttggtacaaaatgaggggagctctacaaaatgtgctgcttgtcagaatccgagaaaacagagtctacctgctacttctattccaacacctgcctcttttaagtttggtacttcagagacaagtaaaactctaaaaagtggatttgaagacatgtttgctaagaaggaaggacagtgggattgcagttcatgcttagtgcgaaatgaagcaaatgctacaagatgtgttgcttgtcagaatccggataaaccaagtccatctacttctgttccagctcctgcctcttttaagtttggtacttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggaaggacagtgggattgcagtgtgtgcttagtaagaaatgaagccagtgctaccaaatgtattgcttgtcagtgtccaagtaaacaaaatcaaacaactgcaatttcaacacctgcctcttcggagataagcaaggctccaaagagtggatttgaaggaatgttcatcaggaaaggacagtgggattgtagtgtttgctgtgtacaaaatgagagttcttccttaaaatgtgtggcttgtgatgcctctaaaccaactcataaacctattgcagaagctccttcagctttcacactgggctcagaaatgaagttgcatgactcttctggaagtcaggtgggaacaggatttaaaagtaatttctcagaaaaagcttctaagtttggcaatacagagcaaggattcaaatttgggcatgtggatcaagaaaattcaccttcatttatgtttcagggttcttctaatacagaatttaagtcaaccaaagaaggattttccatccctgtgtctgctgatggatttaaatttggcatttcggaaccaggaaatcaagaaaagaaaagtgaaaagcctcttgaaaatggtactggcttccaggctcaggatattagtggccagaagaatggccgtggtgtgatttttggccaaacaagtagcacttttacatttgcagatcttgcaaaatcaacttcaggagaaggatttcagtttggcaaaaaagaccccaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcccgaaaaagtagaacttgtaacaggagaagaagatgaaaaagttctgtattcacagcgggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacgatgaacctgaagcctctctctggatcagatagagcatggatgtggttagccagtgatttctctgatggtgatgccaaactagagcagttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactatgatttaagggaagatgctttggatgatagtgtcagtagtagctcagtacatgcttctccattggcaagtagccctgtgagaaaaaatcttttccgttttggtgagtcaacaacaggatttaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcaaaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgactttgcaaaatatgaaagggacagaaagagtatggttgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcaacttcagaagttgaagtgtctagcacatctgaaacaacaccaaaagcagtggtttctcctccaaagtttgtatttggttcagagtctgttaaaagcatttttagtagtgaaaaatcaaaaccatttgcattcggcaacagttcagccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctttgcttcctttccaacggaagaatcttcaatcaactacacatttaaaacaccagaaaaggcaaaagagaagaaaaaacctgaagattctccctcagatgatgatgttctcattgtatatgaactaactccaaccgctgagcagaaagcccttgcaaccaaacttaaacttcctccaactttcttctgctacaagaatagaccagattatgttagtgaagaagaggaggatgatgaagatttcgaaacagctgtcaagaaacttaatggaaaactatatttggatggctcagaaaaatgtagacccttggaagaaaatacagcagataatgagaaagaatgtattattgtttgggaaaagaaaccaacagttgaagagaaggcaaaagcagatacgttaaaacttccacctacatttttttgtggagtctgtagtgatactgatgaagacaatggaaatggggaagactttcaatcagagcttcaaaaagttcaggaagctcaaaaatctcagacagaagaaataactagcacaactgacagtgtatatacaggtgggactgaagtgatggtaccttctttctgtaaatctgaagaacctgattctattaccaaatccattagttcaccatctgtttcctctgaaactatggacaaacctgtagatttgtcaactagaaaggaaattgatacagattctacaagccaaggggaaagcaagatagtttcatttggatttggaagtagcacagggctctcatttgcagacttggcttccagtaattctggagattttgcttttggttctaaagataaaaatttccaatgggcaaatactggagcagctgtgtttggaacacagtcagtcggaacccagtcagccggtaaagttggtgaagatgaagatggtagtgatgaagaagtagttcataatgaagatatccattttgaaccaatagtgtcactaccagaggtagaagtaaaatctggagaagaagatgaagaaattttgtttaaagagagagccaaactttatagatgggatcgggatgtcagtcagtggaaggagcgcggtgttggagatataaagattctttggcatacaatgaagaattattaccggatcctaatgagaagagaccaggtttttaaagtgtgtgcaaaccacgttattactaaaacaatggaattaaagcccttaaatgtttcaaataatgctttagtttggactgcctcagattatgctgatggagaagcaaaagtagaacagcttgcagtgagatttaaaactaaagaagtagctgattgtttcaagaaaacatttgaagaatgtcagcagaatttaatgaaactccagaaaggacatgtatcactggcagcagaattatcaaaggagaccaatcctgtggtgttttttgatgtttgtgcggacggtgaacctctagggcggataactatggaattattttcaaacattgttcctcggactgctgagaacttcagagcactatgcactggagagaaaggctttggtttcaagaattccatttttcacagagtaattccagattttgtttgccaaggaggagatatcaccaaacatgatggaacaggcggacagtccatttatggagacaaatttgaagatgaaaattttgatgtgaaacatactggtcctggtttactatccatggccaatcaaggccagaataccaataattctcaatttgttataacactgaagaaagcagaacatttggactttaagcatgtagtatttgggtttgttaaggatggcatggatactgtgaaaaagattgaatcatttggttctcccaaagggtctgtttgtcgaagaataactatcacagaatgtggacagatataaaatcattgttgttcatagaaaatttcatctgtataagcagttggattgaagcttagctattacaatttgatagttatgttcagcttttgaaaatggacgtttccgatttacaaatgtaaaattgcagcttatagctgttgtcactttttaatgtgttataattgaccttgcatggtgtgaaataaaagtttaaacactggtgta

SEQ ID NO: 37267 - DNA, 11721 bp, Homo sapiens
acacagtggtcctccgccggctacggcgctgcgtcactggtttgcaggcgctttcctcttggaagtggcgactgctgcgggcctgagcgctggtctcacgcgcctcgggagccaggttggcggcgcgatgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagacaaagccgttgaatgttacaggcgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactgcaaagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagagattgttgaaacttttgccaacaaaagcgggcagtctgcattatatgatgctctgttttctagtcagtcacctaaggatacatcttttcttggtagcgatgatattggaaacattgatgtacgagaaccagagcttgaagatttgactagatacgatgttggtgctattcgagcacataatggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaacgtagcaaaattgagacttctagttcagcatgaaataaacactctaagagcccaggaaaaacatggccttcaacctgctctgcttgtacattgggcagaatgccttcagaaaacgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaattcagtcatgcaggaactcgaagactatagtgaaggaggtcctctctataaaaatggttctttgcgaaatgcagattcagaaataaaacattctacaccgtctcctaccagatattcactatcaccaagtaaaagttacaagtattctcccaaaacaccacctcgatgggcagaagatcagaattctttactgaaaatgatttgccaacaagtagaggccattaagaaagaaatgcaggagttgaaactaaatagcagtaactcagcatcccctcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggcccagtctatggcatgaataggcttccaccccaacagcatatttatgcctatccgcaacagatgcacacaccgccagtgcaaagctcatctgcttgtatgttctctcaggagatgtatggtcctcctgcattgcgttttgagtctcctgcaacgggaattctatcgcccaggggtgatgattactttaattacaatgttcaacagacaagcacaaatccacctttgccagaaccaggatatttcacaaaacctccgattgcagctcatgcttcaagatctgcagaatctaagactatagaatttgggaaaactaattttgttcagcccatgccgggtgaaggattaaggccatctttgccaacacaagcacacacaacacagccaactccttttaaatttaactcaaatttcaaatcaaatgatggtgacttcacgttttcctcaccacaggttgtgacacagccccctcctgcagcttacagtaacagtgaaagccttttaggtctcctgacttcagataaacccttgcaaggagatggctatagtggagccaaaccaattcctggtggtcaaaccattgggcctcgaaatacattcaattttggaagcaaaaatgtgtctggaatttcatttacagaaaacatggggtcgagtcagcaaaagaattctggttttcggcgaagtgatgatatgtttactttccatggtccagggaaatcagtatttggaacacccactttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcactttttaaatgcaagtttgaagaagcccagagcattttaaaagccccaggaacaaatgtagccatggcgtcaaatcaggctgtcagaattgtaaaagaacccacaagtcatgataacaaggatatttgcaaatctgatgctggaaacctgaattttgaatttcaggttgcaaagaaagaagggtcttggtggcattgtaacagctgctcattaaagaatgcttcaactgctaagaaatgtgtatcatgccaaaatctaaacccaagcaataaagagctcgttggcccaccattagctgaaactgtttttactcctaaaaccagcccagagaatgttcaagatcgatttgcattggtgactccaaagaaagaaggtcactgggattgtagtatttgtttagtaagaaatgaacctactgtatctaggtgcattgcgtgtcagaatacaaaatctgctaacaaaagtggatcttcatttgttcatcaagcttcatttaaatttggccagggagatcttcctaaacctattaacagtgatttcagatctgttttttctacaaaggaaggacagtgggattgcagtgcatgtttggtacaaaatgaggggagctctacaaaatgtgctgcttgtcagaatccgagaaaacagagtctacctgctacttctattccaacacctgcctcttttaagtttggtacttcagagacaagtaaaactctaaaaagtggatttgaagacatgtttgctaagaaggaaggacagtgggattgcagttcatgcttagtgcgaaatgaagcaaatgctacaagatgtgttgcttgtcagaatccggataaaccaagtccatctacttctgttccagctcctgcctcttttaagtttggtacttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggaaggacagtgggattgcagtgtgtgcttagtaagaaatgaagccagtgctaccaaatgtattgcttgtcagtgtccaagtaaacaaaatcaaacaactgcaatttcaacacctgcctcttcggagataagcaaggctccaaagagtggatttgaaggaatgttcatcaggaaaggacagtgggattgtagtgtttgctgtgtacaaaatgagagttcttccttaaaatgtgtggcttgtgatgcctctaaaccaactcataaacctattgcagaagctccttcagctttcacactgggctcagaaatgaagttgcatgactcttctggaagtcaggtgggaacaggatttaaaagtaatttctcagaaaaagcttctaagtttggcaatacagagcaaggattcaaatttgggcatgtggatcaagaaaattcaccttcatttatgtttcagggttcttctaatacagaatttaagtcaaccaaagaaggattttccatccctgtgtctgctgatggatttaaatttggcatttcggaaccaggaaatcaagaaaagaaaagtgaaaagcctcttgaaaatggtactggcttccaggctcaggatattagtggccagaagaatggccgtggtgtgatttttggccaaacaagtagcacttttacatttgcagatcttgcaaaatcaacttcaggagaaggatttcagtttggcaaaaaagaccccaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcccgaaaaagtagaacttgtaacaggagaagaagatgaaaaagttctgtattcacagcgggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacgatgaacctgaagcctctctctggatcagatagagcatggatgtggttagccagtgatttctctgatggtgatgccaaactagagcagttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactatgatttaagggaagatgctttggatgatagtgtcagtagtagctcagtacatgcttctccattggcaagtagccctgtgagaaaaaatcttttccgttttggtgagtcaacaacaggatttaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcaaaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgactttgcaaaatatgaaagggacagaaagagtatggttgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcaacttcagaagttgaagtgtctagcacatctgaaacaacaccaaaagcagtggtttctcctccaaagtttgtatttggttcagagtctgttaaaagcatttttagtagtgaaaaatcaaaaccatttgcattcggcaacagttcagccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctttgcttcctttccaacggaagaatcttcaatcaactacacatttaaaacaccagaaaaggcaaaagagaagaaaaaacctgaagattctccctcagatgatgatgttctcattgtatatgaactaactccaaccgctgagcagaaagcccttgcaaccaaacttaaacttcctccaactttcttctgctacaagaatagaccagattatgttagtgaagaagaggaggatgatgaagatttcgaaacagctgtcaagaaacttaatggaaaactatatttggatggctcagaaaaatgtagacccttggaagaaaatacagcagataatgagaaagaatgtattattgtttgggaaaagaaaccaacagttgaagagaaggcaaaagcagatacgttaaaacttccacctacatttttttgtggagtctgtagtgatactgatgaagacaatggaaatggggaagactttcaatcagagcttcaaaaagttcaggaagctcaaaaatctcagacagaagaaataactagcacaactgacagtgtatatacaggtgggactgaagtgatggtaccttctttctgtaaatctgaagaacctgattctattaccaaatccattagttcaccatctgtttcctctgaaactatggacaaacctgtagatttgtcaactagaaaggaaattgatacagattctacaagccaaggggaaagcaagatagtttcatttggatttggaagtagcacagggctctcatttgcagacttggcttccagtaattctggagattttgcttttggttctaaagataaaaatttccaatgggcaaatactggagcagctgtgtttggaacacagtcagtcggaacccagtcagccggtaaagttggtgaagatgaagatggtagtgatgaagaagtagttcataatgaagatatccattttgaaccaatagtgtcactaccagaggtagaagtaaaatctggagaagaagatgaagaaattttgtttaaagagagagccaaactttatagatgggatcgggatgtcagtcagtggaaggagcgcggtgttggagatataaagattctttggcatacaatgaagaattattaccggatcctaatgagaagagaccaggtttttaaagtgtgtgcaaaccacgttattactaaaacaatggaattaaagcccttaaatgtttcaaataatgctttagtttggactgcctcagattatgctgatggagaagcaaaagtagaacagcttgcagtgagatttaaaactaaagaagtagctgattgtttcaagaaaacatttgaagaatgtcagcagaatttaatgaaactccagaaaggacatgtatcactggcagcagaattatcaaaggagaccaatcctgtggtgttttttgatgtttgtgcggacggtgaacctctagggcggataactatggaattattttcaaacattgttcctcggactgctgagaacttcagagcactatgcactggagagaaaggctttggtttcaagaattccatttttcacagagtaattccagattttgtttgccaaggaggagatatcaccaaacatgatggaacaggcggacagtccatttatggagacaaatttgaagatgaaaattttgatgtgaaacatactggtcctggtttactatccatggccaatcaaggccagaataccaataattctcaatttgttataacactgaagaaagcagaacatttggactttaagcatgtagtatttgggtttgttaaggatggcatggatactgtgaaaaagattgaatcatttggttctcccaaagggtctgtttgtcgaagaataactatcacagaatgtggacagatataaaatcattgttgttcatagaaaatttcatctgtataagcagttggattgaagcttagctattacaatttgatagttatgttcagcttttgaaaatggacgtttccgatttacaaatgtaaaattgcagcttatagctgttgtcactttttaatgtgttataattgaccttgcatggtgtgaaataaaagtttaaacactggtgtatttcaggtgtacttgtgtttatgtactcctgacgtattaaaatggaataatactaatcttgttaaaagcaatagacctcaaactattgaaggaatatgatatatgcaatttaattttaattccttttaagatatttggacttcctgcatggatatacttaccatttgaataaagggaccacaacttggataatttaattttaggtttgaaatatatttggtaatcttaactattggtgtactcatttatgcatagagactcgtttatgaatgggtagagccacagaacgtatagagttaaccaaagtgctcttctctagaatctttacacctcctgtgtggttacaagttaactttgtaagtagcgtaccttccttccttaaaatatctagcttcctgtgccctttcatagatattcgattaatttttacattttaaacaagttgactatttcctttaggggttttgtttcaaacttttctgtcatctgtctctactacctcagaaactgcagcttggttctgatgatagaaattgaatttttccttgtagttattgtgataaagtatgaatatttttagaaagtctataccatgttctttcgttaaagatttgctttatacaagattgttgcagtacctttttctggtaaattttgtagcagaaataaaatgacaattcctaagagccactgacatccaaaaaattcattacttacgcttcgggttcattctaaagtaaggaagacaatttaaaggcagtaaattcaaactgctgcataatttccagagctcctagtttctcaagtttgatacacaccaaaaacgtatttggaaatggcttgtatcaaatgttaggcaaattgctaaagaaaagaggatgttcttattggcctactcaatatggaactacaaagaatccaggtagaacacaaaattttgtatattgcaattatgaatattgactgtcttccacccatctgtgttctttcgggtgaaattacctcattttatttagtgaggaaagacaggtttattccctgttacatggggatttggaaattgggtatcctaaagcaagtaactgttcaaccaccagtcaaaagaggggagggatgttgtgcgagtaatgagtgatggtataccatcaccattccactcggccacaaagccagatacttgaaataaacctactccaaatgtatcagttcagtcttgaaccatggattacatatgtttacactaaatatttcaaattggcttatttggaaatctatgtaatataaactgatgtaaagtgtgttgtaacttttcagctgagacagttgatgccttcgtcatgattttagaataaattcttaagttaatgcaagtgctttttaagagactttttacagatttgtatgctttcctaaagcactaaagttacaaattaaaaagctttaaaaactttgaccaaaaatttgacaaaatgacatgtaaactgacttttcccgtattagtattccaaagatgcttaaaagtggcttgtggcatttatgagaaagtctttgtgtcacatttcaggaaaggactttgatttctctttgttatttaatcactgatgtggtctaaacccacgataatatgtatctttccttttaaactggattttatgttgtctcattaaaatctgcttaaagatagaataaaattcattatttgtaaaaaaaaaaaa

SEQ ID NO: 37268 - DNA, 11667 bp, Homo sapiens
acacagtggtcctccgccggctacggcgctgcgtcactggtttgcaggcgctttcctcttggaagtggcgactgctgcgggcctgagcgctggtctcacgcgcctcgggagccaggttggcggcgcgatgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagacaaagccgttgaatgttacaggcgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactgcaaagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagagattgttgaaacttttgccaacaaaagcgggcagtctgcattatatgatgctctgttttctagtcagtcacctaaggatacatcttttcttggtagcgatgatattggaaacattgatgtacgagaaccagagcttgaagatttgactagatacgatgttggtgctattcgagcacataatggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaacgtagcaaaattgagacttctagttcagcatgaaataaacactctaagagcccaggaaaaacatggccttcaacctgctctgcttgtacattgggcagaatgccttcagaaaacgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaattcagtcatgcaggaactcgaagactatagtgaaggaggtcctctctataaaaatggttctttgcgaaatgcagattcagaaataaaacattctacaccgtctcctaccagatattcactatcaccaagtaaaagttacaagtattctcccaaaacaccacctcgatgggcagaagatcagaattctttactgaaaatgatttgccaacaagtagaggccattaagaaagaaatgcaggagttgaaactaaatagcagtaactcagcatcccctcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggcccagtctatggcatgaataggcttccaccccaacagcatatttatgcctatccgcaacagatgcacacaccgccagtgcaaagctcatctgcttgtatgttctctcaggagatgtatggtcctcctgcattgcgttttgagtctcctgcaacgggaattctatcgcccaggggtgatgattactttaattacaatgttcaacagacaagcacaaatccacctttgccagaaccaggatatttcacaaaacctccgattgcagctcatgcttcaagatctgcagaatctaagactatagaatttgggaaaactaattttgttcagcccatgccgggtgaaggattaaggccatctttgccaacacaagcacacacaacacagccaactccttttaaatttaactcaaatttcaaatcaaatgatggtgacttcacgttttcctcaccacaggttgtgacacagccccctcctgcagcttacagtaacagtgaaagccttttaggtctcctgacttcagataaacccttgcaaggagatggctatagtggagccaaaccaattcctggtggtcaaaccattgggcctcgaaatacattcaattttggaagcaaaaatgtgtctggaatttcatttacagaaaacatggggtcgagtcagcaaaagaattctggttttcggcgaagtgatgatatgtttactttccatggtccagggaaatcagtatttggaacacccactttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcactttttaaatgcaagtttgaagaagcccagagcattttaaaagccccaggaacaaatgtagccatggcgtcaaatcaggctgtcagaattgtaaaagaacccacaagtcatgataacaaggatatttgcaaatctgatgctggaaacctgaattttgaatttcaggttgcaaagaaagaagggtcttggtggcattgtaacagctgctcattaaagaatgcttcaactgctaagaaatgtgtatcatgccaaaatctaaacccaagcaataaagagctcgttggcccaccattagctgaaactgtttttactcctaaaaccagcccagagaatgttcaagatcgatttgcattggtgactccaaagaaagaaggtcactgggattgtagtatttgtttagtaagaaatgaacctactgtatctaggtgcattgcgtgtcagaatacaaaatctgctaacaaaagtggatcttcatttgttcatcaagcttcatttaaatttggccagggagatcttcctaaacctattaacagtgatttcagatctgttttttctacaaaggaaggacagtgggattgcagtgcatgtttggtacaaaatgaggggagctctacaaaatgtgctgcttgtcagaatccgagaaaacagagtctacctgctacttctattccaacacctgcctcttttaagtttggtacttcagagacaagtaaaactctaaaaagtggatttgaagacatgtttgctaagaaggaaggacagtgggattgcagttcatgcttagtgcgaaatgaagcaaatgctacaagatgtgttgcttgtcagaatccggataaaccaagtccatctacttctgttccagctcctgcctcttttaagtttggtacttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggaaggacagtgggattgcagtgtgtgcttagtaagaaatgaagccagtgctaccaaatgtattgcttgtcagtgtccaagtaaacaaaatcaaacaactgcaatttcaacacctgcctcttcggagataagcaaggctccaaagagtggatttgaaggaatgttcatcaggaaaggacagtgggattgtagtgtttgctgtgtacaaaatgagagttcttccttaaaatgtgtggcttgtgatgcctctaaaccaactcataaacctattgcagaagctccttcagctttcacactgggctcagaaatgaagttgcatgactcttctggaagtcaggtgggaacaggatttaaaagtaatttctcagaaaaagcttctaagtttggcaatacagagcaaggattcaaatttgggcatgtggatcaagaaaattcaccttcatttatgtttcagggttcttctaatacagaatttaagtcaaccaaagaaggattttccatccctgtgtctgctgatggatttaaatttggcatttcggaaccaggaaatcaagaaaagaaaagtgaaaagcctcttgaaaatggtactggcttccaggctcaggatattagtggccagaagaatggccgtggtgtgatttttggccaaacaagtagcacttttacatttgcagatcttgcaaaatcaacttcaggagaaggatttcagtttggcaaaaaagaccccaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcccgaaaaagtagaacttgtaacaggagaagaagatgaaaaagttctgtattcacagcgggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacgatgaacctgaagcctctctctggatcagatagagcatggatgtggttagccagtgatttctctgatggtgatgccaaactagagcagttggcagcaaaatttcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactatgatttaagggaagatgctttggatgatagtgtcagtagtagctcagtacatgcttctccattggcaagtagccctgtgagaaaaaatcttttccgttttggtgagtcaacaacaggatttaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcaaaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgactttgcaaaatatgaaagggacagaaagagtatggttgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcaacttcagaagttgaagtgtctagcacatctgaaacaacaccaaaagcagtggtttctcctccaaagtttgtatttggttcagagtctgttaaaagcatttttagtagtgaaaaatcaaaaccatttgcattcggcaacagttcagccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctttgcttcctttccaacggaagaatcttcaatcaactacacatttaaaacaccagaaaaggcaaaagagaagaaaaaacctgaagattctccctcagatgatgatgttctcattgtatatgaactaactccaaccgctgagcagaaagcccttgcaaccaaacttaaacttcctccaactttcttctgctacaagaatagaccagattatgttagtgaagaagaggaggatgatgaagatttcgaaacagctgtcaagaaacttaatggaaaactatatttggatggctcagaaaaatgtagacccttggaagaaaatacagcagataatgagaaagaatgtattattgtttgggaaaagaaaccaacagttgaagagaaggcaaaagcagatacgttaaaacttccacctacatttttttgtggagtctgtagtgatactgatgaagacaatggaaatggggaagactttcaatcagagcttcaaaaagttcaggaagctcaaaaatctcagacagaagaaataactagcacaactgacagtgtatatacaggtgggactgaagtgatggtaccttctttctgtaaatctgaagaacctgattctattaccaaatccattagttcaccatctgtttcctctgaaactatggacaaacctgtagatttgtcaactagaaaggaaattgatacagattctacaagccaaggggaaagcaagatagtttcatttggatttggaagtagcacagggctctcatttgcagacttggcttccagtaattctggagattttgcttttggttctaaagataaaaatttccaatgggcaaatactggagcagctgtgtttggaacacagtcagtcggaacccagtcagccggtaaagttggtgaagatgaagatggtagtgatgaagaagtagttcataatgaagatatccattttgaaccaatagtgtcactaccagaggtagaagtaaaatctggagaagaagatgaagaaattttgtttaaagagagagccaaactttatagatgggatcgggatgtcagtcagtggaaggagcgcggtgttggagatataaagattctttggcatacaatgaagaattattaccggatcctaatgagaagagaccaggtttttaaagtgtgtgcaaaccacgttattactaaaacaatggaattaaagcccttaaatgtttcaaataatgctttagtttggactgcctcagattatgctgatggagaagcaaaagtagaacagcttgcagtgagatttaaaactaaagaagtagctgattgtttcaagaaaacatttgaagaatgtcagcagaatttaatgaaactccagaaaggacatgtatcactggcagcagaattatcaaaggagaccaatcctgtggtgttttttgatgtttgtgcggacggtgaacctctagggcggataactatggaattattttcaaacattgttcctcggactgctgagaacttcagagcactatgcactggagagaaaggctttggtttcaagaattccatttttcacagagtaattccagattttgtttgccaaggaggagatatcaccaaacatgatggaacaggcggacagtccatttatggagacaaatttgaagatgaaaattttgatgtgaaacatactggtcctggtttactatccatggccaatcaaggccagaataccaataattctcaatttgttataacactgaagaaagcagaacatttggactttaagcatgtagtatttgggtttgttaaggatggcatggatactgtgaaaaagattgaatcatttggttctcccaaagggtctgtttgtcgaagaataactatcacagaatgtggacagatataaaatcattgttgttcatagaaaatttcatctgtataagcagttggattgaagcttagctattacaatttgatagttatgttcagcttttgaaaatggacgtttccgatttacaaatgtaaaattgcagcttatagctgttgtcactttttaatgtgttataattgaccttgcatggtgtgaaataaaagtttaaacactggtgtatttcaggtgtacttgtgtttatgtactcctgacgtattaaaatggaataatactaatcttgttaaaagcaatagacctcaaactattgaaggaatatgatatatgcaatttaattttaattccttttaagatatttggacttcctgcatggatatacttaccatttgaataaagggaccacaacttggataatttaattttaggtttgaaatatatttggtaatcttaactattggtgtactcatttatgcatagagactcgtttatgaatgggtagagccacagaacgtatagagttaaccaaagtgctcttctctagaatctttacacctcctgtgtggttacaagttaactttgtaagtagcgtaccttccttccttaaaatatctagcttcctgtgccctttcatagatattcgattaatttttacattttaaacaagttgactatttcctttaggggttttgtttcaaacttttctgtcatctgtctctactacctcagaaactgcagcttggttctgatgatagaaattgaatttttccttgtagttattgtgataaagtatgaatatttttagaaagtctataccatgttctttcgttaaagatttgctttatacaagattgttgcagtacctttttctggtaaattttgtagcagaaataaaatgacaattcctaagagccactgacatccaaaaaattcattacttacgcttcgggttcattctaaagtaaggaagacaatttaaaggcagtaaattcaaactgctgcataatttccagagctcctagtttctcaagtttgatacacaccaaaaacgtatttggaaatggcttgtatcaaatgttaggcaaattgctaaagaaaagaggatgttcttattggcctactcaatatggaactacaaagaatccaggtagaacacaaaattttgtatattgcaattatgaatattgactgtcttccacccatctgtgttctttcgggtgaaattacctcattttatttagtgaggaaagacaggtttattccctgttacatggggatttggaaattgggtatcctaaagcaagtaactgttcaaccaccagtcaaaagaggggagggatgttgtgcgagtaatgagtgatggtataccatcaccattccactcggccacaaagccagatacttgaaataaacctactccaaatgtatcagttcagtcttgaaccatggattacatatgtttacactaaatatttcaaattggcttatttggaaatctatgtaatataaactgatgtaaagtgtgttgtaacttttcagctgagacagttgatgccttcgtcatgattttagaataaattcttaagttaatgcaagtgctttttaagagactttttacagatttgtatgctttcctaaagcactaaagttacaaattaaaaagctttaaaaactttgaccaaaaatttgacaaaatgacatgtaaactgacttttcccgtattagtattccaaagatgcttaaaagtggcttgtggcatttatgagaaagtctttgtgtcacatttcaggaaaggactttgatttctctttgttatttaatcactgatgtggtctaaacccacgataatatgtatctttccttttaaactggattttatgttgtctcattaaaatctgcttaaagatagaataaaattcattatttgtaaaaaaaaaaaa

SEQ ID NO: 37269 - DNA, 6823 bp, Homo sapiens
tgagacagagtcttactctgtcgcccgggctggagtgcagtggcgtgatctcggctcactgcaagctccacctcctgggttcatgccattctcctccctcagcctccccagtagctgggactacagtaacagtgaaagccttttaggtctcctgacttcagataaacccttgcaaggagatggctatagtggagccaaaccaattcctggtggtcaaaccattgggcctcgaaatacattcaattttggaagcaaaaatgtgtctggaatttcatttacagaaaacatggggtcgagtcagcaaaagaattctggttttcggcgaagtgatgatatgtttactttccatggtccagggaaatcagtatttggaacacccactttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcactttttaaatgcaagtttgaagaagcccagagcattttaaaagccccaggaacaaatgtagccatggcgtcaaatcaggctgtcagaattgtaaaagaacccacaagtcatgataacaaggatatttgcaaatctgatgctggaaacctgaattttgaatttcaggttgcaaagaaagaagggtcttggtggcattgtaacagctgctcattaaagaatgcttcaactgctaagaaatgtgtatcatgccaaaatctaaacccaagcaataaagagctcgttggcccaccattagctgaaactgtttttactcctaaaaccagcccagagaatgttcaagatcgatttgcattggtgactccaaagaaagaaggtcactgggattgtagtatttgtttagtaagaaatgaacctactgtatctaggtgcattgcgtgtcagaatacaaaatctgctaacaaaagtggatcttcatttgttcatcaagcttcatttaaatttggccagggagatcttcctaaacctattaacagtgatttcagatctgttttttctacaaaggaaggacagtgggattgcagtgcatgtttggtacaaaatgaggggagctctacaaaatgtgctgcttgtcagaatccgagaaaacagagtctacctgctacttctattccaacacctgcctcttttaagtttggtacttcagagacaagtaaaactctaaaaagtggatttgaagacatgtttgctaagaaggaaggacagtgggattgcagttcatgcttagtgcgaaatgaagcaaatgctacaagatgtgttgcttgtcagaatccggataaaccaagtccatctacttctgttccagctcctgcctcttttaagtttggtacttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggaaggacagtgggattgcagtgtgtgcttagtaagaaatgaagccagtgctaccaaatgtattgcttgtcagtgtccaagtaaacaaaatcaaacaactgcaatttcaacacctgcctcttcggagataagcaaggctccaaagagtggatttgaaggaatgttcatcaggaaaggacagtgggattgtagtgtttgctgtgtacaaaatgagagttcttccttaaaatgtgtggcttgtgatgcctctaaaccaactcataaacctattgcagaagctccttcagctttcacactgggctcagaaatgaagttgcatgactcttctggaagtcaggtgggaacaggatttaaaagtaatttctcagaaaaagcttctaagtttggcaatacagagcaaggattcaaatttgggcatgtggatcaagaaaattcaccttcatttatgtttcagggttcttctaatacagaatttaagtcaaccaaagaaggattttccatccctgtgtctgctgatggatttaaatttggcatttcggaaccaggaaatcaagaaaagaaaagtgaaaagcctcttgaaaatggtactggcttccaggctcaggatattagtggccagaagaatggccgtggtgtgatttttggccaaacaagtagcacttttacatttgcagatcttgcaaaatcaacttcaggagaaggatttcagtttggcaaaaaagaccccaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcccgaaaaagtagaacttgtaacaggagaagaagatgaaaaagttctgtattcacagcgggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacgatgaacctgaagcctctctctggatcagatagagcatggatgtggttagccagtgatttctctgatggtgatgccaaactagagcagttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactatgatttaagggaagatgctttggatgatagtgtcagtagtagctcagtacatgcttctccattggcaagtagccctgtgagaaaaaatcttttccgttttggtgagtcaacaacaggatttaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcaaaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgactttgcaaaatatgaaagggacagaaagagtatggttgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcaacttcagaagttgaagtgtctagcacatctgaaacaacaccaaaagcagtggtttctcctccaaagtttgtatttggttcagagtctgttaaaagcatttttagtagtgaaaaatcaaaaccatttgcattcggcaacagttcagccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctttgcttcctttccaacggaagaatcttcaatcaactacacatttaaaacaccagaaaaggcaaaagagaagaaaaaacctgaagattctccctcagatgatgatgttctcattgtatatgaactaactccaaccgctgagcagaaagcccttgcaaccaaacttaaacttcctccaactttcttctgctacaagaatagaccagattatgttagtgaagaagaggaggatgatgaagatttcgaaacagctgtcaagaaacttaatggaaaactatatttggatggctcagaaaaatgtagacccttggaagaaaatacagcagataatgagaaagaatgtattattgtttgggaaaagaaaccaacagttgaagagaaggcaaaagcagatacgttaaaacttccacctacatttttttgtggagtctgtagtgatactgatgaagacaatggaaatggggaagactttcaatcagagcttcaaaaagttcaggaagctcaaaaatctcagacagaagaaataactagcacaactgacagtgtatatacaggtgggactgaagtgatggtaccttctttctgtaaatctgaagaacctgattctattaccaaatccattagttcaccatctgtttcctctgaaactatggacaaacctgtagatttgtcaactagaaaggaaattgatacagattctacaagccaaggggaaagcaagatagtttcatttggatttggaagtagcacagggctctcatttgcagacttggcttccagtaattctggagattttgcttttggttctaaagataaaaatttccaatgggcaaatactggagcagctgtgtttggaacacagtcagtcggaacccagtcagccggtaaagttggtgaagatgaagatggtagtgatgaagaagtagttcataatgaagatatccattttgaaccaatagtgtcactaccagaggtagaagtaaaatctggagaagaagatgaagaaattttgtttaaagagagagccaaactttatagatgggatcgggatgtcagtcagtggaaggagcgcggtgttggagatataaagattctttggcatacaatgaagaattattaccggatcctaatgagaagagaccaggtttttaaagtgtgtgcaaaccacgttattactaaaacaatggaattaaagcccttaaatgtttcaaataatgctttagtttggactgcctcagattatgctgatggagaagcaaaagtagaacagcttgcagtgagatttaaaactaaagaagtagctgattgtttcaagaaaacatttgaagaatgtcagcagaatttaatgaaactccagaaaggacatgtatcactggcagcagaattatcaaaggagaccaatcctgtggtgttttttgatgtttgtgcggacggtgaacctctagggcggataactatggaattattttcaaacattgttcctcggactgctgagaacttcagagcactatgcactggagagaaaggctttggtttcaagaattccatttttcacagagtaattccagattttgtttgccaaggaggagatatcaccaaacatgatggaacaggcggacagtccatttatggagacaaatttgaagatgaaaattttgatgtgaaacatactggtcctggtttactatccatggccaatcaaggccagaataccaataattctcaatttgttataacactgaagaaagcagaacatttggactttaagcatgtagtatttgggtttgttaaggatggcatggatactgtgaaaaagattgaatcatttggttctcccaaagggtctgtttgtcgaagaataactatcacagaatgtggacagatataaaatcattgttgttcatagaaaatttcatctgtataagcagttggattgaagcttagctattacaatttgatagttatgttcagcttttgaaaatggacgtttccgatttacaaatgtaaaattgcagcttatagctgttgtcactttttaatgtgttataattgaccttgcatggtgtgaaataaaagtttaaacactggtgta

SEQ ID NO: 37270 - DNA, 11667 bp, Homo sapiens
acacagtggtcctccgccggctacggcgctgcgtcactggtttgcaggcgctttcctcttggaagtggcgactgctgcgggcctgagcgctggtctcacgcgcctcgggagccaggttggcggcgcgatgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagacaaagccgttgaatgttacaggcgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactgcaaagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagagattgttgaaacttttgccaacaaaagcgggcagtctgcattatatgatgctctgttttctagtcagtcacctaaggatacatcttttcttggtagcgatgatattggaaacattgatgtacgagaaccagagcttgaagatttgactagatacgatgttggtgctattcgagcacataatggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaacgtagcaaaattgagacttctagttcagcatgaaataaacactctaagagcccaggaaaaacatggccttcaacctgctctgcttgtacattgggcagaatgccttcagaaaacgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaattcagtcatgcaggaactcgaagactatagtgaaggaggtcctctctataaaaatggttctttgcgaaatgcagattcagaaataaaacattctacaccgtctcctaccagatattcactatcaccaagtaaaagttacaagtattctcccaaaacaccacctcgatgggcagaagatcagaattctttactgaaaatgatttgccaacaagtagaggccattaagaaagaaatgcaggagttgaaactaaatagcagtaactcagcatcccctcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggcccagtctatggcatgaataggcttccaccccaacagcatatttatgcctatccgcaacagatgcacacaccgccagtgcaaagctcatctgcttgtatgttctctcaggagatgtatggtcctcctgcattgcgttttgagtctcctgcaacgggaattctatcgcccaggggtgatgattactttaattacaatgttcaacagacaagcacaaatccacctttgccagaaccaggatatttcacaaaacctccgattgcagctcatgcttcaagatctgcagaatctaagactatagaatttgggaaaactaattttgttcagcccatgccgggtgaaggattaaggccatctttgccaacacaagcacacacaacacagccaactccttttaaatttaactcaaatttcaaatcaaatgatggtgacttcacgttttcctcaccacaggttgtgacacagccccctcctgcagcttacagtaacagtgaaagccttttaggtctcctgacttcagataaacccttgcaaggagatggctatagtggagccaaaccaattcctggtggtcaaaccattgggcctcgaaatacattcaattttggaagcaaaaatgtgtctggaatttcatttacagaaaacatggggtcgagtcagcaaaagaattctggttttcggcgaagtgatgatatgtttactttccatggtccagggaaatcagtatttggaacacccactttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcactttttaaatgcaagtttgaagaagcccagagcattttaaaagccccaggaacaaatgtagccatggcgtcaaatcaggctgtcagaattgtaaaagaacccacaagtcatgataacaaggatatttgcaaatctgatgctggaaacctgaattttgaatttcaggttgcaaagaaagaagggtcttggtggcattgtaacagctgctcattaaagaatgcttcaactgctaagaaatgtgtatcatgccaaaatctaaacccaagcaataaagagctcgttggcccaccattagctgaaactgtttttactcctaaaaccagcccagagaatgttcaagatcgatttgcattggtgactccaaagaaagaaggtcactgggattgtagtatttgtttagtaagaaatgaacctactgtatctaggtgcattgcgtgtcagaatacaaaatctgctaacaaaagtggatcttcatttgttcatcaagcttcatttaaatttggccagggagatcttcctaaacctattaacagtgatttcagatctgttttttctacaaaggaaggacagtgggattgcagtgcatgtttggtacaaaatgaggggagctctacaaaatgtgctgcttgtcagaatccgagaaaacagagtctacctgctacttctattccaacacctgcctcttttaagtttggtacttcagagacaagtaaaactctaaaaagtggatttgaagacatgtttgctaagaaggaaggacagtgggattgcagttcatgcttagtgcgaaatgaagcaaatgctacaagatgtgttgcttgtcagaatccggataaaccaagtccatctacttctgttccagctcctgcctcttttaagtttggtacttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggaaggacagtgggattgcagtgtgtgcttagtaagaaatgaagccagtgctaccaaatgtattgcttgtcagtgtccaagtaaacaaaatcaaacaactgcaatttcaacacctgcctcttcggagataagcaaggctccaaagagtggatttgaaggaatgttcatcaggaaaggacagtgggattgtagtgtttgctgtgtacaaaatgagagttcttccttaaaatgtgtggcttgtgatgcctctaaaccaactcataaacctattgcagaagctccttcagctttcacactgggctcagaaatgaagttgcatgactcttctggaagtcaggtgggaacaggatttaaaagtaatttctcagaaaaagcttctaagtttggcaatacagagcaaggattcaaatttgggcatgtggatcaagaaaattcaccttcatttatgtttcagggttcttctaatacagaatttaagtcaaccaaagaaggattttccatccctgtgtctgctgatggatttaaatttggcatttcggaaccaggaaatcaagaaaagaaaagtgaaaagcctcttgaaaatggtactggcttccaggctcaggatattagtggccagaagaatggccgtggtgtgatttttggccaaacaagtagcacttttacatttgcagatcttgcaaaatcaacttcaggagaaggatttcagtttggcaaaaaagaccccaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcccgaaaaagtagaacttgtaacaggagaagaagatgaaaaagttctgtattcacagcgggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacgatgaacctgaagcctctctctggatcagatagagcatggatgtggttagccagtgatttctctgatggtgatgccaaactagagcagttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactatgatttaagggaagatgctttggatgatagtgtcagtagtagctcagtacatgcttctccattggcaagtagccctgtgagaaaaaatcttttccgttttggtgagtcaacaacaggatttaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcaaaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgactttgcaaaatatgaaagggacagaaagagtatggttgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcaacttcagaagttgaagtgtctagcacatctgaaacaacaccaaaagcagtggtttctcctccaaagtttgtatttggttcagagtctgttaaaagcatttttagtagtgaaaaatcaaaaccatttgcattcggcaacagttcagccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctttgcttcctttccaacggaagaatcttcaatcaactacacatttaaaacaccagaaaaggcaaaagagaagaaaaaacctgaagattctccctcagatgatgatgttctcattgtatatgaactaactccaaccgctgagcagaaagcccttgcaaccaaacttaaacttcctccaactttcttctgctacaagaatagaccagattatgttagtgaagaagaggaggatgatgaagatttcgaaacagctgtcaagaaacttaatggaaaactatatttggatggctcagaaaaatgtagacccttggaagaaaatacagcagataatgagaaagaatgtattattgtttgggaaaagaaaccaacagttgaagagaaggcaaaagcagatacgttaaaacttccacctacatttttttgtggagtctgtagtgatactgatgaagacaatggaaatggggaagactttcaatcagagcttcaaaaagttcaggaagctcaaaaatctcagacagaagaaataactagcacaactgacagtgtatatacaggtgggactgaagtgatggtaccttctttctgtaaatctgaagaacctgattctattaccaaatccattagttcaccatctgtttcctctgaaactatggacaaacctgtagatttgtcaactagaaaggaaattgatacagattctacaagccaaggggaaagcaagatagtttcatttggatttggaagtagcacagggctctcatttgcagacttggcttccagtaattctggagattttgcttttggttctaaagtcggaacccagtcagccggtaaagttggtgaagatgaagatggtagtgatgaagaagtagttcataatgaagatatccattttgaaccaatagtgtcactaccagaggtagaagtaaaatctggagaagaagatgaagaaattttgtttaaagagagagccaaactttatagatgggatcgggatgtcagtcagtggaaggagcgcggtgttggagatataaagattctttggcatacaatgaagaattattaccggatcctaatgagaagagaccaggtttttaaagtgtgtgcaaaccacgttattactaaaacaatggaattaaagcccttaaatgtttcaaataatgctttagtttggactgcctcagattatgctgatggagaagcaaaagtagaacagcttgcagtgagatttaaaactaaagaagtagctgattgtttcaagaaaacatttgaagaatgtcagcagaatttaatgaaactccagaaaggacatgtatcactggcagcagaattatcaaaggagaccaatcctgtggtgttttttgatgtttgtgcggacggtgaacctctagggcggataactatggaattattttcaaacattgttcctcggactgctgagaacttcagagcactatgcactggagagaaaggctttggtttcaagaattccatttttcacagagtaattccagattttgtttgccaaggaggagatatcaccaaacatgatggaacaggcggacagtccatttatggagacaaatttgaagatgaaaattttgatgtgaaacatactggtcctggtttactatccatggccaatcaaggccagaataccaataattctcaatttgttataacactgaagaaagcagaacatttggactttaagcatgtagtatttgggtttgttaaggatggcatggatactgtgaaaaagattgaatcatttggttctcccaaagggtctgtttgtcgaagaataactatcacagaatgtggacagatataaaatcattgttgttcatagaaaatttcatctgtataagcagttggattgaagcttagctattacaatttgatagttatgttcagcttttgaaaatggacgtttccgatttacaaatgtaaaattgcagcttatagctgttgtcactttttaatgtgttataattgaccttgcatggtgtgaaataaaagtttaaacactggtgtatttcaggtgtacttgtgtttatgtactcctgacgtattaaaatggaataatactaatcttgttaaaagcaatagacctcaaactattgaaggaatatgatatatgcaatttaattttaattccttttaagatatttggacttcctgcatggatatacttaccatttgaataaagggaccacaacttggataatttaattttaggtttgaaatatatttggtaatcttaactattggtgtactcatttatgcatagagactcgtttatgaatgggtagagccacagaacgtatagagttaaccaaagtgctcttctctagaatctttacacctcctgtgtggttacaagttaactttgtaagtagcgtaccttccttccttaaaatatctagcttcctgtgccctttcatagatattcgattaatttttacattttaaacaagttgactatttcctttaggggttttgtttcaaacttttctgtcatctgtctctactacctcagaaactgcagcttggttctgatgatagaaattgaatttttccttgtagttattgtgataaagtatgaatatttttagaaagtctataccatgttctttcgttaaagatttgctttatacaagattgttgcagtacctttttctggtaaattttgtagcagaaataaaatgacaattcctaagagccactgacatccaaaaaattcattacttacgcttcgggttcattctaaagtaaggaagacaatttaaaggcagtaaattcaaactgctgcataatttccagagctcctagtttctcaagtttgatacacaccaaaaacgtatttggaaatggcttgtatcaaatgttaggcaaattgctaaagaaaagaggatgttcttattggcctactcaatatggaactacaaagaatccaggtagaacacaaaattttgtatattgcaattatgaatattgactgtcttccacccatctgtgttctttcgggtgaaattacctcattttatttagtgaggaaagacaggtttattccctgttacatggggatttggaaattgggtatcctaaagcaagtaactgttcaaccaccagtcaaaagaggggagggatgttgtgcgagtaatgagtgatggtataccatcaccattccactcggccacaaagccagatacttgaaataaacctactccaaatgtatcagttcagtcttgaaccatggattacatatgtttacactaaatatttcaaattggcttatttggaaatctatgtaatataaactgatgtaaagtgtgttgtaacttttcagctgagacagttgatgccttcgtcatgattttagaataaattcttaagttaatgcaagtgctttttaagagactttttacagatttgtatgctttcctaaagcactaaagttacaaattaaaaagctttaaaaactttgaccaaaaatttgacaaaatgacatgtaaactgacttttcccgtattagtattccaaagatgcttaaaagtggcttgtggcatttatgagaaagtctttgtgtcacatttcaggaaaggactttgatttctctttgttatttaatcactgatgtggtctaaacccacgataatatgtatctttccttttaaactggattttatgttgtctcattaaaatctgcttaaagatagaataaaattcattatttgtaaaaaaaaaaaa

SEQ ID NO: 37271 - DNA, 11667 bp, Homo sapiens
acacagtggtcctccgccggctacggcgctgcgtcactggtttgcaggcgctttcctcttggaagtggcgactgctgcgggcctgagcgctggtctcacgcgcctcgggagccaggttggcggcgcgatgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagacaaagccgttgaatgttacaggcgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactgcaaagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagagattgttgaaacttttgccaacaaaagcgggcagtctgcattatatgatgctctgttttctagtcagtcacctaaggatacatcttttcttggtagcgatgatattggaaacattgatgtacgagaaccagagcttgaagatttgactagatacgatgttggtgctattcgagcacataatggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaacgtagcaaaattgagacttctagttcagcatgaaataaacactctaagagcccaggaaaaacatggccttcaacctgctctgcttgtacattgggcagaatgccttcagaaaacgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaattcagtcatgcaggaactcgaagactatagtgaaggaggtcctctctataaaaatggttctttgcgaaatgcagattcagaaataaaacattctacaccgtctcctaccagatattcactatcaccaagtaaaagttacaagtattctcccaaaacaccacctcgatgggcagaagatcagaattctttactgaaaatgatttgccaacaagtagaggccattaagaaagaaatgcaggagttgaaactaaatagcagtaactcagcatcccctcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggcccagtctatggcatgaataggcttccaccccaacagcatatttatgcctatccgcaacagatgcacacaccgccagtgcaaagctcatctgcttgtatgttctctcaggagatgtatggtcctcctgcattgcgttttgagtctcctgcaacgggaattctatcgcccaggggtgatgattactttaattacaatgttcaacagacaagcacaaatccacctttgccagaaccaggatatttcacaaaacctccgattgcagctcatgcttcaagatctgcagaatctaagactatagaatttgggaaaactaattttgttcagcccatgccgggtgaaggattaaggccatctttgccaacacaagcacacacaacacagccaactccttttaaatttaactcaaatttcaaatcaaatgatggtgacttcacgttttcctcaccacaggttgtgacacagccccctcctgcagcttacagtaacagtgaaagccttttaggtctcctgacttcagataaacccttgcaaggagatggctatagtggagccaaaccaattcctggtggtcaaaccattgggcctcgaaatacattcaattttggaagcaaaaatgtgtctggaatttcatttacagaaaacatggggtcgagtcagcaaaagaattctggttttcggcgaagtgatgatatgtttactttccatggtccagggaaatcagtatttggaacacccactttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcactttttaaatgcaagtttgaagaagcccagagcattttaaaagccccaggaacaaatgtagccatggcgtcaaatcaggctgtcagaattgtaaaagaacccacaagtcatgataacaaggatatttgcaaatctgatgctggaaacctgaattttgaatttcaggttgcaaagaaagaagggtcttggtggcattgtaacagctgctcattaaagaatgcttcaactgctaagaaatgtgtatcatgccaaaatctaaacccaagcaataaagagctcgttggcccaccattagctgaaactgtttttactcctaaaaccagcccagagaatgttcaagatcgatttgcattggtgactccaaagaaagaaggtcactgggattgtagtatttgtttagtaagaaatgaacctactgtatctaggtgcattgcgtgtcagaatacaaaatctgctaacaaaagtggatcttcatttgttcatcaagcttcatttaaatttggccagggagatcttcctaaacctattaacagtgatttcagatctgttttttctacaaaggaaggacagtgggattgcagtgcatgtttggtacaaaatgaggggagctctacaaaatgtgctgcttgtcagaatccgagaaaacagagtctacctgctacttctattccaacacctgcctcttttaagtttggtacttcagagacaagtaaaactctaaaaagtggatttgaagacatgtttgctaagaaggaaggacagtgggattgcagttcatgcttagtgcgaaatgaagcaaatgctacaagatgtgttgcttgtcagaatccggataaaccaagtccatctacttctgttccagctcctgcctcttttaagtttggtacttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggaaggacagtgggattgcagtgtgtgcttagtaagaaatgaagccagtgctaccaaatgtattgcttgtcagtgtccaagtaaacaaaatcaaacaactgcaatttcaacacctgcctcttcggagataagcaaggctccaaagagtggatttgaaggaatgttcatcaggaaaggacagtgggattgtagtgtttgctgtgtacaaaatgagagttcttccttaaaatgtgtggcttgtgatgcctctaaaccaactcataaacctattgcagaagctccttcagctttcacactgggctcagaaatgaagttgcatgactcttctggaagtcaggtgggaacaggatttaaaagtaatttctcagaaaaagcttctaagtttggcaatacagagcaaggattcaaatttgggcatgtggatcaagaaaattcaccttcatttatgtttcagggttcttctaatacagaatttaagtcaaccaaagaaggattttccatccctgtgtctgctgatggatttaaatttggcatttcggaaccaggaaatcaagaaaagaaaagtgaaaagcctcttgaaaatggtactggcttccaggctcaggatattagtggccagaagaatggccgtggtgtgatttttggccaaacaagtagcacttttacatttgcagatcttgcaaaatcaacttcaggagaaggatttcagtttggcaaaaaagaccccaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcccgaaaaagtagaacttgtaacaggagaagaagatgaaaaagttctgtattcacagcgggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacgatgaacctgaagcctctctctggatcagatagagcatggatgtggttagccagtgatttctctgatggtgatgccaaactagagcagttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactatgatttaagggaagatgctttggatgatagtgtcagtagtagctcagtacatgcttctccattggcaagtagccctgtgagaaaaaatcttttccgttttggtgagtcaacaacaggatttaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcaaaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgactttgcaaaatatgaaagggacagaaagagtatggttgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcaacttcagaagttgaagtgtctagcacatctgaaacaacaccaaaagcagtggtttctcctccaaagtttgtatttggttcagagtctgttaaaagcatttttagtagtgaaaaatcaaaaccatttgcattcggcaacagttcagccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctttgcttcctttccaacggaagaatcttcaatcaactacacatttaaaacaccagaaaaggcaaaagagaagaaaaaacctgaagattctccctcagatgatgatgttctcattgtatatgaactaactccaaccgctgagcagaaagcccttgcaaccaaacttaaacttcctccaactttcttctgctacaagaatagaccagattatgttagtgaagaagaggaggatgatgaagatttcgaaacagctgtcaagaaacttaatggaaaactatatttggatggctcagaaaaatgtagacccttggaagaaaatacagcagataatgagaaagaatgtattattgtttgggaaaagaaaccaacagttgaagagaaggcaaaagcagatacgttaaaacttccacctacatttttttgtggagtctgtagtgatactgatgaagacaatggaaatggggaagactttcaatcagagcttcaaaaagttcaggaagctcaaaaatctcagacagaagaaataactagcacaactgacagtgtatatacaggtgggactgaagtgatggtaccttctttctgtaaatctgaagaacctgattctattaccaaatccattagttcaccatctgtttcctctgaaactatggacaaacctgtagatttgtcaactagaaaggaaattgatacagattctacaagccaaggggaaagcaagatagtttcatttggatttggaagtagcacagggctctcatttgcagacttggcttccagtaattctggagattttgcttttggttctaaagataaaaatttccaatgggcaaatactggagcagctgtgtttggaacacagtcagtcggaacccagtcagccggtaaagttggtgaagatgaagatggtagtgatgaagaagtagttcataatgaagatatccattttgaaccaatagtgtcactaccagaggtagaagtaaaatctggagaagaagatgaagaaattttgtttaaagagagagccaaactttatagatgggatcgggatgtcagtcagtggaaggagcgcggtgttggagatataaagattctttggcatacaatgaagaattattaccggatcctaatgagaagagaccaggtttttaaagtgtgtgcaaaccacgttattactaaaacaatggaattaaagcccttaaatgtttcaaataatgctttagtttggactgcctcagattatgctgatggagaagcaaaagtagaacagcttgcagtgagatttaaaactaaagaagtagctgattgtttcaagtcactggcagcagaattatcaaaggagaccaatcctgtggtgttttttgatgtttgtgcggacggtgaacctctagggcggataactatggaattattttcaaacattgttcctcggactgctgagaacttcagagcactatgcactggagagaaaggctttggtttcaagaattccatttttcacagagtaattccagattttgtttgccaaggaggagatatcaccaaacatgatggaacaggcggacagtccatttatggagacaaatttgaagatgaaaattttgatgtgaaacatactggtcctggtttactatccatggccaatcaaggccagaataccaataattctcaatttgttataacactgaagaaagcagaacatttggactttaagcatgtagtatttgggtttgttaaggatggcatggatactgtgaaaaagattgaatcatttggttctcccaaagggtctgtttgtcgaagaataactatcacagaatgtggacagatataaaatcattgttgttcatagaaaatttcatctgtataagcagttggattgaagcttagctattacaatttgatagttatgttcagcttttgaaaatggacgtttccgatttacaaatgtaaaattgcagcttatagctgttgtcactttttaatgtgttataattgaccttgcatggtgtgaaataaaagtttaaacactggtgtatttcaggtgtacttgtgtttatgtactcctgacgtattaaaatggaataatactaatcttgttaaaagcaatagacctcaaactattgaaggaatatgatatatgcaatttaattttaattccttttaagatatttggacttcctgcatggatatacttaccatttgaataaagggaccacaacttggataatttaattttaggtttgaaatatatttggtaatcttaactattggtgtactcatttatgcatagagactcgtttatgaatgggtagagccacagaacgtatagagttaaccaaagtgctcttctctagaatctttacacctcctgtgtggttacaagttaactttgtaagtagcgtaccttccttccttaaaatatctagcttcctgtgccctttcatagatattcgattaatttttacattttaaacaagttgactatttcctttaggggttttgtttcaaacttttctgtcatctgtctctactacctcagaaactgcagcttggttctgatgatagaaattgaatttttccttgtagttattgtgataaagtatgaatatttttagaaagtctataccatgttctttcgttaaagatttgctttatacaagattgttgcagtacctttttctggtaaattttgtagcagaaataaaatgacaattcctaagagccactgacatccaaaaaattcattacttacgcttcgggttcattctaaagtaaggaagacaatttaaaggcagtaaattcaaactgctgcataatttccagagctcctagtttctcaagtttgatacacaccaaaaacgtatttggaaatggcttgtatcaaatgttaggcaaattgctaaagaaaagaggatgttcttattggcctactcaatatggaactacaaagaatccaggtagaacacaaaattttgtatattgcaattatgaatattgactgtcttccacccatctgtgttctttcgggtgaaattacctcattttatttagtgaggaaagacaggtttattccctgttacatggggatttggaaattgggtatcctaaagcaagtaactgttcaaccaccagtcaaaagaggggagggatgttgtgcgagtaatgagtgatggtataccatcaccattccactcggccacaaagccagatacttgaaataaacctactccaaatgtatcagttcagtcttgaaccatggattacatatgtttacactaaatatttcaaattggcttatttggaaatctatgtaatataaactgatgtaaagtgtgttgtaacttttcagctgagacagttgatgccttcgtcatgattttagaataaattcttaagttaatgcaagtgctttttaagagactttttacagatttgtatgctttcctaaagcactaaagttacaaattaaaaagctttaaaaactttgaccaaaaatttgacaaaatgacatgtaaactgacttttcccgtattagtattccaaagatgcttaaaagtggcttgtggcatttatgagaaagtctttgtgtcacatttcaggaaaggactttgatttctctttgttatttaatcactgatgtggtctaaacccacgataatatgtatctttccttttaaactggattttatgttgtctcattaaaatctgcttaaagatagaataaaattcattatttgtaaaaaaaaaaaa

SEQ ID NO: 37272 - DNA, 11669 bp, Homo sapiens
acacagtggtcctccgccggctacggcgctgcgtcactggtttgcaggcgctttcctcttggaagtggcgactgctgcgggcctgagcgctggtctcacgcgcctcgggagccaggttggcggcgcgatgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagacaaagccgttgaatgttacaggcgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactgcaaagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagagattgttgaaacttttgccaacaaaagcgggcagtctgcattatatgatgctctgttttctagtcagtcacctaaggatacatcttttcttggtagcgatgatattggaaacattgatgtacgagaaccagagcttgaagatttgactagatacgatgttggtgctattcgagcacataatggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaacgtagcaaaattgagacttctagttcagcatgaaataaacactctaagagcccaggaaaaacatggccttcaacctgctctgcttgtacattgggcagaatgccttcagaaaacgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaattcagtcatgcaggaactcgaagactatagtgaaggaggtcctctctataaaaatggttctttgcgaaatgcagattcagaaataaaacattctacaccgtctcctaccagatattcactatcaccaagtaaaagttacaagtattctcccaaaacaccacctcgatgggcagaagatcagaattctttactgaaaatgatttgccaacaagtagaggccattaagaaagaaatgcaggagttgaaactaaatagcagtaactcagcatcccctcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggcccagtctatggcatgaataggcttccaccccaacagcatatttatgcctatccgcaacagatgcacacaccgccagtgcaaagctcatctgcttgtatgttctctcaggagatgtatggtcctcctgcattgcgttttgagtctcctgcaacgggaattctatcgcccaggggtgatgattactttaattacaatgttcaacagacaagcacaaatccacctttgccagaaccaggatatttcacaaaacctccgattgcagctcatgcttcaagatctgcagaatctaagactatagaatttgggaaaactaattttgttcagcccatgccgggtgaaggattaaggccatctttgccaacacaagcacacacaacacagccaactccttttaaatttaactcaaatttcaaatcaaatgatggtgacttcacgttttcctcaccacaggttgtgacacagccccctcctgcagcttacagtaacagtgaaagccttttaggtctcctgacttcagataaacccttgcaaggagatggctatagtggagccaaaccaattcctggtggtcaaaccattgggcctcgaaatacattcaattttggaagcaaaaatgtgtctggaatttcatttacagaaaacatggggtcgagtcagcaaaagaattctggttttcggcgaagtgatgatatgtttactttccatggtccagggaaatcagtatttggaacacccactttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcactttttaaatgcaagtttgaagaagcccagagcattttaaaagccccaggaacaaatgtagccatggcgtcaaatcaggctgtcagaattgtaaaagaacccacaagtcatgataacaaggatatttgcaaatctgatgctggaaacctgaattttgaatttcaggttgcaaagaaagaagggtcttggtggcattgtaacagctgctcattaaagaatgcttcaactgctaagaaatgtgtatcatgccaaaatctaaacccaagcaataaagagctcgttggcccaccattagctgaaactgtttttactcctaaaaccagcccagagaatgttcaagatcgatttgcattggtgactccaaagaaagaaggtcactgggattgtagtatttgtttagtaagaaatgaacctactgtatctaggtgcattgcgtgtcagaatacaaaatctgctaacaaaagtggatcttcatttgttcatcaagcttcatttaaatttggccagggagatcttcctaaacctattaacagtgatttcagatctgttttttctacaaaggaaggacagtgggattgcagtgcatgtttggtacaaaatgaggggagctctacaaaatgtgctgcttgtcagaatccgagaaaacagagtctacctgctacttctattccaacacctgcctcttttaagtttggtacttcagagacaagtaaaactctaaaaagtggatttgaagacatgtttgctaagaaggaaggacagtgggattgcagttcatgcttagtgcgaaatgaagcaaatgctacaagatgtgttgcttgtcagaatccggataaaccaagtccatctacttctgttccagctcctgcctcttttaagtttggtacttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggaaggacagtgggattgcagtgtgtgcttagtaagaaatgaagccagtgctaccaaatgtattgcttgtcagtgtccaagtaaacaaaatcaaacaactgcaatttcaacacctgcctcttcggagataagcaaggctccaaagagtggatttgaaggaatgttcatcaggaaaggacagtgggattgtagtgtttgctgtgtacaaaatgagagttcttccttaaaatgtgtggcttgtgatgcctctaaaccaactcataaacctattgcagaagctccttcagctttcacactgggctcagaaatgaagttgcatgactcttctggaagtcaggtgggaacaggatttaaaagtaatttctcagaaaaagcttctaagtttggcaatacagagcaaggattcaaatttgggcatgtggatcaagaaaattcaccttcatttatgtttcagggttcttctaatacagaatttaagtcaaccaaagaaggattttccatccctgtgtctgctgatggatttaaatttggcatttcggaaccaggaaatcaagaaaagaaaagtgaaaagcctcttgaaaatggtactggcttccaggctcaggatattagtggccagaagaatggccgtggtgtgatttttggccaaacaagtagcacttttacatttgcagatcttgcaaaatcaacttcaggagaaggatttcagtttggcaaaaaagaccccaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcccgaaaaagtagaacttgtaacaggagaagaagatgaaaaagttctgtattcacagcgggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacgatgaacctgaagcctctctctggatcagatagagcatggatgtggttagccagtgatttctctgatggtgatgccaaactagagcagttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactatgatttaagggaagatgctttggatgatagtgtcagtagtagctcagtacatgcttctccattggcaagtagccctgtgagaaaaaatcttttccgttttggtgagtcaacaacaggatttaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcaaaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgactttgcaaaatatgaaagggacagaaagagtatggttgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcaacttcagaagttgaagtgtctagcacatctgaaacaacaccaaaagcagtggtttctcctccaaagtttgtatttggttcagagtctgttaaaagcatttttagtagtgaaaaatcaaaaccatttgcattcggcaacagttcagccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctttgcttcctttccaacggaagaatcttcaatcaactacacatttaaaacaccagaaaaggcaaaagagaagaaaaaacctgaagattctccctcagatgatgatgttctcattgtatatgaactaactccaaccgctgagcagaaagcccttgcaaccaaacttaaacttcctccaactttcttctgctacaagaatagaccagattatgttagtgaagaagaggaggatgatgaagatttcgaaacagctgtcaagaaacttaatggaaaactatatttggatggctcagaaaaatgtagacccttggaagaaaatacagcagataatgagaaagaatgtattattgtttgggaaaagaaaccaacagttgaagagaaggcaaaagcagatacgttaaaacttccacctacatttttttgtggagtctgtagtgatactgatgaagacaatggaaatggggaagactttcaatcagagcttcaaaaagttcaggaagctcaaaaatctcagacagaagaaataactagcacaactgacagtgtatatacaggtgggactgaagtgatggtaccttctttctgtaaatctgaagaacctgattctattaccaaatccattagttcaccatctgtttcctctgaaactatggacaaacctgtagatttgtcaactagaaaggaaattgatacagattctacaagccaaggggaaagcaagatagtttcatttggatttggaagtagcacagggctctcatttgcagacttggcttccagtaattctggagattttgcttttggttctaaagataaaaatttccaatgggcaaatactggagcagctgtgtttggaacacagtcagtcggaacccagtcagccggtaaagttggtgaagatgaagatggtagtgatgaagaagtagttcataatgaagatatccattttgaaccaatagtgtcactaccagaggtagaagtaaaatctggagaagaagatgaagaaattttgtttaaagagagagccaaactttatagatgggatcgggatgtcagtcagtggaaggagcgcggtgttggagatataaagattctttggcatacaatgaagaattattaccggatcctaatgagaagagaccaggtttttaaagtgtgtgcaaaccacgttattactaaaacaatggaattaaagcccttaaatgtttcaaataatgctttagtttggactgcctcagattatgctgatggagaagcaaaagtagaacagcttgcagtgagatttagaatttaatgaaactccagaaaggacatgtatcactggcagcagaattatcaaaggagaccaatcctgtggtgttttttgatgtttgtgcggacggtgaacctctagggcggataactatggaattattttcaaacattgttcctcggactgctgagaacttcagagcactatgcactggagagaaaggctttggtttcaagaattccatttttcacagagtaattccagattttgtttgccaaggaggagatatcaccaaacatgatggaacaggcggacagtccatttatggagacaaatttgaagatgaaaattttgatgtgaaacatactggtcctggtttactatccatggccaatcaaggccagaataccaataattctcaatttgttataacactgaagaaagcagaacatttggactttaagcatgtagtatttgggtttgttaaggatggcatggatactgtgaaaaagattgaatcatttggttctcccaaagggtctgtttgtcgaagaataactatcacagaatgtggacagatataaaatcattgttgttcatagaaaatttcatctgtataagcagttggattgaagcttagctattacaatttgatagttatgttcagcttttgaaaatggacgtttccgatttacaaatgtaaaattgcagcttatagctgttgtcactttttaatgtgttataattgaccttgcatggtgtgaaataaaagtttaaacactggtgtatttcaggtgtacttgtgtttatgtactcctgacgtattaaaatggaataatactaatcttgttaaaagcaatagacctcaaactattgaaggaatatgatatatgcaatttaattttaattccttttaagatatttggacttcctgcatggatatacttaccatttgaataaagggaccacaacttggataatttaattttaggtttgaaatatatttggtaatcttaactattggtgtactcatttatgcatagagactcgtttatgaatgggtagagccacagaacgtatagagttaaccaaagtgctcttctctagaatctttacacctcctgtgtggttacaagttaactttgtaagtagcgtaccttccttccttaaaatatctagcttcctgtgccctttcatagatattcgattaatttttacattttaaacaagttgactatttcctttaggggttttgtttcaaacttttctgtcatctgtctctactacctcagaaactgcagcttggttctgatgatagaaattgaatttttccttgtagttattgtgataaagtatgaatatttttagaaagtctataccatgttctttcgttaaagatttgctttatacaagattgttgcagtacctttttctggtaaattttgtagcagaaataaaatgacaattcctaagagccactgacatccaaaaaattcattacttacgcttcgggttcattctaaagtaaggaagacaatttaaaggcagtaaattcaaactgctgcataatttccagagctcctagtttctcaagtttgatacacaccaaaaacgtatttggaaatggcttgtatcaaatgttaggcaaattgctaaagaaaagaggatgttcttattggcctactcaatatggaactacaaagaatccaggtagaacacaaaattttgtatattgcaattatgaatattgactgtcttccacccatctgtgttctttcgggtgaaattacctcattttatttagtgaggaaagacaggtttattccctgttacatggggatttggaaattgggtatcctaaagcaagtaactgttcaaccaccagtcaaaagaggggagggatgttgtgcgagtaatgagtgatggtataccatcaccattccactcggccacaaagccagatacttgaaataaacctactccaaatgtatcagttcagtcttgaaccatggattacatatgtttacactaaatatttcaaattggcttatttggaaatctatgtaatataaactgatgtaaagtgtgttgtaacttttcagctgagacagttgatgccttcgtcatgattttagaataaattcttaagttaatgcaagtgctttttaagagactttttacagatttgtatgctttcctaaagcactaaagttacaaattaaaaagctttaaaaactttgaccaaaaatttgacaaaatgacatgtaaactgacttttcccgtattagtattccaaagatgcttaaaagtggcttgtggcatttatgagaaagtctttgtgtcacatttcaggaaaggactttgatttctctttgttatttaatcactgatgtggtctaaacccacgataatatgtatctttccttttaaactggattttatgttgtctcattaaaatctgcttaaagatagaataaaattcattatttgtaaaaaaaaaaaa

SEQ ID NO: 37273 - DNA, 11691 bp, Homo sapiens
acacagtggtcctccgccggctacggcgctgcgtcactggtttgcaggcgctttcctcttggaagtggcgactgctgcgggcctgagcgctggtctcacgcgcctcgggagccaggttggcggcgcgatgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagacaaagccgttgaatgttacaggcgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactgcaaagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagagattgttgaaacttttgccaacaaaagcgggcagtctgcattatatgatgctctgttttctagtcagtcacctaaggatacatcttttcttggtagcgatgatattggaaacattgatgtacgagaaccagagcttgaagatttgactagatacgatgttggtgctattcgagcacataatggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaacgtagcaaaattgagacttctagttcagcatgaaataaacactctaagagcccaggaaaaacatggccttcaacctgctctgcttgtacattgggcagaatgccttcagaaaacgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaattcagtcatgcaggaactcgaagactatagtgaaggaggtcctctctataaaaatggttctttgcgaaatgcagattcagaaataaaacattctacaccgtctcctaccagatattcactatcaccaagtaaaagttacaagtattctcccaaaacaccacctcgatgggcagaagatcagaattctttactgaaaatgatttgccaacaagtagaggccattaagaaagaaatgcaggagttgaaactaaatagcagtaactcagcatcccctcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggcccagtctatggcatgaataggcttccaccccaacagcatatttatgcctatccgcaacagatgcacacaccgccagtgcaaagctcatctgcttgtatgttctctcaggagatgtatggtcctcctgcattgcgttttgagtctcctgcaacgggaattctatcgcccaggggtgatgattactttaattacaatgttcaacagacaagcacaaatccacctttgccagaaccaggatatttcacaaaacctccgattgcagctcatgcttcaagatctgcagaatctaagactatagaatttgggaaaactaattttgttcagcccatgccgggtgaaggattaaggccatctttgccaacacaagcacacacaacacagccaactccttttaaatttaactcaaatttcaaatcaaatgatggtgacttcacgttttcctcaccacaggttgtgacacagccccctcctgcagcttacagtaacagtgaaagccttttaggtctcctgacttcagataaacccttgcaaggagatggctatagtggagccaaaccaattcctggtggtcaaaccattgggcctcgaaatacattcaattttggaagcaaaaatgtgtctggaatttcatttacagaaaacatggggtcgagtcagcaaaagaattctggttttcggcgaagtgatgatatgtttactttccatggtccagggaaatcagtatttggaacacccactttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcactttttaaatgcaagtttgaagaagcccagagcattttaaaagccccaggaacaaatgtagccatggcgtcaaatcaggctgtcagaattgtaaaagaacccacaagtcatgataacaaggatatttgcaaatctgatgctggaaacctgaattttgaatttcaggttgcaaagaaagaagggtcttggtggcattgtaacagctgctcattaaagaatgcttcaactgctaagaaatgtgtatcatgccaaaatctaaacccaagcaataaagagctcgttggcccaccattagctgaaactgtttttactcctaaaaccagcccagagaatgttcaagatcgatttgcattggtgactccaaagaaagaaggtcactgggattgtagtatttgtttagtaagaaatgaacctactgtatctaggtgcattgcgtgtcagaatacaaaatctgctaacaaaagtggatcttcatttgttcatcaagcttcatttaaatttggccagggagatcttcctaaacctattaacagtgatttcagatctgttttttctacaaaggaaggacagtgggattgcagtgcatgtttggtacaaaatgaggggagctctacaaaatgtgctgcttgtcagaatccgagaaaacagagtctacctgctacttctattccaacacctgcctcttttaagtttggtacttcagagacaagtaaaactctaaaaagtggatttgaagacatgtttgctaagaaggaaggacagtgggattgcagttcatgcttagtgcgaaatgaagcaaatgctacaagatgtgttgcttgtcagaatccggataaaccaagtccatctacttctgttccagctcctgcctcttttaagtttggtacttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggaaggacagtgggattgcagtgtgtgcttagtaagaaatgaagccagtgctaccaaatgtattgcttgtcagtgtccaagtaaacaaaatcaaacaactgcaatttcaacacctgcctcttcggagataagcaaggctccaaagagtggatttgaaggaatgttcatcaggaaaggacagtgggattgtagtgtttgctgtgtacaaaatgagagttcttccttaaaatgtgtggcttgtgatgcctctaaaccaactcataaacctattgcagaagctccttcagctttcacactgggctcagaaatgaagttgcatgactcttctggaagtcaggtgggaacaggatttaaaagtaatttctcagaaaaagcttctaagtttggcaatacagagcaaggattcaaatttgggcatgtggatcaagaaaattcaccttcatttatgtttcagggttcttctaatacagaatttaagtcaaccaaagaaggattttccatccctgtgtctgctgatggatttaaatttggcatttcggaaccaggaaatcaagaaaagaaaagtgaaaagcctcttgaaaatggtactggcttccaggctcaggatattagtggccagaagaatggccgtggtgtgatttttggccaaacaagtagcacttttacatttgcagatcttgcaaaatcaacttcaggagaaggatttcagtttggcaaaaaagaccccaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcccgaaaaagtagaacttgtaacaggagaagaagatgaaaaagttctgtattcacagcgggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacgatgaacctgaagcctctctctggatcagatagagcatggatgtggttagccagtgatttctctgatggtgatgccaaactagagcagttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactatgatttaagggaagatgctttggatgatagtgtcagtagtagctcagtacatgcttctccattggcaagtagccctgtgagaaaaaatcttttccgttttggtgagtcaacaacaggatttaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcaaaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgactttgcaaaatatgaaagggacagaaagagtatggttgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcaacttcagaagttgaagtgtctagcacatctgaaacaacaccaaaagcagtggtttctcctccaaagtttgtatttggttcagagtctgttaaaagcatttttagtagtgaaaaatcaaaaccatttgcattcggcaacagttcagccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctttgcttcctttccaacggaagaatcttcaatcaactacacatttaaaacaccagaaaaggcaaaagagaagaaaaaacctgaagattctccctcagatgatgatgttctcattgtatatgaactaactccaaccgctgagcagaaagcccttgcaaccaaacttaaacttcctccaactttcttctgctacaagaatagaccagattatgttagtgaagaagaggaggatgatgaagatttcgaaacagctgtcaagaaacttaatggaaaactatatttggatggctcagaaaaatgtagacccttggaagaaaatacagcagataatgagaaagaatgtattattgtttgggaaaagaaaccaacagttgaagagaaggcaaaagcagatacgttaaaacttccacctacatttttttgtggagtctgtagtgatactgatgaagacaatggaaatggggaagactttcaatcagagcttcaaaaagttcaggaagctcaaaaatctcagacagaagaaataactagcacaactgacagtgtatatacaggtgggactgaagtgatggtaccttctttctgtaaatctgaagaacctgattctattaccaaatccattagttcaccatctgtttcctctgaaactatggacaaacctgtagatttgtcaactagaaaggaaattgatacagattctacaagccaaggggaaagcaagatagtttcatttggatttggaagtagcacagggctctcatttgcagacttggcttccagtaattctggagattttgcttttggttctaaagataaaaatttccaatgggcaaatactggagcagctgtgtttggaacacagtcagtcggaacccagtcagccggtaaagttggtgaagatgaagatggtagtgatgaagaagtagttcataatgaagatatccattttgaaccaatagtgtcactaccagaggtagaagtaaaatctggagaagaagatgaagaaattttgtttaaagagagagccaaactttatagatgggatcgggatgtcagtcagtggaaggagcgcggtgttggagatataaagattctttggcatacaatgaagaattattaccggatcctaatgagaagagaccaggtttttaaagtgtgtgcaaaccacgttattactaaaacaatggaattaaagcccttaaatgtttcaaataatgctttagtttggactgcctcagattatgctgatggagaagcaaaagtagaacagcttgcagtgagatttaaaactaaagaagtagctgattgtttcaagaaaacatttgaagaatgtcagcagaatttaatgaaactccagaaaggacatgtatcactggcagcagaattatcaaaggagaccaatcctgtggtgttttttgatgtttgtgcggacggtgaacctctagggcggataactatggaattattttcaaacattgttcctcggactgctgagaacttcagagcactatgcactggagagaaaggctttggtttcaagaattccatttttcacagagtaattccagattttgtttgccaaggaggagatatcaccaaacatgatggaacaggcggacagtccatttatggagacaaatttgaagatgaaaattttgatgtgaaacatactggtcctggtttactatccatggccaatcaaggccagaataccaataattctcaatttgttataacactgaagaaagcagaacatttggactttaagcatgtagtatttgggtttgttaaggatggcatggatactgtgaaaaagattgaatcatttggttctcccaaagggtctgtttgtcgaagaataactatcacagaatgtggacagatataaaatcattgttgttcatagaaaatttcatctgtataagcagttggattgaagcttagctattacaatttgatagttatgttcagcttttgaaaatggacgtttccgatttacaaatgtaaaattgcagcttatagctgttgtcactttttaatgtgttataattgaccttgcatggtgtgaaataaaagtttaaacactggtgtatttcaggtgtacttgtgtttatgtactcctgacgtattaaaatggaataatactaatcttgttaaaagcaatagacctcaaactattgaaggaatatgatatatgcaatttaattttaattccttttaagatatttggacttcctgcatggatatacttaccatttgaataaagggaccacaacttggataatttaattttaggtttgaaatatatttggtaatcttaactattggtgtactcatttatgcatagagactcgtttatgaatgggtagagccacagaacgtatagagttaaccaaagtgctcttctctagaatctttacacctcctgtgtggttacaagttaactttgtaagtagcgtaccttccttccttaaaatatctagcttcctgtgccctttcatagatattcgattaatttttacattttaaacaagttgactatttcctttaggggttttgtttcaaacttttctgtcatctgtctctactacctcagaaactgcagcttggttctgatgatagaaattgaatttttccttgtagttattgtgataaagtatgaatatttttagaaagtctataccatgttctttcgttaaagatttgctttatacaagattgttgcagtacctttttctggtaaattttgtagcagaaataaaatgacaattcctaagagccactgacatccaaaaaattcattacttacgcttcgggttcattctaaagtaaggaagacaatttaaaggcagtaaattcaaactgctgcataatttccagagctcctagtttctcaagtttgatacacaccaaaaacgtatttggaaatggcttgtatcaaatgttaggcaaattgctaaagaaaagaggatgttcttattggcctactcaatatggaactacaaagaatccaggtagaacacaaaattttgtatattgcaattatgaatattgactgtcttccacccatctgtgttctttcgggtgaaattacctcattttatttagtgaggaaagacaggtttattccctgttacatggggatttggaaattgggtatcctaaagcaagtaactgttcaaccaccagtcaaaagaggggagggatgttgtgcgagtaatgagtgatggtataccatcaccattccactcggccacaaagccagatacttgaaataaacctactccaaatgtatcagttcagtcttgaaccatggattacatatgtttacactaaatatttcaaattggcttatttggaaatctatgtaatataaactgatgtaaagtgtgttgtaacttttcagctgagacagttgatgccttcgtcatgattttagaataaattcttaagttaatgcaagtgctttttaagagactttttacagatttgtatgctttcctaaagcactaaagttacaaattaaaaagctttaaaaactttgaccaaaaatttgacaaaatgacatgtaaactgacttttcccgtattagtattccaaagatgcttaaaagtggcttgtggcatttatgagaaagtctttgtgtcacatttcaggaaaggactttgatttctctttgttatttaatcactgatgtggtctaaccaagatatttgttcttctttaactggtttatgtggttcataaatctgtaagatgataatcttttggcctccc

SEQ ID NO: 37274 - DNA, 11076 bp, Homo sapiens
acacagtggtcctccgccggctacggcgctgcgtcactggtttgcaggcgctttcctcttggaagtggcgactgctgcgggcctgagcgctggtctcacgcgcctcgggagccaggttggcggcgcgatgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagacaaagccgttgaatgttacaggcgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactgcaaagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagagattgttgaaacttttgccaacaaaagcgggcagtctgcattatatgatgctctgttttctagtcagtcacctaaggatacatcttttcttggtagcgatgatattggaaacattgatgtacgagaaccagagcttgaagatttgactagatacgatgttggtgctattcgagcacataatggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaacgtagcaaaattgagacttctagttcagcatgaaataaacactctaagagcccaggaaaaacatggccttcaacctgctctgcttgtacattgggcagaatgccttcagaaaacgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaattcagtcatgcaggaactcgaagactatagtgaaggaggtcctctctataaaaatggttctttgcgaaatgcagattcagaaataaaacattctacaccgtctcctaccagatattcactatcaccaagtaaaagttacaagtattctcccaaaacaccacctcgatgggcagaagatcagaattctttactgaaaatgatttgccaacaagtagaggccattaagaaagaaatgcaggagttgaaactaaatagcagtaactcagcatcccctcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggcccagtctatggcatgaataggcttccaccccaacagcatatttatgcctatccgcaacagatgcacacaccgccagtgcaaagctcatctgcttgtatgttctctcaggagatgtatggtcctcctgcattgcgttttgagtctcctgcaacgggaattctatcgcccaggggtgatgattactttaattacaatgttcaacagacaagcacaaatccacctttgccagaaccaggatatttcacaaaacctccgattgcagctcatgcttcaagatctgcagaatctaagactatagaatttgggaaaactaattttgttcagcccatgccgggtgaaggattaaggccatctttgccaacacaagcacacacaacacagccaactccttttaaatttaactcaaatttcaaatcaaatgatggtgacttcacgttttcctcaccacaggttgtgacacagccccctcctgcagcttacagtaacagtgaaagccttttaggtctcctgacttcagataaacccttgcaaggagatggctatagtggagccaaaccaattcctggtggtcaaaccattgggcctcgaaatacattcaattttggaagcaaaaatgtgtctggaatttcatttacagaaaacatggggtcgagtcagcaaaagaattctggttttcggcgaagtgatgatatgtttactttccatggtccagggaaatcagtatttggaacacccactttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcactttttaaatgcaagtttgaagaagcccagagcattttaaaagccccaggaacaaatgtagccatggcgtcaaatcaggctgtcagaattgtaaaagaacccacaagtcatgataacaaggatatttgcaaatctgatgctggaaacctgaattttgaatttcaggttgcaaagaaagaagggtcttggtggcattgtaacagctgctcattaaagaatgcttcaactgctaagaaatgtgtatcatgccaaaatctaaacccaagcaataaagagctcgttggcccaccattagctgaaactgtttttactcctaaaaccagcccagagaatgttcaagatcgatttgcattggtgactccaaagaaagaaggtcactgggattgtagtatttgtttagtaagaaatgaacctactgtatctaggtgcattgcgtgtcagaatacaaaatctgctaacaaaagtggatcttcatttgttcatcaagcttcatttaaatttggccagggagatcttcctaaacctattaacagtgatttcagatctgttttttctacaaaggaaggacagtgggattgcagtgcatgtttggtacaaaatgaggggagctctacaaaatgtgctgcttgtcagaatccgagaaaacagagtctacctgctacttctattccaacacctgcctcttttaagtttggtacttcagagacaagtaaaactctaaaaagtggatttgaagacatgtttgctaagaaggaaggacagtgggattgcagttcatgcttagtgcgaaatgaagcaaatgctacaagatgtgttgcttgtcagaatccggataaaccaagtccatctacttctgttccagctcctgcctcttttaagtttggtacttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggaaggacagtgggattgcagtgtgtgcttagtaagaaatgaagccagtgctaccaaatgtattgcttgtcagtgtccaagtaaacaaaatcaaacaactgcaatttcaacacctgcctcttcggagataagcaaggctccaaagagtggatttgaaggaatgttcatcaggaaaggacagtgggattgtagtgtttgctgtgtacaaaatgagagttcttccttaaaatgtgtggcttgtgatgcctctaaaccaactcataaacctattgcagaagctccttcagctttcacactgggctcagaaatgaagttgcatgactcttctggaagtcaggtgggaacaggatttaaaagtaatttctcagaaaaagcttctaagtttggcaatacagagcaaggattcaaatttgggcatgtggatcaagaaaattcaccttcatttatgtttcagggttcttctaatacagaatttaagtcaaccaaagaaggattttccatccctgtgtctgctgatggatttaaatttggcatttcggaaccaggaaatcaagaaaagaaaagtgaaaagcctcttgaaaatggtactggcttccaggctcaggatattagtggccagaagaatggccgtggtgtgatttttggccaaacaagtagcacttttacatttgcagatcttgcaaaatcaacttcaggagaaggatttcagtttggcaaaaaagaccccaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcccgaaaaagtagaacttgtaacaggagaagaagatgaaaaagttctgtattcacagcgggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacgatgaacctgaagcctctctctggatcagatagagcatggatgtggttagccagtgatttctctgatggtgatgccaaactagagcagttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactatgatttaagggaagatgctttggatgatagtgtcagtagtagctcagtacatgcttctccattggcaagtagccctgtgagaaaaaatcttttccgttttggtgagtcaacaacaggatttaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcaaaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgactttgcaaaatatgaaagggacagaaagagtatggttgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcaacttcagaagttgaagtgtctagcacatctgaaacaacaccaaaagcagtggtttctcctccaaagtttgtatttggttcagagtctgttaaaagcatttttagtagtgaaaaatcaaaaccatttgcattcggcaacagttcagccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctttgcttcctttccaacggaagaatcttcaatcaactacacatttaaaacaccagaaaaggcaaaagagaagaaaaaacctgaagattctccctcagatgatgatgttctcattgtatatgaactaactccaaccgctgagcagaaagcccttgcaaccaaacttaaacttcctccaactttcttctgctacaagaatagaccagattatgttagtgaagaagaggaggatgatgaagatttcgaaacagctgtcaagaaacttaatggaaaactatatttggatggctcagaaaaatgtagacccttggaagaaaatacagcagataatgagaaagaatgtattattgtttgggaaaagaaaccaacagttgaagagaaggcaaaagcagatacgttaaaacttccacctacatttttttgtggagtctgtagtgatactgatgaagacaatggaaatggggaagactttcaatcagagcttcaaaaagttcaggaagctcaaaaatctcagacagaagaaataactagcacaactgacagtgtatatacaggtgggactgaagtgatggtaccttctttctgtaaatctgaagaacctgattctattaccaaatccattagttcaccatctgtttcctctgaaactatggacaaacctgtagatttgtcaactagaaaggaaattgataagaatttaatgaaactccagaaaggacatgtatcactggcagcagaattatcaaaggagaccaatcctgtggtgttttttgatgtttgtgcggacggtgaacctctagggcggataactatggaattattttcaaacattgttcctcggactgctgagaacttcagagcactatgcactggagagaaaggctttggtttcaagaattccatttttcacagagtaattccagattttgtttgccaaggaggagatatcaccaaacatgatggaacaggcggacagtccatttatggagacaaatttgaagatgaaaattttgatgtgaaacatactggtcctggtttactatccatggccaatcaaggccagaataccaataattctcaatttgttataacactgaagaaagcagaacatttggactttaagcatgtagtatttgggtttgttaaggatggcatggatactgtgaaaaagattgaatcatttggttctcccaaagggtctgtttgtcgaagaataactatcacagaatgtggacagatataaaatcattgttgttcatagaaaatttcatctgtataagcagttggattgaagcttagctattacaatttgatagttatgttcagcttttgaaaatggacgtttccgatttacaaatgtaaaattgcagcttatagctgttgtcactttttaatgtgttataattgaccttgcatggtgtgaaataaaagtttaaacactggtgtatttcaggtgtacttgtgtttatgtactcctgacgtattaaaatggaataatactaatcttgttaaaagcaatagacctcaaactattgaaggaatatgatatatgcaatttaattttaattccttttaagatatttggacttcctgcatggatatacttaccatttgaataaagggaccacaacttggataatttaattttaggtttgaaatatatttggtaatcttaactattggtgtactcatttatgcatagagactcgtttatgaatgggtagagccacagaacgtatagagttaaccaaagtgctcttctctagaatctttacacctcctgtgtggttacaagttaactttgtaagtagcgtaccttccttccttaaaatatctagcttcctgtgccctttcatagatattcgattaatttttacattttaaacaagttgactatttcctttaggggttttgtttcaaacttttctgtcatctgtctctactacctcagaaactgcagcttggttctgatgatagaaattgaatttttccttgtagttattgtgataaagtatgaatatttttagaaagtctataccatgttctttcgttaaagatttgctttatacaagattgttgcagtacctttttctggtaaattttgtagcagaaataaaatgacaattcctaagagccactgacatccaaaaaattcattacttacgcttcgggttcattctaaagtaaggaagacaatttaaaggcagtaaattcaaactgctgcataatttccagagctcctagtttctcaagtttgatacacaccaaaaacgtatttggaaatggcttgtatcaaatgttaggcaaattgctaaagaaaagaggatgttcttattggcctactcaatatggaactacaaagaatccaggtagaacacaaaattttgtatattgcaattatgaatattgactgtcttccacccatctgtgttctttcgggtgaaattacctcattttatttagtgaggaaagacaggtttattccctgttacatggggatttggaaattgggtatcctaaagcaagtaactgttcaaccaccagtcaaaagaggggagggatgttgtgcgagtaatgagtgatggtataccatcaccattccactcggccacaaagccagatacttgaaataaacctactccaaatgtatcagttcagtcttgaaccatggattacatatgtttacactaaatatttcaaattggcttatttggaaatctatgtaatataaactgatgtaaagtgtgttgtaacttttcagctgagacagttgatgccttcgtcatgattttagaataaattcttaagttaatgcaagtgctttttaagagactttttacagatttgtatgctttcctaaagcactaaagttacaaattaaaaagctttaaaaactttgaccaaaaatttgacaaaatgacatgtaaactgacttttcccgtattagtattccaaagatgcttaaaagtggcttgtggcatttatgagaaagtctttgtgtcacatttcaggaaaggactttgatttctctttgttatttaatcactgatgtggtctaaacccacgataatatgtatctttccttttaaactggattttatgttgtctcattaaaatctgcttaaagatagaataaaattcattatttgtaaaaaaaaaaaa

SEQ ID NO: 37275 - DNA, 10330 bp, Homo sapiens
acacagtggtcctccgccggctacggcgctgcgtcactggtttgcaggcgctttcctcttggaagtggcgactgctgcgggcctgagcgctggtctcacgcgcctcgggagccaggttggcggcgcgatgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagacaaagccgttgaatgttacaggcgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactgcaaagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagagattgttgaaacttttgccaacaaaagcgggcagtctgcattatatgatgctctgttttctagtcagtcacctaaggatacatcttttcttggtagcgatgatattggaaacattgatgtacgagaaccagagcttgaagatttgactagatacgatgttggtgctattcgagcacataatggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaacgtagcaaaattgagacttctagttcagcatgaaataaacactctaagagcccaggaaaaacatggccttcaacctgctctgcttgtacattgggcagaatgccttcagaaaacgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaattcagtcatgcaggaactcgaagactatagtgaaggaggtcctctctataaaaatggttctttgcgaaatgcagattcagaaataaaacattctacaccgtctcctaccagatattcactatcaccaagtaaaagttacaagtattctcccaaaacaccacctcgatgggcagaagatcagaattctttactgaaaatgatttgccaacaagtagaggccattaagaaagaaatgcaggagttgaaactaaatagcagtaactcagcatcccctcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggcccagtctatggcatgaataggcttccaccccaacagcatatttatgcctatccgcaacagatgcacacaccgccagtgcaaagctcatctgcttgtatgttctctcaggagatgtatggtcctcctgcattgcgttttgagtctcctgcaacgggaattctatcgcccaggggtgatgattactttaattacaatgttcaacagacaagcacaaatccacctttgccagaaccaggatatttcacaaaacctccgattgcagctcatgcttcaagatctgcagaatctaagactatagaatttgggaaaactaattttgttcagcccatgccgggtgaaggattaaggccatctttgccaacacaagcacacacaacacagccaactccttttaaatttaactcaaatttcaaatcaaatgatggtgacttcacgttttcctcaccacaggttgtgacacagccccctcctgcagcttacagtaacagtgaaagccttttaggtctcctgacttcagataaacccttgcaaggagatggctatagtggagccaaaccaattcctggtggtcaaaccattgggcctcgaaatacattcaattttggaagcaaaaatgtgtctggaatttcatttacagaaaacatggggtcgagtcagcaaaagaattctggttttcggcgaagtgatgatatgtttactttccatggtccagggaaatcagtatttggaacacccactttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcactttttaaatgcaagtttgaagaagcccagagcattttaaaagccccaggaacaaatgtagccatggcgtcaaatcaggctgtcagaattgtaaaagaacccacaagtcatgataacaaggatatttgcaaatctgatgctggaaacctgaattttgaatttcaggttgcaaagaaagaagggtcttggtggcattgtaacagctgctcattaaagaatgcttcaactgctaagaaatgtgtatcatgccaaaatctaaacccaagcaataaagagctcgttggcccaccattagctgaaactgtttttactcctaaaaccagcccagagaatgttcaagatcgatttgcattggtgactccaaagaaagaaggtcactgggattgtagtatttgtttagtaagaaatgaacctactgtatctaggtgcattgcgtgtcagaatacaaaatctgctaacaaaagtggatcttcatttgttcatcaagcttcatttaaatttggccagggagatcttcctaaacctattaacagtgatttcagatctgttttttctacaaaggaaggacagtgggattgcagtgcatgtttggtacaaaatgaggggagctctacaaaatgtgctgcttgtcagaatccgagaaaacagagtctacctgctacttctattccaacacctgcctcttttaagtttggtacttcagagacaagtaaaactctaaaaagtggatttgaagacatgtttgctaagaaggaaggacagtgggattgcagttcatgcttagtgcgaaatgaagcaaatgctacaagatgtgttgcttgtcagaatccggataaaccaagtccatctacttctgttccagctcctgcctcttttaagtttggtacttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggaaggacagtgggattgcagtgtgtgcttagtaagaaatgaagccagtgctaccaaatgtattgcttgtcagtgtccaagtaaacaaaatcaaacaactgcaatttcaacacctgcctcttcggagataagcaaggctccaaagagtggatttgaaggaatgttcatcaggaaaggacagtgggattgtagtgtttgctgtgtacaaaatgagagttcttccttaaaatgtgtggcttgtgatgcctctaaaccaactcataaacctattgcagaagctccttcagctttcacactgggctcagaaatgaagttgcatgactcttctggaagtcaggtgggaacaggatttaaaagtaatttctcagaaaaagcttctaagtttggcaatacagagcaaggattcaaatttgggcatgtggatcaagaaaattcaccttcatttatgtttcagggttcttctaatacagaatttaagtcaaccaaagaaggattttccatccctgtgtctgctgatggatttaaatttggcatttcggaaccaggaaatcaagaaaagaaaagtgaaaagcctcttgaaaatggtactggcttccaggctcaggatattagtggccagaagaatggccgtggtgtgatttttggccaaacaagtagcacttttacatttgcagatcttgcaaaatcaacttcaggagaaggatttcagtttggcaaaaaagaccccaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcccgaaaaagtagaacttgtaacaggagaagaagatgaaaaagttctgtattcacagcgggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacgatgaacctgaagcctctctctggatcagatagagcatggatgtggttagccagtgatttctctgatggtgatgccaaactagagcagttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactatgatttaagggaagatgctttggatgatagtgtcagtagtagctcagtacatgcttctccattggcaagtagccctgtgagaaaaaatcttttccgttttggtgagtcaacaacaggatttaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcaaaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgactttgcaaaatatgaaagggacagaaagagtatggttgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcaacttcagaagttgaagtgtctagcacatctgaaacaacaccaaaagcagtggtttctcctccaaagtttgtatttggttcagagtctgttaaaagcatttttagtagtgaaaaatcaaaaccatttgcattcggcaacagttcagccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctttgcttcctttccaacggaagaatcttcaatcaactacacatttaaaacaccagaaaaggcaaaagagaagaaaaaacctgaagattctccctcagatgatgatgttctcattgtatatgaactaactccaaccgctgagcagaaagcccttgcaaccaaacttaaacttcctccaactttcttctgctacaagaatagaccagattatgttagtgaagaagaggaggatgatgaagatttcgaaacagctgtcaagaaacttaatggaaaactatatttggatggctcagaaaaatgtagacccttggaagaaaatacagcagataatgagaaagaatgtattattgtttgggaaaagaaaccaacagttgaagagaaggcaaaagcagatacgttaaaacttccacctacatttttttgtggagtctgtagtgatactgatgaagacaatggaaatggggaagactttcaatcagagcttcaaaaagttcaggaagctcaaaaatctcagacagaagaaataactagcacaactgacagtgtatatacaggtgggactgaagtgatggtaccttctttctgtaaatctgaagaacctgattctattaccaaatccattagttcaccatctgtttcctctgaaactatggacaaacctgtagatttgtcaactagaaaggaaattgatacagattctacaagccaaggggaaagcaagatagtttcatttggatttggaagtagcacagggctctcatttgcagacttggcttccagtaattctggagattttgcttttggttctaaagataaaaatttccaatgggcaaatactggagcagctgtgtttggaacacagtcagtcggaacccagtcagccggtaaagttggtgaagatgaagatggtagtgatgaagaagtagttcataatgaagatatccattttgaaccaatagtgtcactaccagaggtagaagtaaaatctggagaagaagatgaagaaattttgtttaaagagagagccaaactttatagatgggatcgggatgtcagtcagtggaaggagcgcggtgttggagatataaagattctttggcatacaatgaagaattattaccggatcctaatgagaagagaccaggtttttaaagtgtgtgcaaaccacgttattactaaaacaatggaattaaagcccttaaatgtttcaaataatgctttagtttggactgcctcagattatgctgatggagaagcaaaagtagaacagcttgcagtgagatttaaaactaaagaagtagctgattgtttcaagaaaacatttgaagaatgtcagcagaatttaatgaaactccagaaaggacatgtatcactggcagcagaattatcaaaggagaccaatcctgtggtgttttttgatgtttgtgcggacggtgaacctctagggcggataactatggaattattttcaaacattgttcctcggactgctgagaacttcagagcactatgcactggagagaaaggctttggtttcaagaattccatttttcacagagtaattccagattttgtttgccaaggaggagatatcaccaaacatgatggaacaggcggacagtccatttatggagacaaatttgaagatgaaaattttgatgtgaaacatactggtcctggtttactatccatggccaatcaaggccagaataccaataattctcaatttgttataacactgaagaaagcagaacatttggactttaagcatgtagtatttgggtttgttaaggatggcatggatactgtgaaaaagattgaatcatttggttctcccaaagggtctgtttgtcgaagaataactatcacagaatgtggacagatataaaatcattgttgttcatagaaaatttcatctgtataagcagttggattgaagcttagctattacaatttgatagttatgttcagcttttgaaaatggacgtttccgatttacaaatgtaaaattgcagcttatagctgttgtcactttttaatgtgttataattgaccttgcatggtgtgaaataaaagtttaaacactggtgtaaaaaaaaaaaaaaaaaaaatcggggattatatggggggggggaaaaaagaggtacggaaggcgcatggtcataaggtgttccgggaccaatttcgtggtccaagggtgaaatcgggcggctccccaaggggagcgtaaaattcgaaagcaggtaactgtagacttgtgcggaacacgggaagacaggaacaggaaccaccagcacacaaggaacaaacagcaacaacataccgacaccaacagagaagccaagcatccgagaacaagagcacgacacagccgcacgcgagacgaacagcacgagacagcacagaaaaaaacaac

SEQ ID NO: 37276 - DNA, 3719 bp, Homo sapiens
aacgatggtcctcagctaaggaagtacagttacgtgcttctggactccaacgatggtcctcagcggtttcgaaatcttaaacttcctccaactttcttctgctacaagaatagaccagattatgttagtgaagaagaggaggatgatgaagatttcgaaacagctgtcaagaaacttaatggaaaactatatttggatggctcagaaaaatgtagacccttggaagaaaatacagcagataatgagaaagaatgtattattgtttgggaaaagaaaccaacagttgaagagaaggcaaaagcagatacgttaaaacttccacctacatttttttgtggagtctgtagtgatactgatgaagacaatggaaatggggaagactttcaatcagagcttcaaaaagttcaggaagctcaaaaatctcagacagaagaaataactagcacaactgacagtgtatatacaggtgggactgaagtgatggtaccttctttctgtaaatctgaagaacctgattctattaccaaatccattagttcaccatctgtttcctctgaaactatggacaaacctgtagatttgtcaactagaaaggaaattgatacagattctacaagccaaggggaaagcaagatagtttcatttggatttggaagtagcacagggctctcatttgcagacttggcttccagtaattctggagattttgcttttggttctaaagataaaaatttccaatgggcaaatactggagcagctgtgtttggaacacagtcagtcggaacccagtcagccggtaaagttggtgaagatgaagatggtagtgatgaagaagtagttcataatgaagatatccattttgaaccaatagtgtcactaccagaggtagaagtaaaatctggagaagaagatgaagaaattttgtttaaagagagagccaaactttatagatgggatcgggatgtcagtcagtggaaggagcgcggtgttggagatataaagattctttggcatacaatgaagaattattaccggatcctaatgagaagagaccaggtttttaaagtgtgtgcaaaccacgttattactaaaacaatggaattaaagcccttaaatgtttcaaataatgctttagtttggactgcctcagattatgctgatggagaagcaaaagtagaacagcttgcagtgagatttaaaactaaagaagtagctgattgtttcaagaaaacatttgaagaatgtcagcagaatttaatgaaactccagaaaggacatgtatcactggcagcagaattatcaaaggagaccaatcctgtggtgttttttgatgtttgtgcggacggtgaacctctagggcggataactatggaattattttcaaacattgttcctcggactgctgagaacttcagagcactatgcactggagagaaaggctttggtttcaagaattccatttttcacagagtaattccagattttgtttgccaaggaggagatatcaccaaacatgatggaacaggcggacagtccatttatggagacaaatttgaagatgaaaattttgatgtgaaacatactggtcctggtttactatccatggccaatcaaggccagaataccaataattctcaatttgttataacactgaagaaagcagaacatttggactttaagcatgtagtatttgggtttgttaaggatggcatggatactgtgaaaaagattgaatcatttggttctcccaaagggtctgtttgtcgaagaataactatcacagaatgtggacagatataaaatcattgttgttcatagaaaatttcatctgtataagcagttggattgaagcttagctattacaatttgatagttatgttcagcttttgaaaatggacgtttccgatttacaaatgtaaaattgcagcttatagctgttgtcactttttaatgtgttataattgaccttgcatggtgtgaaataaaagtttaaacactggtgtatttcaggtgtacttgtgtttatgtactcctgacgtattaaaatggaataatactaatcttgttaaaagcaatagacctcaaactattgaaggaatatgatatatgcaatttaattttaattccttttaagatatttggacttcctgcatggatatacttaccatttgaataaagggaccacaacttggataatttaattttaggtttgaaatatatttggtaatcttaactattggtgtactcatttatgcatagagactcgtttatgaatgggtagagccacagaacgtatagagttaaccaaagtgctcttctctagaatctttacacctcctgtgtggttacaagttaactttgtaagtagcgtaccttccttccttaaaatatctagcttcctgtgccctttcatagatattcgattaatttttacattttaaacaagttgactatttcctttaggggttttgtttcaaacttttctgtcatctgtctctactacctcagaaactgcagcttggttctgatgatagaaattgaatttttccttgtagttattgtgataaagtatgaatatttttagaaagtctataccatgttctttcgttaaagatttgctttatacaagattgttgcagtacctttttctggtaaattttgtagcagaaataaaatgacaattcctaagagccactgacatccaaaaaattcattacttacgcttcgggttcattctaaagtaaggaagacaatttaaaggcagtaaattcaaactgctgcataatttccagagctcctagtttctcaagtttgatacacaccaaaaacgtatttggaaatggcttgtatcaaatgttaggcaaattgctaaagaaaagaggatgttcttattggcctactcaatatggaactacaaagaatccaggtagaacacaaaattttgtatattgcaattatgaatattgactgtcttccacccatctgtgttctttcgggtgaaattacctcattttatttagtgaggaaagacaggtttattccctgttacatggggatttggaaattgggtatcctaaagcaagtaactgttcaaccaccagtcaaaagaggggagggatgttgtgcgagtaatgagtgatggtataccatcaccattccactcggccacaaagccagatacttgaaataaacctactccaaatgtatcagttcagtcttgaaccatggattacatatgtttacactaaatatttcaaattggcttatttggaaatctatgtaatataaactgatgtaaagtgtgttgtaacttttcagctgagacagttgatgccttcgtcatgattttagaataaattcttaagttaatgcaagtgctttttaagagactttttacagatttgtatgctttcctaaagcactaaagttacaaattaaaaagctttaaaaactttgaccaaaaatttgacaaaatgacatgtaaactgacttttcccgtattagtattccaaagatgcttaaaagtggcttgtggcatttatgagaaagtctttgtgtcacatttcaggaaaggactttgatttctctttgttatttaatcactgatgtggtctaaacccacgataatatgtatctttccttttaaactggattttatgttgtctcattaaaatctgcttaaagatagaataaaattcattatttgtaaaaaaaaaaaa

SEQ ID NO: 37277 - DNA, 9041 bp, Homo sapiens
acacagtggtcctccgccggctacggcgctgcgtcactggtttgcaggcgctttcctcttggaagtggcgactgctgcgggcctgagcgctggtctcacgcgcctcgggagccaggttggcggcgcgatgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagacaaagccgttgaatgttacaggcgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactgcaaagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagagattgttgaaacttttgccaacaaaagcgggcagtctgcattatatgatgctctgttttctagtcagtcacctaaggatacatcttttcttggtagcgatgatattggaaacattgatgtacgagaaccagagcttgaagatttgactagatacgatgttggtgctattcgagcacataatggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaacgtagcaaaattgagacttctagttcagcatgaaataaacactctaagagcccaggaaaaacatggccttcaacctgctctgcttgtacattgggcagaatgccttcagaaaacgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaattcagtcatgcaggaactcgaagactatagtgaaggaggtcctctctataaaaatggttctttgcgaaatgcagattcagaaataaaacattctacaccgtctcctaccagatattcactatcaccaagtaaaagttacaagtattctcccaaaacaccacctcgatgggcagaagatcagaattctttactgaaaatgatttgccaacaagtagaggccattaagaaagaaatgcaggagttgaaactaaatagcagtaactcagcatcccctcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggcccagtctatggcatgaataggcttccaccccaacagcatatttatgcctatccgcaacagatgcacacaccgccagtgcaaagctcatctgcttgtatgttctctcaggagatgtatggtcctcctgcattgcgttttgagtctcctgcaacgggaattctatcgcccaggggtgatgattactttaattacaatgttcaacagacaagcacaaatccacctttgccagaaccaggatatttcacaaaacctccgattgcagctcatgcttcaagatctgcagaatctaagactatagaatttgggaaaactaattttgttcagcccatgccgggtgaaggattaaggccatctttgccaacacaagcacacacaacacagccaactccttttaaatttaactcaaatttcaaatcaaatgatggtgacttcacgttttcctcaccacaggttgtgacacagccccctcctgcagcttacagtaacagtgaaagccttttaggtctcctgacttcagataaacccttgcaaggagatggctatagtggagccaaaccaattcctggtggtcaaaccattgggcctcgaaatacattcaattttggaagcaaaaatgtgtctggaatttcatttacagaaaacatggggtcgagtcagcaaaagaattctggttttcggcgaagtgatgatatgtttactttccatggtccagggaaatcagtatttggaacacccactttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcactttttaaatgcaagtttgaagaagcccagagcattttaaaagccccaggaacaaatgtagccatggcgtcaaatcaggctgtcagaattgtaaaagaacccacaagtcatgataacaaggatatttgcaaatctgatgctggaaacctgaattttgaatttcaggttgcaaagaaagaagggtcttggtggcattgtaacagctgctcattaaagaatgcttcaactgctaagaaatgtgtatcatgccaaaatctaaacccaagcaataaagagctcgttggcccaccattagctgaaactgtttttactcctaaaaccagcccagagaatgttcaagatcgatttgcattggtgactccaaagaaagaaggtcactgggattgtagtatttgtttagtaagaaatgaacctactgtatctaggtgcattgcgtgtcagaatacaaaatctgctaacaaaagtggatcttcatttgttcatcaagcttcatttaaatttggccagggagatcttcctaaacctattaacagtgatttcagatctgttttttctacaaaggaaggacagtgggattgcagtgcatgtttggtacaaaatgaggggagctctacaaaatgtgctgcttgtcagaatccgagaaaacagagtctacctgctacttctattccaacacctgcctcttttaagtttggtacttcagagacaagtaaaactctaaaaagtggatttgaagacatgtttgctaagaaggaaggacagtgggattgcagttcatgcttagtgcgaaatgaagcaaatgctacaagatgtgttgcttgtcagaatccggataaaccaagtccatctacttctgttccagctcctgcctcttttaagtttggtacttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggaaggacagtgggattgcagtgtgtgcttagtaagaaatgaagccagtgctaccaaatgtattgcttgtcagtgtccaagtaaacaaaatcaaacaactgcaatttcaacacctgcctcttcggagataagcaaggctccaaagagtggatttgaaggaatgttcatcaggaaaggacagtgggattgtagtgtttgctgtgtacaaaatgagagttcttccttaaaatgtgtggcttgtgatgcctctaaaccaactcataaacctattgcagaagctccttcagctttcacactgggctcagaaatgaagttgcatgactcttctggaagtcaggtgggaacaggatttaaaagtaatttctcagaaaaagcttctaagtttggcaatacagagcaaggattcaaatttgggcatgtggatcaagaaaattcaccttcatttatgtttcagggttcttctaatacagaatttaagtcaaccaaagaaggattttccatccctgtgtctgctgatggatttaaatttggcatttcggaaccaggaaatcaagaaaagaaaagtgaaaagcctcttgaaaatggtactggcttccaggctcaggatattagtggccagaagaatggccgtggtgtgatttttggccaaacaagtagcacttttacatttgcagatcttgcaaaatcaacttcaggagaaggatttcagtttggcaaaaaagaccccaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcccgaaaaagtagaacttgtaacaggagaagaagatgaaaaagttctgtattcacagcgggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacgatgaacctgaagcctctctctggatcagatagagcatggatgtggttagccagtgatttctctgatggtgatgccaaactagagcagttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactatgatttaagggaagatgctttggatgatagtgtcagtagtagctcagtacatgcttctccattggcaagtagccctgtgagaaaaaatcttttccgttttggtgagtcaacaacaggatttaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcaaaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgactttgcaaaatatgaaagggacagaaagagtatggttgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcaacttcagaagttgaagtgtctagcacatctgaaacaacaccaaaagcagtggtttctcctccaaagtttgtatttggttcagagtctgttaaaagcatttttagtagtgaaaaatcaaaaccatttgcattcggcaacagttcagccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctttgcttcctttccaacggaagaatcttcaatcaactacacatttaaaacaccagaaaaggcaaaagagaagaaaaaacctgaagattctccctcagatgatgatgttctcattgtatatgaactaactccaaccgctgagcagaaagcccttgcaaccaaacttaaacttcctccaactttcttctgctacaagaatagaccagattatgttagtgaagaagaggaggatgatgaagatttcgaaacagctgtcaagaaacttaatggaaaactatatttggatggctcagaaaaatgtagacccttggaagaaaatacagcagataatgagaaagaatgtattattgtttgggaaaagaaaccaacagttgaagagaaggcaaaagcagatacgttaaaacttccacctacatttttttgtggagtctgtagtgatactgatgaagacaatggaaatggggaagactttcaatcagagcttcaaaaagttcaggaagctcaaaaatctcagacagaagaaataactagcacaactgacagtgtatatacaggtgggactgaagtgatggtaccttctttctgtaaatctgaagaacctgattctattaccaaatccattagttcaccatctgtttcctctgaaactatggacaaacctgtagatttgtcaactagaaaggaaattgatacagattctacaagccaaggggaaagcaagatagtttcatttggatttggaagtagcacagggctctcatttgcagacttggcttccagtaattctggagattttgcttttggttctaaagataaaaatttccaatgggcaaatactggagcagctgtgtttggaacacagtcagtcggaacccagtcagccggtaaagttggtgaagatgaagatggtagtgatgaagaagtagttcataatgaagatatccattttgaaccaatagtgtcactaccagaggtagaagtaaaatctggagaagaagatgaagaaattttgtttaaagagagagccaaactttatagatgggatcgggggggaaaaatttgggggggtttttccccccaaaaaagggggttttttcccccccaaaatgaagaattattaccggatc

SEQ ID NO: 37278 - DNA, 8812 bp, Homo sapiens
acacagtggtcctccgccggctacggcgctgcgtcactggtttgcaggcgctttcctcttggaagtggcgactgctgcgggcctgagcgctggtctcacgcgcctcgggagccaggttggcggcgcgatgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagacaaagccgttgaatgttacaggcgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactgcaaagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagagattgttgaaacttttgccaacaaaagcgggcagtctgcattatatgatgctctgttttctagtcagtcacctaaggatacatcttttcttggtagcgatgatattggaaacattgatgtacgagaaccagagcttgaagatttgactagatacgatgttggtgctattcgagcacataatggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaacgtagcaaaattgagacttctagttcagcatgaaataaacactctaagagcccaggaaaaacatggccttcaacctgctctgcttgtacattgggcagaatgccttcagaaaacgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaattcagtcatgcaggaactcgaagactatagtgaaggaggtcctctctataaaaatggttctttgcgaaatgcagattcagaaataaaacattctacaccgtctcctaccagatattcactatcaccaagtaaaagttacaagtattctcccaaaacaccacctcgatgggcagaagatcagaattctttactgaaaatgatttgccaacaagtagaggccattaagaaagaaatgcaggagttgaaactaaatagcagtaactcagcatcccctcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggcccagtctatggcatgaataggcttccaccccaacagcatatttatgcctatccgcaacagatgcacacaccgccagtgcaaagctcatctgcttgtatgttctctcaggagatgtatggtcctcctgcattgcgttttgagtctcctgcaacgggaattctatcgcccaggggtgatgattactttaattacaatgttcaacagacaagcacaaatccacctttgccagaaccaggatatttcacaaaacctccgattgcagctcatgcttcaagatctgcagaatctaagactatagaatttgggaaaactaattttgttcagcccatgccgggtgaaggattaaggccatctttgccaacacaagcacacacaacacagccaactccttttaaatttaactcaaatttcaaatcaaatgatggtgacttcacgttttcctcaccacaggttgtgacacagccccctcctgcagcttacagtaacagtgaaagccttttaggtctcctgacttcagataaacccttgcaaggagatggctatagtggagccaaaccaattcctggtggtcaaaccattgggcctcgaaatacattcaattttggaagcaaaaatgtgtctggaatttcatttacagaaaacatggggtcgagtcagcaaaagaattctggttttcggcgaagtgatgatatgtttactttccatggtccagggaaatcagtatttggaacacccactttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcactttttaaatgcaagtttgaagaagcccagagcattttaaaagccccaggaacaaatgtagccatggcgtcaaatcaggctgtcagaattgtaaaagaacccacaagtcatgataacaaggatatttgcaaatctgatgctggaaacctgaattttgaatttcaggttgcaaagaaagaagggtcttggtggcattgtaacagctgctcattaaagaatgcttcaactgctaagaaatgtgtatcatgccaaaatctaaacccaagcaataaagagctcgttggcccaccattagctgaaactgtttttactcctaaaaccagcccagagaatgttcaagatcgatttgcattggtgactccaaagaaagaaggtcactgggattgtagtatttgtttagtaagaaatgaacctactgtatctaggtgcattgcgtgtcagaatacaaaatctgctaacaaaagtggatcttcatttgttcatcaagcttcatttaaatttggccagggagatcttcctaaacctattaacagtgatttcagatctgttttttctacaaaggaaggacagtgggattgcagtgcatgtttggtacaaaatgaggggagctctacaaaatgtgctgcttgtcagaatccgagaaaacagagtctacctgctacttctattccaacacctgcctcttttaagtttggtacttcagagacaagtaaaactctaaaaagtggatttgaagacatgtttgctaagaaggaaggacagtgggattgcagttcatgcttagtgcgaaatgaagcaaatgctacaagatgtgttgcttgtcagaatccggataaaccaagtccatctacttctgttccagctcctgcctcttttaagtttggtacttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggaaggacagtgggattgcagtgtgtgcttagtaagaaatgaagccagtgctaccaaatgtattgcttgtcagtgtccaagtaaacaaaatcaaacaactgcaatttcaacacctgcctcttcggagataagcaaggctccaaagagtggatttgaaggaatgttcatcaggaaaggacagtgggattgtagtgtttgctgtgtacaaaatgagagttcttccttaaaatgtgtggcttgtgatgcctctaaaccaactcataaacctattgcagaagctccttcagctttcacactgggctcagaaatgaagttgcatgactcttctggaagtcaggtgggaacaggatttaaaagtaatttctcagaaaaagcttctaagtttggcaatacagagcaaggattcaaatttgggcatgtggatcaagaaaattcaccttcatttatgtttcagggttcttctaatacagaatttaagtcaaccaaagaaggattttccatccctgtgtctgctgatggatttaaatttggcatttcggaaccaggaaatcaagaaaagaaaagtgaaaagcctcttgaaaatggtactggcttccaggctcaggatattagtggccagaagaatggccgtggtgtgatttttggccaaacaagtagcacttttacatttgcagatcttgcaaaatcaacttcaggagaaggatttcagtttggcaaaaaagaccccaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcccgaaaaagtagaacttgtaacaggagaagaagatgaaaaagttctgtattcacagcgggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacgatgaacctgaagcctctctctggatcagatagagcatggatgtggttagccagtgatttctctgatggtgatgccaaactagagcagttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactatgatttaagggaagatgctttggatgatagtgtcagtagtagctcagtacatgcttctccattggcaagtagccctgtgagaaaaaatcttttccgttttggtgagtcaacaacaggatttaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcaaaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgactttgcaaaatatgaaagggacagaaagagtatggttgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcaacttcagaagttgaagtgtctagcacatctgaaacaacaccaaaagcagtggtttctcctccaaagtttgtatttggttcagagtctgttaaaagcatttttagtagtgaaaaatcaaaaccatttgcattcggcaacagttcagccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctttgcttcctttccaacggaagaatcttcaatcaactacacatttaaaacaccagaaaaggcaaaagagaagaaaaaacctgaagattctccctcagatgatgatgttctcattgtatatgaactaactccaaccgctgagcagaaagcccttgcaaccaaacttaaacttcctccaactttcttctgctacaagaatagaccagattatgttagtgaagaagaggaggatgatgaagatttcgaaacagctgtcaagaaacttaatggaaaactatatttggatggctcagaaaaatgtagacccttggaagaaaatacagcagataatgagaaagaatgtattattgtttgggaaaagaaaccaacagttgaagagaaggcaaaagcagatacgttaaaacttccacctacatttttttgtggagtctgtagtgatactgatgaagacaatggaaatggggaagactttcaatcagagcttcaaaaagttcaggaagctcaaaaatctcagacagaagaaataactagcacaactgacagtgtatatacaggtgggactgaagtgatggtaccttctttctgtaaatctgaagaacctgattctattaccaaatccattagttcaccatctgtttcctctgaaactatggacaaacctgtagatttgtcaactagaaaggaaattgatacagattctacaagccaaggggaaagcaagatagtttcatttggatttggaagtagcacagggctctcatttgcagacttggcttccagtaattctggagattttgcttttggttctaaaggatgtcactctgttgcccaggctggagtgcagtggcatgaacacagctcactgctgccttgacctcctgggctctaaagcaatcct

SEQ ID NO: 37279 - DNA, 8749 bp, Homo sapiens
acacagtggtcctccgccggctacggcgctgcgtcactggtttgcaggcgctttcctcttggaagtggcgactgctgcgggcctgagcgctggtctcacgcgcctcgggagccaggttggcggcgcgatgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagacaaagccgttgaatgttacaggcgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactgcaaagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagagattgttgaaacttttgccaacaaaagcgggcagtctgcattatatgatgctctgttttctagtcagtcacctaaggatacatcttttcttggtagcgatgatattggaaacattgatgtacgagaaccagagcttgaagatttgactagatacgatgttggtgctattcgagcacataatggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaacgtagcaaaattgagacttctagttcagcatgaaataaacactctaagagcccaggaaaaacatggccttcaacctgctctgcttgtacattgggcagaatgccttcagaaaacgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaattcagtcatgcaggaactcgaagactatagtgaaggaggtcctctctataaaaatggttctttgcgaaatgcagattcagaaataaaacattctacaccgtctcctaccagatattcactatcaccaagtaaaagttacaagtattctcccaaaacaccacctcgatgggcagaagatcagaattctttactgaaaatgatttgccaacaagtagaggccattaagaaagaaatgcaggagttgaaactaaatagcagtaactcagcatcccctcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggcccagtctatggcatgaataggcttccaccccaacagcatatttatgcctatccgcaacagatgcacacaccgccagtgcaaagctcatctgcttgtatgttctctcaggagatgtatggtcctcctgcattgcgttttgagtctcctgcaacgggaattctatcgcccaggggtgatgattactttaattacaatgttcaacagacaagcacaaatccacctttgccagaaccaggatatttcacaaaacctccgattgcagctcatgcttcaagatctgcagaatctaagactatagaatttgggaaaactaattttgttcagcccatgccgggtgaaggattaaggccatctttgccaacacaagcacacacaacacagccaactccttttaaatttaactcaaatttcaaatcaaatgatggtgacttcacgttttcctcaccacaggttgtgacacagccccctcctgcagcttacagtaacagtgaaagccttttaggtctcctgacttcagataaacccttgcaaggagatggctatagtggagccaaaccaattcctggtggtcaaaccattgggcctcgaaatacattcaattttggaagcaaaaatgtgtctggaatttcatttacagaaaacatggggtcgagtcagcaaaagaattctggttttcggcgaagtgatgatatgtttactttccatggtccagggaaatcagtatttggaacacccactttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcactttttaaatgcaagtttgaagaagcccagagcattttaaaagccccaggaacaaatgtagccatggcgtcaaatcaggctgtcagaattgtaaaagaacccacaagtcatgataacaaggatatttgcaaatctgatgctggaaacctgaattttgaatttcaggttgcaaagaaagaagggtcttggtggcattgtaacagctgctcattaaagaatgcttcaactgctaagaaatgtgtatcatgccaaaatctaaacccaagcaataaagagctcgttggcccaccattagctgaaactgtttttactcctaaaaccagcccagagaatgttcaagatcgatttgcattggtgactccaaagaaagaaggtcactgggattgtagtatttgtttagtaagaaatgaacctactgtatctaggtgcattgcgtgtcagaatacaaaatctgctaacaaaagtggatcttcatttgttcatcaagcttcatttaaatttggccagggagatcttcctaaacctattaacagtgatttcagatctgttttttctacaaaggaaggacagtgggattgcagtgcatgtttggtacaaaatgaggggagctctacaaaatgtgctgcttgtcagaatccgagaaaacagagtctacctgctacttctattccaacacctgcctcttttaagtttggtacttcagagacaagtaaaactctaaaaagtggatttgaagacatgtttgctaagaaggaaggacagtgggattgcagttcatgcttagtgcgaaatgaagcaaatgctacaagatgtgttgcttgtcagaatccggataaaccaagtccatctacttctgttccagctcctgcctcttttaagtttggtacttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggaaggacagtgggattgcagtgtgtgcttagtaagaaatgaagccagtgctaccaaatgtattgcttgtcagtgtccaagtaaacaaaatcaaacaactgcaatttcaacacctgcctcttcggagataagcaaggctccaaagagtggatttgaaggaatgttcatcaggaaaggacagtgggattgtagtgtttgctgtgtacaaaatgagagttcttccttaaaatgtgtggcttgtgatgcctctaaaccaactcataaacctattgcagaagctccttcagctttcacactgggctcagaaatgaagttgcatgactcttctggaagtcaggtgggaacaggatttaaaagtaatttctcagaaaaagcttctaagtttggcaatacagagcaaggattcaaatttgggcatgtggatcaagaaaattcaccttcatttatgtttcagggttcttctaatacagaatttaagtcaaccaaagaaggattttccatccctgtgtctgctgatggatttaaatttggcatttcggaaccaggaaatcaagaaaagaaaagtgaaaagcctcttgaaaatggtactggcttccaggctcaggatattagtggccagaagaatggccgtggtgtgatttttggccaaacaagtagcacttttacatttgcagatcttgcaaaatcaacttcaggagaaggatttcagtttggcaaaaaagaccccaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcccgaaaaagtagaacttgtaacaggagaagaagatgaaaaagttctgtattcacagcgggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacgatgaacctgaagcctctctctggatcagatagagcatggatgtggttagccagtgatttctctgatggtgatgccaaactagagcagttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactatgatttaagggaagatgctttggatgatagtgtcagtagtagctcagtacatgcttctccattggcaagtagccctgtgagaaaaaatcttttccgttttggtgagtcaacaacaggatttaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcaaaactctacagatatgataaagatgttggtcaatggaaagaaaggggcattggtgatataaagattttacagaattatgataataagcaagttcgtatagtgatgagaagggaccaagtattaaaactttgtgccaatcacagaataactccagacatgactttgcaaaatatgaaagggacagaaagagtatggttgtggactgcatgtgattttgcagatggagaaagaaaagtagagcatttagctgttcgttttaaactacaggatgttgcagactcgtttaagaaaatttttgatgaagcaaaaacagcccaggaaaaagattctttgataacacctcatgtttctcggtcaagcactcccagagagtcaccatgtggcaaaattgctgtagctgtattagaagaaaccacaagagagaggacagatgttattcagggtgatgatgtagcagatgcaacttcagaagttgaagtgtctagcacatctgaaacaacaccaaaagcagtggtttctcctccaaagtttgtatttggttcagagtctgttaaaagcatttttagtagtgaaaaatcaaaaccatttgcattcggcaacagttcagccactgggtctttgtttggatttagttttaatgcacctttgaaaagtaacaatagtgaaactagttcagtagcccagagtggatctgaaagcaaagtggaacctaaaaaatgtgaactgtcaaagaactctgatatcgaacagtcttcagatagcaaagtcaaaaatctctttgcttcctttccaacggaagaatcttcaatcaactacacatttaaaacaccagaaaaggcaaaagagaagaaaaaacctgaagattctccctcagatgatgatgttctcattgtatatgaactaactccaaccgctgagcagaaagcccttgcaaccaaacttaaacttcctccaactttcttctgctacaagaatagaccagattatgttagtgaagaagaggaggatgatgaagatttcgaaacagctgtcaagaaacttaatggaaaactatatttggatggctcagaaaaatgtagacccttggaagaaaatacagcagataatgagaaagaatgtattattgtttgggaaaagaaaccaacagttgaagagaaggcaaaagcagatacgttaaaacttccacctacatttttttgtggagtctgtagtgatactgatgaagacaatggaaatggggaagactttcaatcagagcttcaaaaagttcaggaagctcaaaaatctcagacagaaggaaaacaactttttatgtatagcttctaaaaggggaaaaaaaaaaaaaagagaaaccctttgacttccacgtgcccatctcaagacattccactcacagatttgaggttctggattccaggtctggagttttccaatgttaatgtaaacagaactggcacacacacattaagatgaatgtaattattattcctcttgctggtcactaccgtcgctttctatttctctttctttgtgtgaatttatttaaaagaaaaaaaactttttgtaacgactatttgcagtttaaaaatcaataaaccccgttttttcaag

SEQ ID NO: 37280 - DNA, 7294 bp, Homo sapiens
acacagtggtcctccgccggctacggcgctgcgtcactggtttgcaggcgctttcctcttggaagtggcgactgctgcgggcctgagcgctggtctcacgcgcctcgggagccaggttggcggcgcgatgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagacaaagccgttgaatgttacaggcgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactgcaaagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagagattgttgaaacttttgccaacaaaagcgggcagtctgcattatatgatgctctgttttctagtcagtcacctaaggatacatcttttcttggtagcgatgatattggaaacattgatgtacgagaaccagagcttgaagatttgactagatacgatgttggtgctattcgagcacataatggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaacgtagcaaaattgagacttctagttcagcatgaaataaacactctaagagcccaggaaaaacatggccttcaacctgctctgcttgtacattgggcagaatgccttcagaaaacgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaattcagtcatgcaggaactcgaagactatagtgaaggaggtcctctctataaaaatggttctttgcgaaatgcagattcagaaataaaacattctacaccgtctcctaccagatattcactatcaccaagtaaaagttacaagtattctcccaaaacaccacctcgatgggcagaagatcagaattctttactgaaaatgatttgccaacaagtagaggccattaagaaagaaatgcaggagttgaaactaaatagcagtaactcagcatcccctcatcgttggcccacagagaattatggaccagactcggtgcctgatggatatcaggggtcacagacatttcatggggctccactaacagttgcaactactggcccttcagtatattatagtcagtcaccagcatataattcccagtatcttctcagaccagcagctaatgttactcccacaaagggcccagtctatggcatgaataggcttccaccccaacagcatatttatgcctatccgcaacagatgcacacaccgccagtgcaaagctcatctgcttgtatgttctctcaggagatgtatggtcctcctgcattgcgttttgagtctcctgcaacgggaattctatcgcccaggggtgatgattactttaattacaatgttcaacagacaagcacaaatccacctttgccagaaccaggatatttcacaaaacctccgattgcagctcatgcttcaagatctgcagaatctaagactatagaatttgggaaaactaattttgttcagcccatgccgggtgaaggattaaggccatctttgccaacacaagcacacacaacacagccaactccttttaaatttaactcaaatttcaaatcaaatgatggtgacttcacgttttcctcaccacaggttgtgacacagccccctcctgcagcttacagtaacagtgaaagccttttaggtctcctgacttcagataaacccttgcaaggagatggctatagtggagccaaaccaattcctggtggtcaaaccattgggcctcgaaatacattcaattttggaagcaaaaatgtgtctggaatttcatttacagaaaacatggggtcgagtcagcaaaagaattctggttttcggcgaagtgatgatatgtttactttccatggtccagggaaatcagtatttggaacacccactttagagacagcaaacaagaatcatgagacagatggaggaagtgcccatggggatgatgatgatgacggtcctcactttgagcctgtagtacctcttcctgataagattgaagtaaaaactggtgaggaagatgaagaagaattcttttgcaaccgcgcgaaattgtttcgtttcgatgtagaatccaaagaatggaaagaacgtgggattggcaatgtaaaaatactgaggcataaaacatctggtaaaattcgccttctaatgagacgagagcaagtattgaaaatctgtgcaaatcattacatcagtccagatatgaaattgacaccaaatgctggatcagacagatcttttgtatggcatgcccttgattatgcagatgagttgccaaaaccagaacaacttgctattaggttcaaaactcctgaggaagcagcactttttaaatgcaagtttgaagaagcccagagcattttaaaagccccaggaacaaatgtagccatggcgtcaaatcaggctgtcagaattgtaaaagaacccacaagtcatgataacaaggatatttgcaaatctgatgctggaaacctgaattttgaatttcaggttgcaaagaaagaagggtcttggtggcattgtaacagctgctcattaaagaatgcttcaactgctaagaaatgtgtatcatgccaaaatctaaacccaagcaataaagagctcgttggcccaccattagctgaaactgtttttactcctaaaaccagcccagagaatgttcaagatcgatttgcattggtgactccaaagaaagaaggtcactgggattgtagtatttgtttagtaagaaatgaacctactgtatctaggtgcattgcgtgtcagaatacaaaatctgctaacaaaagtggatcttcatttgttcatcaagcttcatttaaatttggccagggagatcttcctaaacctattaacagtgatttcagatctgttttttctacaaaggaaggacagtgggattgcagtgcatgtttggtacaaaatgaggggagctctacaaaatgtgctgcttgtcagaatccgagaaaacagagtctacctgctacttctattccaacacctgcctcttttaagtttggtacttcagagacaagtaaaactctaaaaagtggatttgaagacatgtttgctaagaaggaaggacagtgggattgcagttcatgcttagtgcgaaatgaagcaaatgctacaagatgtgttgcttgtcagaatccggataaaccaagtccatctacttctgttccagctcctgcctcttttaagtttggtacttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggagggacagtgggattgcagtgtgtgcttagtaagaaatgaagccagtgctaccaaatgtattgcttgtcagaatccaggtaaacaaaatcaaactacttctgcagtttcaacacctgcctcttcagagacaagcaaggctccaaagagcggatttgagggaatgttcactaagaaggaaggacagtgggattgcagtgtgtgcttagtaagaaatgaagccagtgctaccaaatgtattgcttgtcagtgtccaagtaaacaaaatcaaacaactgcaatttcaacacctgcctcttcggagataagcaaggctccaaagagtggatttgaaggaatgttcatcaggaaaggacagtgggattgtagtgtttgctgtgtacaaaatgagagttcttccttaaaatgtgtggcttgtgatgcctctaaaccaactcataaacctattgcagaagctccttcagctttcacactgggctcagaaatgaagttgcatgactcttctggaagtcaggtgggaacaggatttaaaagtaatttctcagaaaaagcttctaagtttggcaatacagagcaaggattcaaatttgggcatgtggatcaagaaaattcaccttcatttatgtttcagggttcttctaatacagaatttaagtcaaccaaagaaggattttccatccctgtgtctgctgatggatttaaatttggcatttcggaaccaggaaatcaagaaaagaaaagtgaaaagcctcttgaaaatggtactggcttccaggctcaggatattagtggccagaagaatggccgtggtgtgatttttggccaaacaagtagcacttttacatttgcagatcttgcaaaatcaacttcaggagaaggatttcagtttggcaaaaaagaccccaatttcaagggattttcaggtgctggagaaaaattattctcatcacaatacggtaaaatggccaataaagcaaacacttccggtgactttgagaaagatgatgatgcctataagactgaggacagcgatgacatccattttgaaccagtagttcaaatgcccgaaaaagtagaacttgtaacaggagaagaagatgaaaaagttctgtattcacagcgggtaaaactatttagatttgatgctgaggtaagtcagtggaaagaaaggggcttggggaacttaaaaattctcaaaaacgaggtcaatggcaaactaagaatgctgatgcgaagagaacaagtactaaaagtgtgtgctaatcattggataacgactacgatgaacctgaagcctctctctggatcagatagagcatggatgtggttagccagtgatttctctgatggtgatgccaaactagagcagttggcagcaaaatttaaaacaccagagctggctgaagaattcaagcagaaatttgaggaatgccagcggcttctgttagacataccacttcaaactccccataaacttgtagatactggcagagctgccaagttaatacagagagctgaagaaatgaagagtggactgaaagatttcaaaacatttttgacaaatgatcaaacaaaagtcactgaggaagaaaataagggttcaggtacaggtgcggccggtgcctcagacacaacaataaaacccaatcctgaaaacactgggcccacattagaatgggataactatgatttaagggaagatgctttggatgatagtgtcagtagtagctcagtacatgcttctccattggcaagtagccctgtgagaaaaaatcttttccgttttggtgagtcaacaacaggatttaacttcagttttaaatctgctttgagtccatctaagtctcctgccaagttgaatcagagtgggacttcagttggcactgatgaagaatctgatgttactcaagaagaagagagagatggacagtactttgaacctgttgttcctttacctgatctagttgaagtatccagtggtgaggaaaatgaacaagttgtttttagtcacagggcaaaactctacagatatgataaagatgttggtcaatggaaagaaaggggcattggtgatataaagattttacagaattatgataataagcaagttcgtatagtgatgagaaagggaaccgtcgacgcggccgcgaatttagtagtagtaggcggccgc

SEQ ID NO: 37281 - DNA, 2313 bp, Homo sapiens
acacagtggtcctccgccggctacggcgctgcgtcactggtttgcaggcgctttcctcttggaagtggcgactgctgcgggcctgagcgctggtctcacgcgcctcgggagccaggttggcggcgcgatgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagacaaagccgttgaatgttacaggcgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactgcaaagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagagattgttgaaacttttgccaacaaaagcgggcagtctgcattatatgatgctctgttttctagtcagtcacctaaggatacatcttttcttggtagcgatgatattggaaacattgatgtacgagaaccagagcttgaagatttgactagatacgatgttggtgctattcgagcacataatggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtgtaagtagtaaaacaaaaatattgctttcacttagtgcgtaggttttaccggggatttaatcctcatgtgaagatttaatttgtcatgtgacccattaacatatatgtatgtaagccctgaactgtgtatttagaaagcaattttagtaaattgaactattttttagacctggaaacgtagcaaaattgagacttctagttcagcatgaaataaacactctaagagcccaggaaaaacatggccttcaacctgctctgcttgtacattgggcagaatgccttcagaaaacggtgagttttaaagtataagcatttttaaagaacattaccttaattttttaaaatcatgaactttttattgaaagttttttttttctgaaaacagcagcttggtcacattatgacagatgtgttttttattgctgcaaaatagttaatgtagttaaatataagcacttagaggagcaatgcctggcacacagtgaatgttacatattagctgagctgttactgttattccttaataattaagttctgataattattcagcctgaa

SEQ ID NO: 37282 - DNA, 1448 bp, Homo sapiens
acacagtggtcctccgccggctacggcgctgcgtcactggtttgcaggcgctttcctcttggaagtggcgactgctgcgggcctgagcgctggtctcacgcgcctcgggagccaggttggcggcgcgatgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagacaaagccgttgaatgttacaggcgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactgcaaagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggtaagtcttccacttgtaggagcaattgacatttcactgagtcttgatgtgtttgaaatgaaggtgtgctctggtatgtaatgacaatatgtgaacaaacctgtggaattaaagttgaaatagtcaatttgatacagtggaaaataactaagcatacacaatactggtgaggctggtgaaacagggatgttgaatgcactcttgttgaaagcctgcattgccatgatttgtttgtagacaaatttgaagagtttgatctttttactctgccatttttgggaacatgataaagatgtaatctcgtattatgggtaaagcttgattcagaaagatgtgttacttggac

SEQ ID NO: 37283 - DNA, 361 bp, Homo sapiens
gtccataattccacatcatactgatctttcttagaaaaggcaacagttactttcttctttattccttttttaatgcttgtgaggtagttgttcttgttgatcacagcaatgctattctcttattcttcatgtcatatttagcagtttttttctagtttgtcatttgataatcttgattggtgtattttgatgtacagaaatttaaaatttatgtagttaaatctttctttaatttctattgcctttgtatttatagctcttgcctagatagtcttaactgtagtatagactttaacagtgttttctttattttctttttgtttttttagttgcaactactggcccttcagtatattatagt

SEQ ID NO: 37284 - DNA, 317 bp, Homo sapiens
gtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtaagcaaagattttaacaaattaaatattctgaattttgtttaattttttttctaacttaacttttccttaaatgaaacaggtatttctccttggagtagtatataccagccacttacaattaaaggagaaatgtaattctcaccacagctccta

SEQ ID NO: 37285 - DNA, 646 bp, Homo sapiens
gggaaagcaagatagtttcatttggatttggaagtagcacagggctctcatttgcagacttggcttccagtaattctggagattttgcttttggttctaaaggtaagatcaagaggagagacttttaatgacattgttacagaatcaagcacaactgaaaaactagttttttgttgcagtttttagtttttagtttttagttgtttagtttttagtgttttaataatgaagggcttctacactttattttttgacgtcaatataatcttaagaattttctcttaattttatataagccatgctgatagtcctccccattctgaaatgcagaaccatttttgagctttggaatgactctgactttgatccttactcttttaactatactttcatatgtgatttgttaatatttcaggatttgtgagtttatactttttaaggatatgattttgtagttttcttttttgtactatctttggatttcagtattagggttgtgctaatttattgtgctaagtttataattggtgtgcttgcccatcttctttagtggagtttctatttttaatccattttggtaacatttctagaaaagaatccatttccctgattgtatccggtttactagtgtaaggccattcattat

SEQ ID NO: 37286 - DNA, 592 bp, Homo sapiens
ggacaagaacattgttctaggaaaattactttgtcattttttaacctcagtcagtagctaatatttctcttcagtagcaaacacttttgaaacctctctgtcctataaagaaaagcatttaatttccaaagggaaaatgaatattatataaaagaaaatgtttaatgataaatcaggtctttactccctcagccaaatcagatatattcctagccctaagatatataaccagttatcacattaacaaattctctttgtcatcacaaagaaaatgccttaaaagaatttggatctttgaaatttgtcatggaatttattataagcagcagcttatagagaatttcatctcctattataggtagaagtaaaatctggagaagaagatgaagaaattttgtttaaagagagagccaaactttatagatgggatcgggatgtcagtcagtggaaggagcgcggtgttggagatataaagattctttggcatacaatgaagaattattaccggatcctaatgagaagagaccaggtttttaaagtgtgtgcaaaccacgttattactaaaacaatggaattaaagcccttaaatgtt

SEQ ID NO: 37287 - DNA, 373 bp, Homo sapiens
gatctagtagaaactaagggatgggaaaaaccttttcatttttcatcttctttccaacaatatgaatttcttagttttcaaactatactcaggaaagctgggctttaggatttaacatgtagtgatgagttctgtgtgtattttaatattttactcaggattcctattaattgaaaaaaatttttaacttttttattataaatctttttttcagggaggagatatcaccaaacatgatggaacaggcggacagtccatttatggagacaaatttgaagatgaaaattttgatgtgaaacatactggtcctggtttactatccatggccaatcaaggccagaataccaataattctcaatttgttataacactg

SEQ ID NO: 37288 - DNA, 398 bp, Homo sapiens
ggcaggcacagaaggttaaagagggttctaaggtggaggatttatcactgctcactctggatagagagatcgcaggataaggggagcaatttttctctagaaaaataaccctggaaaaacattattttcctctttttagagccacttaaatgcaaaagcagaaaacgacaagttgaacatgaatagatgaatatatgatatatgaatatagtttgcctgtgaaggtgcaacacctacagtatgaaacattttgtgttaaaatagagtttatggctgggcacggtggctcacgcctgtaatcccagcagtttgggaggctgaggcagaaggatcgcttgaccccaggagtttaagaccagcctgggcaacacagcgagaccctgtctcaactgaaaaaa

SEQ ID NO: 37289 - DNA, 496 bp, Homo sapiens
attcaaatacaccagacaccttcactcccaggtgcatctgcaaggggcaggcagatattccccagctggtgcccagacccaaaccaattctctcctttttggggtcttgaaacatccctggggaatatagcagcttccaggctacaactgagcagctatgagtgtcaaagcctcaaaacctggaacctggaagtccatgctgagtgtttggataagacaatgtcccagcgacacaggtctagacctggccacactgttcaatcctggagcacaaacaccactccagggcttcatgacctggccatgccacctctcctgcctcttctcttgctacctccccattatgtccttcactccagtcaggccaaaccacaggcaattcctggaagttgcattgcactaactttgcccatgaagttccctctgatggggaggctcttccacctgacccaataagcctcagctcagctcccctctttcattaagctttccctaa

SEQ ID NO: 37290 - DNA, 784 bp, Homo sapiens
aaatgtaatagttggtgtcttttggtatagctaacttttaaacagtacaggtggctcttggacagtcactgttttaaacaagcagcagtaaggcagactgaagacagtaggaaaaatgatcaacatggtggaaggaaagaaagcagtcagtaacaacttatataataatttgcaggaactcttagaactgaaccttacagttaagttgtgatatctggggtagattgtattatttccttatttcagaagaactgaggccccaggtcacatggctgtttatctgcagagctggcattccactctgcttagctaagtgctccctcaaccttgatgctatttttcctgagctgggtgccaggggagcttggatatgtaaagcttggttgatgtccttgataggtgcatggttctaagattgtgattttcatcctaagtttaggaagttacacacctgcgtggacaaggtgggtctaattatttttcattctggtttaatgttgacaagaaaacagacatggaagaggactttcctgcactcctggtcttccttttccttaagtagtgctacaagggtctgaccggaagatctttttactggtggcttgctgcttaatataatacaggttttgagtacaatcatttcttcgtattgtttttaaagtagagcaatgatatgactagtctgaagtgaacatagtctagaagtcacttgcttggtttggggattagaagtatttgcaaggtgaaccacccattctcttctgcttatttacactacactgct

SEQ ID NO: 37291 - DNA, 370 bp, Homo sapiens
aagctggaaactgggttccagtcctggctctgtgcctctctgagtctcattgcaaaatagaggtcaccagaaggattactggatgaaaaatgaggtagcattgcagacgtgcatggcacgtacactctaggttgcttcctagacagaaagctcagttcgaggctggtggcatccatgctggcagcagccaactgtctgcgacagagtgaggaggggcatgccacgtgaaggaccagcatcagaatgacatgggaagaaactctcacaatagcagaagaaagagctccttcagcctaacatgtagaactcaagtcttcttgtcgcgcttctgtcccctcgcccctcctcccccactgagaactagctttta

SEQ ID NO: 37292 - DNA, 958 bp, Homo sapiens
caggtggactttaaagaatccccctttggggctctgcgcagtcagtttaacattatcacaaatatttttcattttaattgtggtaggacctttgaatttgttcatcaactggaaagaaatcctaccctctgtagacacatacacacacatttatatatctatgtgtttgaattgtgactagtatagcactttacattttctcaagtaacaggaagttattgccttcaatattgattggaaattgttttctattgaagtctatactgtagagttttccatttatattgagagtttgaacaattaagctcctattggaacttttccttaagccacatgagcatgaacaatctctgtgacacttgggtgctagagaaacacaacagtggctaaagtagccaagagcaagactgaatgtatagcagagtgccttgttagagtggtaacctagtcttggaagcaattcagtggatgtttcataaagaggactagaacttcaagaagcctcctgtgctggctgaggtgagcccttttggtatatgtacactactgggttgcctagaagccaattcatgaagaataacagcaggatgagaaaaagagtcactgtaacctgtggaacaacaacgtaagaatcaccaacccctaggctgagctagaactggaagccaggaatatggcaatgagtttcaagatttgccctcagaagatgaactgggtgaggtatgggttgaggtgagggcacaagcactcatcctacctaccctgctgctgttgaggagctagaagtaaaacatattggttaggattttaacagttggagtagcctcccattatcagattaagtgggggtcacttttgcttccaaactcagaataagtttgtaaacatgggaaagtctaagccaagagatctaaagctctagaaatattaatgacatttctgggagtaaaactactaa

SEQ ID NO: 37293 - DNA, 818 bp, Homo sapiens
caggtggactttaaagaatccccctttggggctctgcgcagtcagtttaacattatcacaaatatttttcattttaattgtggtaggacctttgaatttgttcatcaactggaaagaaatcctaccctctgtagacacatacacacacatttatatatctatgtgtttgaattgtgactagtatagcactttacattttctcaagtaacaggaagttattgccttcaatattgattggaaattgttttctattgaagtctatactgtagagttttccatttatattgagagtttgaacaattaagctcctattggaacttttccttaagccacatgagcatgaacaatctctgtgacacttgggtgctagagaaacacaacagtggctaaagtagccaagagcaagactgaatgtatagcagagtgccttgttagagtggtaacctagtcttggaagcaattcagtggatgtttcataaagaggactagaacttcaagaagcctcctgtgctggctgaggtgagcccttttggtatatgtacactactgggttgcctagaagccaattcatgaagaataacagcaggatgagaaaaagagtcactgtaacctgtggaacaacaacgtaagaatcaccaacccctaggcagaagcaggaagcgcgtcctgcttctgccagggtgttgccattcaggtccagcttcttcagttctgtctttgtcttccttgtgcctcttgctacattctcaggtcagtcatcctctcttgatctctactgtatgtacttttctgttcttttagtcttttttttttttttt

SEQ ID NO: 37294 - DNA, 238 bp, Homo sapiens
tcaaaaaatgttaaaaaataagaatgcaggtgttaagacttgtaaatgatgttttgccagaatcctccagaacaatgctgaaaatacctcccactcccacccaagctttccagggaacaccatgtttagggccttaagtaatcctttgagtcttagcaaacttatattttgcttggttccattttaatacaaaatgaacatatggtctggaaacagaagtttgtctatttggcggtta

SEQ ID NO: 37295 - DNA, 204 bp, Homo sapiens
taactgagaggcttcctttatctaccaattcatgaaactagaaacctgagagtccattttgattcctcccattccctctctttgcctcctctcccacttccagttcatttacagtcctagcttgtaaatgctaactcccaaaacctcttgaatccacctacttctacccaggtccactgccaccactcttttttactttaccat

SEQ ID NO: 37296 - DNA, 2441 bp, Homo sapiens
aaataataataataaaatacaaatacttagaaattaacttcgcctttgccttcaggcacttttgctacatgttagcatcagaggctattgtacaactagatggttattccctgtttcttggccgatttttggtacctttctttgaagaagagggttagattttaagaaagaaagtgtgcttatttcactcatgtctttgcagaatttaactttgctttactttaaaaattccaatcatcatgtacctataaaggttaaaatatagtgaaagtttctgcttcatgtgaattcaattctgagcacctgcaggtcatatcaggtgtctgatgcagttacctttatagatcgtggcaggtccttacatttcaacaggcttatgcatttccatggggggaagagattctgtttctaggaaattacaaagggcacaccactgcagggagtgtaaacaattctttgttgcaacagacaagattttttttaaaaaaagaaaaaaggatgcattttaggtacacagggtatggacgcattcaacatttacttttatctccacagatgccaacctccccttgttgcaggcagttgggcttttccaactcattgctaacaaagctggcatctgcattaatttcaatgagaatttcaagtactgaagatgaaaagttggggagattcatgtttgaaaaatgaaaaatgaacaaaaaatccaccttgtgcagtgagatagctaacgctgatatatcaggaataattttaaactatttttgctgtaatgtgtagctttaatgtctcttttcagttatggacccataaaagtattcctatatcttgtgaataaagatcattcttgtggactagtacgtggatgcattcataggctttgggaagcagtggtgtgcgtatgtgtgtctatatcaatattttatgtttataactctgcgtattaagtttatatagaaaaaaataatgtctttctttagtgtttgggggactcaatggtaatatgaccattgcagtgtaatctgactgctcactctagagaacacttctgttatacacaatgcacatacaaacatacacccctaaagcgtagctaactgctcccactagataattgctgctaaaaacaaaacaaaacaaaacaatacaaaacaaaaaaaaccctaagtaatggaggaagaaatagcattcttttaaaaggggcttttctgaagagtaaaatgtaaatacaggacatgtggggagggtggggccgcctgcaaaatgtcctgaagatggacaaatagccttttaaattctactttttaaccatctttaccgtgtgtgcctatttgtattgcagatgtgaactactatttttggaggttgatatcagtatgttttgaaactgaattattacataaaatcagagtaacctctttctccatcctccttttccacactattcttgccaaatatttctactgaaacccagtttcagcaaggcaaaatgatgggactctcaaacctccctcctcatcttcccttcccctctgtcttatgcctggcctggccttttttgttgttgttggcttttcataagtaagaaaaatttattgtagtatttcaagactgcagaatttcaagtgtatatctataaatctttttttaaaatcttcggctacacagtaacatcaattaaaacagaagagtgagtctaagtctgtaatatgctgtaggaccagataagattttgaatgagactaaacttgactgccatattttaagaggaaattgaaactttatggtggagaatggatgagagcaagtctatgatatatatgtagtcattgtataattagaaacaccaaatgctgaatcctatcactgtgttcttgggggccaggccttggatttggttgtcatttaaactccttgaagattatatgtaattataatgagcagaaggcaaataaagtttttgaacaaaagcccttgttttcagtatttaaaatttggtaatatattttctttttcagttaaactatcttccccacaaaaaatattatacttcagttaaactatcttccccacagaaattattatactacgaacaagttatgagtgagactgagaagcttgaagaagctggtttttaagcagctcatataatattttgtgttaaagaaagtgtcattgtttcctgttgggaggcaaataacaacaacaacaaaagaaattgtcatgattctttctgagccaaactgtcacgaaatgttctgtgacagaaccactactcttttttctgccattctgcctactggagagttctatgttgtatttgtttttaatccttgattttaaaaatattaatggttttagtgttgcttagcttcagtttgaagtataactttcactaataactgcaataaaaagaaaagctttgctcttaaactttctct

SEQ ID NO: 37297 - DNA, 2055 bp, Homo sapiens
ataatatcacgatcatagcatagtagtaaggtcatcagggcggatccatatgctgtggcagggcgtcaagaatgccaactggttggccaaagccatccattccaaggctgccaggaaatgaatgcgtccgttcgacggacgcattcaacatttacttttatctccacagatgccaacctccccttgttgcaggcagttgggcttttccaactcattgctaacaaagctggcatctgcattaatttcaatgagaatttcaagtactgaagatgaaaagttggggagattcatgtttgaaaaatgaaaaatgaacaaaaaatccaccttgtgcagtgagatagctaacgctgatatatcaggaataattttaaactatttttgctgtaatgtgtagctttaatgtctcttttcagttatggacccataaaagtattcctatatcttgtgaataaagatcattcttgtggactagtacgtggatgcattcataggctttgggaagcagtggtgtgcgtatgtgtgtctatatcaatattttatgtttataactctgcgtattaagtttatatagaaaaaaataatgtctttctttagtgtttgggggactcaatggtaatatgaccattgcagtgtaatctgactgctcactctagagaacacttctgttatacacaatgcacatacaaacatacacccctaaagcgtagctaactgctcccactagataattgctgctaaaaacaaaacaaaacaaaacaatacaaaacaaaaaaaaccctaagtaatggaggaagaaatagcattcttttaaaaggggcttttctgaagagtaaaatgtaaatacaggacatgtggggagggtggggccgcctgcaaaatgtcctgaagatggacaaatagccttttaaattctactttttaaccatctttaccgtgtgtgcctatttgtattgcagatgtgaactactatttttggaggttgatatcagtatgttttgaaactgaattattacataaaatcagagtaacctctttctccatcctccttttccacactattcttgccaaatatttctactgaaacccagtttcagcaaggcaaaatgatgggactctcaaacctccctcctcatcttcccttcccctctgtcttatgcctggcctggccttttttgttgttgttggcttttcataagtaagaaaaatttattgtagtatttcaagactgcagaatttcaagtgtatatctataaatctttttttaaaatcttcggctacacagtaacatcaattaaaacagaagagtgagtctaagtctgtaatatgctgtaggaccagataagattttgaatgagactaaacttgactgccatattttaagaggaaattgaaactttatggtggagaatggatgagagcaagtctatgatatatatgtagtcattgtataattagaaacaccaaatgctgaatcctatcactgtgttcttgggggccaggccttggatttggttgtcatttaaactccttgaagattatatgtaattataatgagcagaaggcaaataaagtttttgaacaaaagcccttgttttcagtatttaaaatttggtaatatattttctttttcagttaaactatcttccccacaaaaaatattatacttcagttaaactatcttccccacagaaattattatactacgaacaagttatgagtgagactgagaagcttgaagaagctggtttttaagcagctcatataatattttgtgttaaagaaagtgtcattgtttcctgttgggaggcaaataacaacaacaacaaaagaaattgtcatgattctttctgagccaaactgtcacgaaatgttctgtgacagaaccactactcttttttctgccattctgcctactggagagttctatgttgtatttgtttttaatccttgattttaaaaatattaatggttttagtgttgcttagcttcagtttgaagtataactttcactaataactgcaataaaaagaaaagctttgctcttaaactttctct

SEQ ID NO: 37298 - DNA, 358 bp, Homo sapiens
accccaaggttttcctaaggcaaatgaattccttgaaaatctcttgggagaaaaagtgcattcataatttaaatgactatgctgctaatttatctgttacaaaagctcagaaccttgtgtctcttttgtctttcaaagtgatatacactgaggctccaaaattctgctctagaaaaattatggtggaaatctcttgggagccctgggtttgtgtgccaattttgtagccctgggcaagtcaccttattcctttgggcctcagtttccccacatctgtagaccgggttgtggaacggcaccaaggtcttgcctggcttcaacactctccatctagactcagggctaacgctcactgttg

SEQ ID NO: 37299 - DNA, 198 bp, Homo sapiens
ggataagactcagggagatgctgcaggaagcacgggcaggagagaaaaagcagaagctttggacagatcatcgggctaaagccacagctaagaaagtgaccatctctggagagacctttaatgtcttctgatggcctaccaatgacctccacgctcaaagagaaaattctgcaattaagaaattagctgggtgagttc

SEQ ID NO: 37300 - DNA, 2481 bp, Homo sapiens
acagctatcaggatgactacggattcactggccgtagatttaaaccaagaaaatggtatcacctttgttatataaatcctttctgctttgtaagttttctctttttgggattttccgcagatcagggcaacacagaatgactaccttcccagccatgtctctgcagtcatcctgtgtaatcatgttctagtccagtgttgctcaaacagttaaaatccaggctgcttttggtaaacatacaaattctgatatagagcctctgtggcaaagggaatttctcagttcctgccccagcccccttgtttatcattacacagctaagatttttatttaacttagcattttagcaagttttcttatgaaaatacctttgtgctttctaagtataaagatttaaattatttttaatacggtttttagaaccacagactatccctctttttagagcatcctgatcaattgcaagtacttccacttcttccctaaatgcgctttgtgtgttttccacctcagtagccttgcacacatcattacttctgcatccttctttgtgaccaagtgaatacctacctacctcttaggactcagcttcagtgattctgttttcataggctttttaaagcccttttcagtcaaattagatgctcctttgttctggtcctttactcttcccctcccatgttgtcgcactgatcacactgctttgtaattattttctttattgttggtaaactccatattttaaaaatttacctgtatacatagtgcttaatgcatggtaggcccttagtaatgtttttgaattaatgaggcatgattctaaatgccaaactttgcacaaaaagttgttgctattggattccaaactgctatgccctctataccagtggctgacaaggcatatagggatatatgccatcctgagaggagtaaagtgtttagattctgaacctgagaaaagagaactttctcttaagaagttggaaacttcattttaccttcgtgaccctggtagaccacttggtctcactggttggtacaattatgagggtagtactgggtgctttttatacaactttccatcccccacacagttggagaataatttgtagaccatggcagttaaaatgctttttactctggtgtattatagaataatgaacacatttttatatatgttaaagcctgctaaatcattcacttagaatgaagtaacctcaaggtaccaaataccccacataaggaaagtactacactaaattcactcaactattgtatgcctaccatatgccagattttatcctagaccctgaggatatagctttttaaaaccccctcctgtttcagagcttatattctagtggaggaagttagacaagcattttaagtaataaatgtatagagagtgtcaagtgatgagtaccatgaagaagaataaatgagggtaaggggctagtgtgatagggagaggggtgggatgccatcatatttaggggtggttgggaactgtctactgctttagcatttgtgtcttcaaatttctctcctttggttatataccttgcgtattccgcacattgataaagtttctttcttacagaagttctgatattgaattaaggaatgggtcactacttaagactttatcatttcagctacacataaaaggtttctctcccctatggattttgctaatggttgagtgatacctaaaggccttgttgcattttttacacttggggtttctcttcggtttgaattctctcatggttaccaaaactctgttaaaggacttttcacagtcgttaaatgtgtatggctctttcccaatatgaatttttttgatgttaactaggcttttagacttagttaaagacctgtgtgctctgctgcatttatagggttttgggctgctgagaataattgatgctgattaaggtgcaaatcatgactaaagacttttctttcttcttttgcatatagtagagtgaggtgagggtcgtggctaaaaccccacaataactttacattcctagctttacagtcttgctgtgaattctctggtgttcattaaagtgtgagctgtgttaaaaggcattcttagattcattttaaccacatttttaaaaactcacagttggttaacatgatggtttcagattgcttgcctcttttctctttctaccttacagggctccttttctagcttaaataagggtactccatctgccacagaatccaggattctatagttttttagtttcacttccctatgttctttttttttttttaatttttaacaatgagatgataccatgttacagcggtattacattaagatacatttaatatagccacaattaaagtatgtattatgtatttatgctggtgttctttcatgttatttcttctagtgaaaatttccaagtaaactgttattgagcatatacatttttaaaaaaataaaaccatacaccccta

SEQ ID NO: 37301 - DNA, 2447 bp, Homo sapiens
  misc_feature (1677)..(1677): n is a, c, g, or t
ggcgtcacttccgcctccagcctccgggccgaagcttggcctatggtgcggggaggtagtagtttcttccgcgagggtgcgggagggccccggggcgcccttgggaaccgggctggaggcagagacaggcccggaggaccaggcggacgtaaggatcaggcctctggacgcaactgcggagccggaacagaccaggagggcgcggttgggcgggtacagccaggaagtgctcgtcgcgagcgcggccgcggttcggccacagcgagaagcccgcgggtgccgggagtgctcggtcttctctcgatctctgcagggagtcactggccccgttcctttttatctgtctgaacatcacgccgaacttttaacagttgattccactgcattttcaatgtggtatttttttttttctgtaaatgttcatctatttttcgcttcaaatatgcgtttctgttacttttctaatgtaccgtaggagccaagaccacctatactacgttgcaaaatagcactgataccaggggttctcccaaggttcattcagaaatgtcacatgattccagtaacaatacgaaaaggtttttttttgggaaccaggcatatggatcctggagttcacatggaggaacaaatgtctcataacgcagacgacgcggacaaacaaaagcgcaatgcccgacagatgcgaaaacagcctctgtcattaaaactgtgtgctactgacacatgaacaggaaacaaatggaatatccagacatcaacccagtaacatggaaatttggttcataaacataatttcagagcggtggaacaaacatgcagtttataatgaaaggtgctaagacaaatggttagccgtctgagaaatgatgaaattaattctggatctcacagggataaactccaaacggatcaggagtctaaatgtgaaaaacaaaacaaaaccacatgtgaagtgttcacgtgatttcgtggctgattaagaaacaagatgtgcccaggaggtggcggtggcgcacaagctttgacaggttggagggtgagggagtctcacgcaccatgagattacccacaggcttcgaattgggggtcactactcagaaaagagaaaaaaatgagcgtgggcggggggcgcgcagagaactcccagagaagaaggagatcagacagggggagggctgacgtgactagatcacgtttctcagcagcctgacaggtgtctgagtcacaaagctctgaagggcagcaacggcttgcagtctttagagccccaggatttatcttatctatggctagcagagattggacacaatttcacgaagtatacaaagcaaccacatgctaaatggttcaacactatgagtgtttgggatgtgttttatttattatttattaattttgatacggagtctccctctgtcgtccaggctggagtgcagtggcacgatcttggctcactgcaacctccgcctcccaggttccagctattctcctgcctcagcctcccaagtagctgggattacaggtgcccaccttgtaatttttagtagagacggagtttcaccatgttggccaggctggtctcaaacttctcacttcaggtgatccacccgcctcggcctcccaaagtggtgggattacagacgtgagccactgcagccaccgtgcctgcccttnggatatgtttttttttcttttaattttgttttgttttgtttttttgagacgaagtcttgctctgtcgaccaggctggagtgcaggggcacaatcttggctcaccgcaacctccgcctcccaggttcaagcgattctcctgcctcagcctccagagtagctgggattacaggcacgtgccaccaagcccagctaatttttgtatttttagtagagatggggtttcaccatgttagccaggatggtatctatctcttgacctcgtgatcctcctgcctcagcctcccagactgctgagattacaggcgtgagccaccgcacggatatgttttaagtaactgaatgtattaaaatttgactttggcaccagcaggctattgtgaataatgttgctttgagcatcgtgtgcaaaaatatcctggacccttgttctcagcacttttggatatatatgcaaaagtggaatggctgggtcacatgataattctgtctgatgttttgagaaaccactgtcctgttttccagagctgctgcaccattttgtattcccatgagcaggtgcacaaggttccaactttaccacatccagccaacagttacctcctatttaatggctaagagccatcaccaccggggtaatgtgatctcactgtggcttttgttttcatttccctaatgtttagttatgttgatcatcttttcatgttcttattggccatctgttatcttctttattataagtccttttctgaattaaattggttttgttgtt

SEQ ID NO: 37302 - DNA, 2498 bp, Homo sapiens
  misc_feature (1677)..(1677): n is a, c, g, or t
ggcgtcacttccgcctccagcctccgggccgaagcttggcctatggtgcggggaggtagtagtttcttccgcgagggtgcgggagggccccggggcgcccttgggaaccgggctggaggcagagacaggcccggaggaccaggcggacgtaaggatcaggcctctggacgcaactgcggagccggaacagaccaggagggcgcggttgggcgggtacagccaggaagtgctcgtcgcgagcgcggccgcggttcggccacagcgagaagcccgcgggtgccgggagtgctcggtcttctctcgatctctgcagggagtcactggccccgttcctttttatctgtctgaacatcacgccgaacttttaacagttgattccactgcattttcaatgtggtatttttttttttctgtaaatgttcatctatttttcgcttcaaatatgcgtttctgttacttttctaatgtaccgtaggagccaagaccacctatactacgttgcaaaatagcactgataccaggggttctcccaaggttcattcagaaatgtcacatgattccagtaacaatacgaaaaggtttttttttgggaaccaggcatatggatcctggagttcacatggaggaacaaatgtctcataacgcagacgacgcggacaaacaaaagcgcaatgcccgacagatgcgaaaacagcctctgtcattaaaactgtgtgctactgacacatgaacaggaaacaaatggaatatccagacatcaacccagtaacatggaaatttggttcataaacataatttcagagcggtggaacaaacatgcagtttataatgaaaggtgctaagacaaatggttagccgtctgagaaatgatgaaattaattctggatctcacagggataaactccaaacggatcaggagtctaaatgtgaaaaacaaaacaaaaccacatgtgaagtgttcacgtgatttcgtggctgattaagaaacaagatgtgcccaggaggtggcggtggcgcacaagctttgacaggttggagggtgagggagtctcacgcaccatgagattacccacaggcttcgaattgggggtcactactcagaaaagagaaaaaaatgagcgtgggcggggggcgcgcagagaactcccagagaagaaggagatcagacagggggagggctgacgtgactagatcacgtttctcagcagcctgacaggtgtctgagtcacaaagctctgaagggcagcaacggcttgcagtctttagagccccaggatttatcttatctatggctagcagagattggacacaatttcacgaagtatacaaagcaaccacatgctaaatggttcaacactatgagtgtttgggatgtgttttatttattatttattaattttgatacggagtctccctctgtcgtccaggctggagtgcagtggcacgatcttggctcactgcaacctccgcctcccaggttccagctattctcctgcctcagcctcccaagtagctgggattacaggtgcccaccttgtaatttttagtagagacggagtttcaccatgttggccaggctggtctcaaacttctcacttcaggtgatccacccgcctcggcctcccaaagtggtgggattacagacgtgagccactgcagccaccgtgcctgcccttnggatatgtttttttttcttttaattttgttttgttttgtttttttgagacgaagtcttgctctgtcgaccaggctggagtgcaggggcacaatcttggctcaccgcaacctccgcctcccaggttcaagcgattctcctgcctcagcctccagagtagctgggattacaggcacgtgccaccaagcccagctaatttttgtatttttagtagagatggggtttcaccatgttagccaggatggtatctatctcttgacctcgtgatcctcctgcctcagcctcccagactgctgagattacaggcgtgagccaccgcacggatatgttttaagtaactgaatgtattaaaatttgactttggcaccagcaggctattgtgaataatgttgctttgagcatcgtgtgcaaaaatatcctggacccttgttctcagcacttttggatatatatgcaaaagtggaatggctgggtcacatgataattctgtctgatgttttgagaaaccactgtcctgttttccagagctgctgcaccattttgtattcccatgagcaggtgcacaaggttccaactttaccacatccagccaacagttacctcctatttaatggctaagagccatcaccaccggggtaatgtgatctcactgtggcttttgttttcatttccctaatgtttagttatgttgatcatcttttcatgttcttattggccatctgttatcttctttattataagtccttttctgaattaaattggttttgttgttattcttgagttataggagttcttaataaactgaatattaatccttaagcaa

SEQ ID NO: 37303 - DNA, 2439 bp, Homo sapiens
  misc_feature (1677)..(1677): n is a, c, g, or t
ggcgtcacttccgcctccagcctccgggccgaagcttggcctatggtgcggggaggtagtagtttcttccgcgagggtgcgggagggccccggggcgcccttgggaaccgggctggaggcagagacaggcccggaggaccaggcggacgtaaggatcaggcctctggacgcaactgcggagccggaacagaccaggagggcgcggttgggcgggtacagccaggaagtgctcgtcgcgagcgcggccgcggttcggccacagcgagaagcccgcgggtgccgggagtgctcggtcttctctcgatctctgcagggagtcactggccccgttcctttttatctgtctgaacatcacgccgaacttttaacagttgattccactgcattttcaatgtggtatttttttttttctgtaaatgttcatctatttttcgcttcaaatatgcgtttctgttacttttctaatgtaccgtaggagccaagaccacctatactacgttgcaaaatagcactgataccaggggttctcccaaggttcattcagaaatgtcacatgattccagtaacaatacgaaaaggtttttttttgggaaccaggcatatggatcctggagttcacatggaggaacaaatgtctcataacgcagacgacgcggacaaacaaaagcgcaatgcccgacagatgcgaaaacagcctctgtcattaaaactgtgtgctactgacacatgaacaggaaacaaatggaatatccagacatcaacccagtaacatggaaatttggttcataaacataatttcagagcggtggaacaaacatgcagtttataatgaaaggtgctaagacaaatggttagccgtctgagaaatgatgaaattaattctggatctcacagggataaactccaaacggatcaggagtctaaatgtgaaaaacaaaacaaaaccacatgtgaagtgttcacgtgatttcgtggctgattaagaaacaagatgtgcccaggaggtggcggtggcgcacaagctttgacaggttggagggtgagggagtctcacgcaccatgagattacccacaggcttcgaattgggggtcactactcagaaaagagaaaaaaatgagcgtgggcggggggcgcgcagagaactcccagagaagaaggagatcagacagggggagggctgacgtgactagatcacgtttctcagcagcctgacaggtgtctgagtcacaaagctctgaagggcagcaacggcttgcagtctttagagccccaggatttatcttatctatggctagcagagattggacacaatttcacgaagtatacaaagcaaccacatgctaaatggttcaacactatgagtgtttgggatgtgttttatttattatttattaattttgatacggagtctccctctgtcgtccaggctggagtgcagtggcacgatcttggctcactgcaacctccgcctcccaggttccagctattctcctgcctcagcctcccaagtagctgggattacaggtgcccaccttgtaatttttagtagagacggagtttcaccatgttggccaggctggtctcaaacttctcacttcaggtgatccacccgcctcggcctcccaaagtggtgggattacagacgtgagccactgcagccaccgtgcctgcccttnggatatgtttttttttcttttaattttgttttgttttgtttttttgagacgaagtcttgctctgtcgaccaggctggagtgcaggggcacaatcttggctcaccgcaacctccgcctcccaggttcaagcgattctcctgcctcagcctccagagtagctgggattacaggcacgtgccaccaagcccagctaatttttgtatttttagtagagatggggtttcaccatgttagccaggatggtatctatctcttgacctcgtgatcctcctgcctcagcctcccagactgctgagattacaggcgtgagccaccgcacggatatgttttaagtaactgaatgtattaaaatttgactttggcaccagcaggctattgtgaataatgttgctttgagcatcgtgtgcaaaaatatcctggacccttgttctcagcacttttggatatatatgcaaaagtggaatggctgggtcacatgataattctgtctgatgttttgagaaaccactgtcctgttttccagagctgctgcaccattttgtattcccatgagcaggtgcacaaggttccaactttaccacatccagccattaaataggaggtaactgttggctggatgtggttatgttgatcatcttttcatgttcttattggccatctgttatcttctttattataagtccttttctgaattaaattggttttgttgttattcttgagttataggagttcttaataaactgaatattaatccttaagcaa

SEQ ID NO: 37304 - DNA, 501 bp, Homo sapiens
tacaggtacccgccatcatgcccagctaagtttttgtatttttagtagagacgagtttcaccatgttggccaggttggtctctagctcctaacctcatgattcacctgccttggcctcccaaagtgctgggattacaggcatgagccactgctcccggccccaccaacctttctttctaactaccgctcacctatacaaagccctgttctagttaaactctacttgggcttttcattttcctttctaaacacctttgcacacgtcatttcccatgatgtcccttttctccatcaaccaaaaacttacccatcttttagggctaaagagtttacctcttcctttttcactcctggacttctcttaccaggggagcttgcttttcctctgtagctgctgtaggacgtgtccaaatcactcacttaggcactcatcattactatgttttgatcgtgatattttccctgcatctctgtcttatctctcttaatatcttataagca

SEQ ID NO: 37305 - DNA, 472 bp, Homo sapiens
attttaatcatggtaatatgaatggattgattaaagaattagatataaaataacatgctaaattcatattccaaaaacctacattatttcacattttagcctgtcttcagttggaatgtatcttacaatattgatgtggtagtgatattttttcactttattagagatatataaaataattcatcttgaaatgggtgatgtcttagatttgaagatacattgtaacttacccgctctgccatcgttatagtcgtctagtcactggagaactcttctttttgtcactcaatttgaaacctcaagggttgtaccttacaataaatttccttagcttcatcagtgggagtgaagtgagtttagtgcagaatgatataaatgatagtacttcttacatcaaaatccttatactttgaacagacactttatcaagtgcctgagcaaacacagcagcttttgaagtatttgaagagcc

SEQ ID NO: 37306 - DNA, 88 bp, Homo sapiens
gactttgctaaaaccagctgcctgggccctgcgccggaggcgtctggggaagccccagaacctgtgtttcatttgttttccccgattt

SEQ ID NO: 37307 - DNA, 215 bp, Homo sapiens
tattattatttttactttcactcctaaatttttttctaagtcctctaaatacttttgtgtaaaatccaaagctttaaaatggagcccagggcatttctggctagccatagacataactggaaaatggcctcatggttcttgatttctgcacttctattcctgcctcccagtgtgatgcttcccatctcttacagggctaccttctggattcattg

SEQ ID NO: 37308 - DNA, 1200 bp, Homo sapiens
tacgtgcgcccgttctattttctggtgggggagtattatttatagccatggaggccttgtcttttgtttggggcatgatggcgcaactgcactccagcctgggcaatgaagcaagaccccatttcaaaaactaaacaaataaataaataaaagcccagctaaaagcaacttattgaccatgtccccaggtcgtggaattaagggaagaagcagaaaagttctagaagaggactggagaagtagaaggactacagaccccatgatgcacatggaaatgggcgtaaatctgcacgacttgttccggggcatgcgcatgtgtaagcgcacaataatctcttaagaattaaagaaaccttgtaacaaagaaaagtagtgaagaaaagccttaaggaaaagagaaggaatgtgtgtagtccctctgcttaaggaaaagatagagggtgggaagatcttccttcaacaatttagatcaacatttgttaggtatatgtggtttgccaggaaactgcatgtgtgttgtggaccatatgtgttgaagatgcagtgatcaaaaagacttagtcccagctattaaggagatcacagtttggcagcaaattattatagaatgtgatggctgttctaacagacatataaaggaagtgctatggatggaagcacagaggaagaagaggttaatagtgtctaagaacctagaagggatgaagatgaaaattgagatttgaaaggtgagaaagtcattaagacaaggatgacttaaaggtattccaaactcctaagaaatacagggagttttggtggatgcagaatgattgaggaaggctgtgaaagtcttctcttaacaaaaatctctttctgtaatggttgcttgtttatgggatgagaaactagggggtcatttgcttgcttaaagcctctggcttctcctgatgcaacttccaggccagtctaccttctcttctcaaatcccccagcttttgcttcaagtttacttccagcctggcaaggagtgagtcttctgagcacaaccacccagtgtccaagcagggcgggaacacctccttcctcatctctcccacacatactccttccatacccaccaagaagaaaggcagccaggaagagtggacaggtccagaaccacagagggtgatgaacagatgcagaagtatcaatcctgaggctaaagagtaattgggc

SEQ ID NO: 37309 - DNA, 902 bp, Homo sapiens
gcttcagtttgcagaggaggaaactgagcccagagagggagcatgactgaggtgtcacaggggcagagtgagagtgtggcccaggctctccaggagctcaggctctcagcacagtatttgcacctgtctaggctgctgccttggagagtgtggtggggagcaggccctactctgtatccagggtactaccgctgccttctgttttccttcagatgttgccatgcaggccctgtgaaactgtctctttctgctcagtaatttatggatagaattttaccagaatacacatagtacaagatgtggttgtcactgatttttggaatatcttgaggggaaaggcaatgaacattaagaggctcctgtttctgtgtgaacatagaaagactgagaaactgaagcttgttttgttcctcagtaacctcaaacaccacctcttggtcacacattttctcccgctaggatgtgctcctatatcactactaatattaattattagtgttattaatacttggctgctgagtacttactgtacgtcagtgcatgtgaagtgttcagcacaatgcatgtatcatttaatccacccagaaactctacaaagatggtactgtaattttctccattttgtaaatgaggaaacaggttaaggtcacagagtaggggggagaactgagattcaaatccctccaatttatgaagcctaaattggcttgttccagctctgttgtactgatttctgtggaggtgattaccgtaaaccccacctgcctgctcctcttctccagccaaatttgaagcatttgatgtccctgtgttagtctgctagggctggcgttacaaaataacacaggctgggtagcattaatgatagaagtttattttcttggctgggcgcggtggctcat

SEQ ID NO: 37310 - DNA, 395 bp, Homo sapiens
gatttttccaacacatctcacacccaagtaggtgataccaggagtgaggaagtagtgacagctacctggtgtctcctctttttatccctgaacctgaaacttgaaagaatttcattataattcagtagtttagccttaatatttctacttctcaaaataataaaatttcaaagctatcttttgatctaaatgtgaggaatgttaacagtgcacgtatgtattagaagatatggactcttacttttttttttttttttgcaaactttataaattgttttctttcattgctgaaggtcagaatctcagtgattaatggtgactaaagaagtttgtgacagaaatttaacccagatactcacacatccagtcctatcttcctcttacctgtaggggca

SEQ ID NO: 37311 - DNA, 434 bp, Homo sapiens
atgatcttcagcttaaggtaacaatagttaaaatggagccaaataaactcccatcaaatttgtgcctgtatgctaaagaaatgtgttcatactgaactctgctgtacagcagaagagggtgaccaaatagcaagatgtaattccttcccttgtaatccatttctgaagttcccctcttgccttcctagaaatttgattttcaaattttgtctgtagagtttttgcttggaattttaaaagggtaagagaacatcacctaattttatagatgattagattgaggtataaagataataagctttgttcaaggtatatagttgcaaggctaggcctagatctgaaactgattttttagttcccatttcagtgctttcttcctgataaccatttgccagtgactttttttttattattaataaagtatttgttattgc

SEQ ID NO: 37312 - DNA, 375 bp, Homo sapiens
ggttgctgggatttacgaagaggataacctaaggttatgatgataaaaacactcacagatggctccacgactggtactgaattaatgagtggaaatgtgcaaggactgataggagacatgtaggagacctaaaggaaaactgtggcaacttccctttcccctgggactctgcttcttttgattgtgcttcatgtagatcgtcttgatcattctgtgtgtaaaaaatgtcttgcggctgggtgcggtggctcacaccagcacttttggaggcccaggcaggtggatcacttgagatcaggagttgaagaccaagcctggccaacatggtgaaacctcatctctactgaatatacaaaaattagccaggtgtggtgg

SEQ ID NO: 37313 - DNA, 359 bp, Homo sapiens
cctattaaaaataattatgtagataagtataaaagattgtatcattccttgtttgtaaactgagttaagaacatatcgcggccaggcgtggtggttcatgcctgtaatctcagcactttgggaggccgaggcaggcagatcacgaggtcaggagatcaagaccatcctggccaacatggtgaaaccctgtctctacttaaaatacaaaaattagctgggcgtggtgacgcttgcctgtagtcccagctattcgggaggctgaggcaggagaattgcttgaacctgggaagtggaggttgcagtaagccgagattgcaccactgcactccagcctggtgacagagtgagactccgtcaaa

SEQ ID NO: 37314 - DNA, 507 bp, Homo sapiens
actggaactacgcagagccagaccagcgggaccacagaatgggctgaggcggcggcggctgtttggataaagtcaacagcgggacgtggggcgtgacgccggtccggcatcctaagacgtgtggtttgagttgcgggcgagaccaggctttttttaggaccttgggcctgataagtgggcgactgcagtagtgcgggaacctattatttgacaggaacatgacaggaagtgtagggaccccatgcttgatggatggtgacttatagtgtggtagtctcagtgttgatgggcatgaccgagacagcaggagtacccctaagttctggtgagaggtggagcctcagaaggacaccttactcaagctgtctttagttcccaaagacaaaaaggctcagtggaaaagattccttttttttttttaatgtctctatatttgagactgtgggtttattgtggatatgcattatctagttttaataaataaaagtataaacgtttaacattttc

SEQ ID NO: 37315 - DNA, 422 bp, Homo sapiens
  misc_feature (14)..(14): n is a, c, g, or t
  misc_feature (25)..(25): n is a, c, g, or t
  misc_feature (405)..(405): n is a, c, g, or t
ggcacgaggcgtgngcctgccgctnggaatgtgagtttcagccagacacctgtggatatctgggctttgggctgtatgatcattgagatggccactggaaatccctatcttcctagtagttctgatttggatttactccataaaattgttttgaaagtgggattcatgccagaactgaaagctaaattactgcaggaagcaaaagtcaattcattaataaagccaaaagagagttctaaagaaaatgaactcaggaaagatgaaagaaaaacagtttataccaatacactgctaagtagttcagttttgggaaagaaataggaaaaaggaggaaaaagccccaagggagatccaaagtccagagttatttaaagtccaaaggggggaggagggagatttcttccnggaccccaaaaaggaag

SEQ ID NO: 37316 - DNA, 1622 bp, Homo sapiens
actggaactacgcagagccagaccagcgggaccacagaatgggctgaggcggcggcggctgtttggataaagtcaacagcgggacgtggggcgtgacgccgtagtaaaagcccagcttgaaaatggagatgtatgaaacccttggaaaagtgggagagggaagttacggaacagtcatgaaatgtaaacataagaatactgggcagatagtggccattaagatattttatgagagaccagaacaatctgtcaacaaaattgcgatgagagaaataaagtttctaaagcaatttcatcacgaaaacctggtcaatctgattgaagtttttagacagaaaaagaaaattcatttggtatttgaatttattgaccacacagtattagatgagttacaacattattgtcatggactagagagtaagcgacttagaaaatacctcttccagatccttcgagcaattgactatcttcacagtaataatatcattcatcgagatataaaacctgagaatattttagtatcccagtcaggaattactaagctctgtgattttggttttgcacgaacactagcagctcctggggacatttatacggactatgtggccacacgctggtatagagctcccgaattagtattaaaagatacttcttatggaaaacctgtggatatctgggctttgggctgtatgatcattgagatggccactggaaatccctatcttcctagtagttctgatttggatttactccataaaattgttttgaaagtgggcaatttgtcacctcacttgcagaatatcttttccaagagccccatttttgctggggtagttcttcctcaagttcaacaccccaaaaatgcaagaaaaaaatatccaaagcttaatggattgttggcagatatagttcatgcttgtttacaaattgatcctgctgacaggatatcatctagtgatcttttgcatcatgagtattttactagagatggatttattgaaaaattcatgccagaactgaaagctaaattactgcaggaagcaaaagtcaattcattaataaagccaaaagagagttctaaagaaaatgaactcaggaaagatgaaagaaaaacagtttataccaatacactgctaagtagttcagttttgggaaaggaaatagaaaaagagaaaaagcccaaggagatcaaagtcagagttattaaagtcaaaggaggaagaggagatatctcagaaccaaaaaagaaagagtatgaaggtggacttggtcaacaggatgcaaatgaaaatgttcatcctatgtctccagatacaaaacttgtaaccattgaaccaccaaaccctatcaatcccagcactaactgtaatggcttgaaagaaaatccacattgcggaggttctgtgacaatgccacccatcaatctaactaacagtaatttgatggctgcaaatctcagttcaaatctctttcaccccagtgtgaggtgagctgtaacagagaagaaacctaaataatacaacattcctgtataatggtatttcaaagaatcgtgttcatagtgtctgtatgtaaactgaacttgaagaaaatatattgaaattaaagctgtataatgggcc

SEQ ID NO: 37317 - DNA, 2442 bp, Homo sapiens
actggaactacgcagagccagaccagcgggaccacagaatgggctgaggcggcggcggctgtttggataaagtcaacagcgggacgtggggcgtgacgccgtagtaaaagcccagcttgaaaatggagatgtatgaaacccttggaaaagtgggagagggaagttacggaacagtcatgaaatgtaaacataagaatactgggcagatagtggccattaagatattttatgagagaccagaacaatctgtcaacaaaattgcgatgagagaaataaagtttctaaagcaatttcatcacgaaaacctggtcaatctgattgaagtttttagacagaaaaagaaaattcatttggtatttgaatttattgaccacacagtattagatgagttacaacattattgtcatggactagagagtaagcgacttagaaaatacctcttccagatccttcgagcaattgactatcttcacagtaataatatcattcatcgagatataaaacctgagaatattttagtatcccagtcaggaattactaagctctgtgattttggttttgcacgaacactagcagctcctggggacatttatacggactatgtggccacacgctggtatagagctcccgaattagtattaaaagatacttcttatggaaaacctgtggatatctgggctttgggctgtatgatcattgagatggccactggaaatccctatcttcctagtagttctgatttggatttactccataaaattgttttgaaagtgggcaatttgtcacctcacttgcagaatatcttttccaagagccccatttttgctggggtagttcttcctcaagttcaacaccccaaaaatgcaagaaaaaaatatccaaagcttaatggattgttggcagatatagttcatgcttgtttacaaattgatcctgctgacaggatatcatctagtgatcttttgcatcatgagtattttactagagatggatttattgaaaaattcatgccagaactgaaagctaaattactgcaggaagcaaaagtcaattcattaataaagccaaaagagagttctaaagaaaatgaactcaggaaagatgaaagaaaaacagtttataccaatacactgctaagtagttcagttttgggaaaggaaatagaaaaagagaaaaagcccaaggagatcaaagtcagagttattaaagtcaaaggaggaagaggagatatctcagaaccaaaaaagaaagagtatgaaggtggacttggtcaacaggatgcaaatgaaaatgttcatcctatgtctccagatacaaaacttgtaaccattgaaccaccaaaccctatcaatcccagcactaactgtaatggcttgaaagaaaatccacattgcggaggttctgtgacaatgccacccatcaatctaactaacagtaatttgatggctgcaaatctcagttcaaatctctttcaccccagtgtgaggttaactgaaagagcaaaaaagagacgcacttcttcacaatctattggacaagttatgcctaatagcaggcaagaggatccaggtcctattcaagagccaaatggagaagggtatatttaatgagcgaacaggtcacagtgaccaaatggcaaatgagaacaaaaggaagctgaatttttccagatctgacaggaaagaattccattttccagaattgcctgtcacaatacagtcaaaagatacaaaaggaatggaagttaaacagataaaaatgctgaagagggagtcaaagaaaacagagtcatctaagataccaactttacttaacgtggatcaaaatcaagaaaaacaagagggtggagatggccattgcgaggggaagaatttgaagagaaacaggttttttttctggtagtgtcttttcttttacatagtccaaaaaatacaagatgacaactcttcccgttttatttatctacaatagaagtgtgatgtgagttgttgttaagacagccatccatgtgcatgagcatcatccagctttttttgttagcaaaacatttactgttttcttttcccttttaagactctgttgatgtgataatttgatttggaattataaagtcatctcttctctgcctacttcttttttttgccatgattactgagtggataacacaagccgtgacatgatacaaactgtacttatacttaatgatctctgccttcttgtagccacataacttcgagtcagttatctcctataacacacaggcctctttaaatgagttcttaataaaatatttgagccgttgttttaaaagctattcatggctgggtgcaatggctcatgcctgtaatcccaacactttgggaggctgaggcaggcggatcacttgaggtcaggagttcgaaaccagcctgaccaacacggtgaaacaccatctctactaaa

SEQ ID NO: 37318 - DNA, 2060 bp, Homo sapiens
actggaactacgcagagccagaccagcgggaccacagaatgggctgaggcggcggcggctgtttggataaagtcaacagcgggacgtggggcgtgacgccgtagtaaaagcccagcttgaaaatggagatgtatgaaacccttggaaaagtgggagagggaagttacggaacagtcatgaaatgtaaacataagaatactgggcagatagtggccattaagatattttatgagagaccagaacaatctgtcaacaaaattgcgatgagagaaataaagtttctaaagcaatttcatcacgaaaacctggtcaatctgattgaagtttttagacagaaaaagaaaattcatttggtatttgaatttattgaccacacagtattagatgagttacaacattattgtcatggactagagagtaagcgacttagaaaatacctcttccagatccttcgagcaattgactatcttcacagtaataatatcattcatcgagatataaaacctgagaatattttagtatcccagtcaggaattactaagctctgtgattttggttttgcacgaacactagcagctcctggggacatttatacggactatgtggccacacgctggtatagagctcccgaattagtattaaaagatacttcttatggaaaacctgtggatatctgggctttgggctgtatgatcattgagatggccactggaaatccctatcttcctagtagttctgatttggatttactccataaaattgttttgaaagtggggaaatagaaaaagagaaaaagcccaaggagatcaaagtcagagttattaaagtcaaaggaggaagaggagatatctcagaaccaaaaaagaaagagtatgaaggtggacttggtcaacaggatgcaaatgaaaatgttcatcctatgtctccagatacaaaacttgtaaccattgaaccaccaaaccctatcaatcccagcactaactgtaatggcttgaaagaaaatccacattgcggaggttctgtgacaatgccacccatcaatctaactaacagtaatttgatggctgcaaatctcagttcaaatctctttcaccccagtgtgaggttaactgaaagagcaaaaaagagacgcacttcttcacaatctattggacaagttatgcctaatagcaggcaagaggatccaggtcctattcaagagccaaatggagaagggtatatttaatgagcgaacaggtcacagtgaccaaatggcaaatgagaacaaaaggaagctgaatttttccagatctgacaggaaagaattccattttccagaattgcctgtcacaatacagtcaaaagatacaaaaggaatggaagttaaacagataaaaatgctgaagagggagtcaaagaaaacagagtcatctaagataccaactttacttaacgtggatcaaaatcaagaaaaacaagagggtggagatggccattgcgaggggaagaatttgaagagaaacaggttttttttctggtagtgtcttttcttttacatagtccaaaaaatacaagatgacaactcttcccgttttatttatctacaatagaagtgtgatgtgagttgttgttaagacagccatccatgtgcatgagcatcatccagctttttttgttagcaaaacatttactgttttcttttcccttttaagactctgttgatgtgataatttgatttggaattataaagtcatctcttctctgcctacttcttttttttgccatgattactgagtggataacacaagccgtgacatgatacaaactgtacttatacttaatgatctctgccttcttgtagccacataacttcgagtcagttatctcctataacacacaggcctctttaaatgagttcttaataaaatatttgagccgttgttttaaaagctattcatggctgggtgcaatggctcatgcctgtaatcccaacactttgggaggctgaggcaggcggatcacttgaggtcaggagttcgaaaccagcctgaccaacacggtgaaacaccatctctactaaa

SEQ ID NO: 37319 - DNA, 1745 bp, Homo sapiens
actggaactacgcagagccagaccagcgggaccacagaatgggctgaggcggcggcggctgtttggataaagtcaacagcgggacgtggggcgtgacgccgtagtaaaagcccagcttgaaaatggagatgtatgaaacccttggaaaagtgggagagggaagttacggaacagtcatgaaatgtaaacataagaatactgggcagatagtggccattaagatattttatgagagaccagaacaatctgtcaacaaaattgcgatgagagaaataaagtttctaaagcaatttcatcacgaaaacctggtcaatctgattgaagtttttagacagaaaaagaaaattcatttggtatttgaatttattgaccacacagtattagatgagttacaacattattgtcatggactagagagtaagcgacttagaaaatacctcttccagatccttcgagcaattgactatcttcacagtaataatatcattcatcgagatataaaacctgagaatattttagtatcccagtcaggaattactaagctctgtgattttggttttgcacgaacactagcagctcctggggacatttatacggactatgtggccacacgctggtatagagctcccgaattagtattaaaagatacttcttatggaaaacctgtggatatctgggctttgggctgtatgatcattgagatggccactggaaatccctatcttcctagtagttctgatttggatttactccataaaattgttttgaaagtgggcaatttgtcacctcacttgcagaatatcttttccaagagccccatttttgctggggtagttcttcctcaagttcaacaccccaaaaatgcaagaaaaaaatatccaaagcttaatggattgttggcagatatagttcatgcttgtttacaaattgatcctgctgacaggatatcatctagtgatcttttgcatcatgagtattttactagagatggatttattgaaaaattcatgccagaactgaaagctaaattactgcaggaagcaaaagtcaattcattaataaagccaaaagagagttctaaagaaaatgaactcaggaaagatgaaagaaaaacagtttataccaatacactgctaagtagttcagttttgggaaaggaaatagaaaaagagaaaaagcccaaggagatcaaagtcagagttattaaagtcaaaggaggaagaggagatatctcagaaccaaaaaagaaagagtatgaaggtggacttggtcaacaggatgcaaatgaaaatgttcatcctatgtctccagatacaaaacttgtaaccattgaaccaccaaaccctatcaatcccagcactaactgtaatggcttgaaagaaaatccacattgcggaggttctgtgacaatgccacccatcaatctaactaacagtaatttgatggctgcaaatctcagttcaaatctctttcaccccagtgtgaggtgagctgtaacagagaagaaacctaaataatacaacattcctgtataatggtatttcaaagaatcgtgttcatagtgtctgtatgtaaactgaacttgaagaaaatatattgaaattaaagctgtataatgggccatttactgagtgtttcttatggatgctgtagaagaaattaacttttcttggccatatagatgtttaaattttcactaatgtcttcttgaaaaaccttattaaaaaaaaagaccctttgaaaaa

SEQ ID NO: 37320 - DNA, 2263 bp, Homo sapiens
actggaactacgcagagccagaccagcgggaccacagaatgggctgaggcggcggcggctgtttggataaagtcaacagcgggacgtggggcgtgacgccgtagtaaaagcccagcttgaaaatggagatgtatgaaacccttggaaaagtgggagagggaagttacggaacagtcatgaaatgtaaacataagaatactgggcagatagtggccattaagatattttatgagagaccagaacaatctgtcaacaaaattgcgatgagagaaataaagtttctaaagcaatttcatcacgaaaacctggtcaatctgattgaagtttttagacagaaaaagaaaattcatttggtatttgaatttattgaccacacagtattagatgagttacaacattattgtcatggactagagagtaagcgacttagaaaatacctcttccagatccttcgagcaattgactatcttcacagtaataatacctgtggatatctgggctttgggctgtatgatcattgagatggccactggaaatccctatcttcctagtagttctgatttggatttactccataaaattgttttgaaagtgggcaatttgtcacctcacttgcagaatatcttttccaagagccccatttttgctggggtagttcttcctcaagttcaacaccccaaaaatgcaagaaaaaaatatccaaagcttaatggattgttggcagatatagttcatgcttgtttacaaattgatcctgctgacaggatatcatctagtgatcttttgcatcatgagtattttactagagatggatttattgaaaaattcatgccagaactgaaagctaaattactgcaggaagcaaaagtcaattcattaataaagccaaaagagagttctaaagaaaatgaactcaggaaagatgaaagaaaaacagtttataccaatacactgctaagtagttcagttttgggaaaggaaatagaaaaagagaaaaagcccaaggagatcaaagtcagagttattaaagtcaaaggaggaagaggagatatctcagaaccaaaaaagaaagagtatgaaggtggacttggtcaacaggatgcaaatgaaaatgttcatcctatgtctccagatacaaaacttgtaaccattgaaccaccaaaccctatcaatcccagcactaactgtaatggcttgaaagaaaatccacattgcggaggttctgtgacaatgccacccatcaatctaactaacagtaatttgatggctgcaaatctcagttcaaatctctttcaccccagtgtgaggttaactgaaagagcaaaaaagagacgcacttcttcacaatctattggacaagttatgcctaatagcaggcaagaggatccaggtcctattcaagagccaaatggagaagggtatatttaatgagcgaacaggtcacagtgaccaaatggcaaatgagaacaaaaggaagctgaatttttccagatctgacaggaaagaattccattttccagaattgcctgtcacaatacagtcaaaagatacaaaaggaatggaagttaaacagataaaaatgctgaagagggagtcaaagaaaacagagtcatctaagataccaactttacttaacgtggatcaaaatcaagaaaaacaagagggtggagatggccattgcgaggggaagaatttgaagagaaacaggttttttttctggtagtgtcttttcttttacatagtccaaaaaatacaagatgacaactcttcccgttttatttatctacaatagaagtgtgatgtgagttgttgttaagacagccatccatgtgcatgagcatcatccagctttttttgttagcaaaacatttactgttttcttttcccttttaagactctgttgatgtgataatttgatttggaattataaagtcatctcttctctgcctacttcttttttttgccatgattactgagtggataacacaagccgtgacatgatacaaactgtacttatacttaatgatctctgccttcttgtagccacataacttcgagtcagttatctcctataacacacaggcctctttaaatgagttcttaataaaatatttgagccgttgttttaaaagctattcatggctgggtgcaatggctcatgcctgtaatcccaacactttgggaggctgaggcaggcggatcacttgaggtcaggagttcgaaaccagcctgaccaacacggtgaaacaccatctctactaaa

SEQ ID NO: 37321 - DNA, 1502 bp, Homo sapiens
actggaactacgcagagccagaccagcgggaccacagaatgggctgaggcggcggcggctgtttggataaagtcaacagcgggacgtggggcgtgacgccgtagtaaaagcccagcttgaaaatggagatgtatgaaacccttggaaaagtgggagagggaagttacggaacagtcatgaaatgtaaacataagaatactgggcagatagtggccattaagatattttatgagagaccagaacaatctgtcaacaaaattgcgatgagagaaataaagtttctaaagcaatttcatcacgaaaacctggtcaatctgattgaagtttttagacagaaaaagaaaattcatttggtatttgaatttattgaccacacagtattagatgagttacaacattattgtcatggactagagagtaagcgacttagaaaatacctcttccagatccttcgagcaattgactatcttcacagtaataatatcattcatcgagatataaaacctgagaatattttagtatcccagtcaggaattactaagctctgtgattttggttttgcacgaacactagcagctcctggggacatttatacggactatgtggccacacgctggtatagagctcccgaattagtattaaaagatacttcttatggaaaacctgtggatatctgggctttgggctgtatgatcattgagatggccactggaaatccctatcttcctagtagttctgatttggatttactccataaaattgttttgaaagtgggcaatttgtcacctcacttgcagaatatcttttccaagagccccatttttgctggggtagttcttcctcaagttcaacaccccaaaaatgcaagaaaaaaatatccaaagcttaatggattgttggcagatatagttcatgaaatagaaaaagagaaaaagcccaaggagatcaaagtcagagttattaaagtcaaaggaggaagaggagatatctcagaaccaaaaaagaaagagtatgaaggtggacttggtcaacaggatgcaaatgaaaatgttcatcctatgtctccagatacaaaacttgtaaccattgaaccaccaaaccctatcaatcccagcactaactgtaatggcttgaaagaaaatccacattgcggaggttctgtgacaatgccacccatcaatctaactaacagtaatttgatggctgcaaatctcagttcaaatctctttcaccccagtgtgaggtgagctgtaacagagaagaaacctaaataatacaacattcctgtataatggtatttcaaagaatcgtgttcatagtgtctgtatgtaaactgaacttgaagaaaatatattgaaattaaagctgtataatgggccatttactgagtgtttcttatggatgctgtagaagaaattaacttttcttggccatatagatgtttaaattttcactaatgtcttcttgaaaaaccttattaaaaaaaaagaccctttgaaaaa

SEQ ID NO: 37322 - DNA, 1239 bp, Homo sapiens
gcccgcggccttgtcaacaatccacccctgagtgggagggggagaagtatctagaaccacgtgtccctatgacgcgtttagaacgggtcacgtgagcgcctcgcctggatgtgagtttcagccagacctgtggatatctgggctttgggctgtatgatcattgagatggccactggaaatccctatcttcctagtagttctgatttggatttactccataaaattgttttgaaagtgggcaatttgtcacctcacttgcagaatatcttttccaagagccccatttttgctggggtagttcttcctcaagttcaacaccccaaaaatgcaagaaaaaaatatccaaagcttaatggattgttggcagatatagttcatagccaaatggagaagggtatatttaatgagcgaacaggtcacagtgaccaaatggcaaatgagaacaaaaggaagctgaatttttccagatctgacaggaaagaattccattttccagaattgcctgtcacaatacagtcaaaagatacaaaaggaatggaagttaaacagataaaaatgctgaagagggagtcaaagaaaacagagtcatctaagataccaactttacttaacgtggatcaaaatcaagaaaaacaagagggtggagatggccattgcgaggggaagaatttgaagagaaacaggttttttttctggtagtgtcttttcttttacatagtccaaaaaatacaagatgacaactcttcccgttttatttatctacaatagaagtgtgatgtgagttgttgttaagacagccatccatgtgcatgagcatcatccagctttttttgttagcaaaacatttactgttttcttttcccttttaagactctgttgatgtgataatttgatttggaattataaagtcatctcttctctgcctacttcttttttttgccatgattactgagtggataacacaagccgtgacatgatacaaactgtacttatacttaatgatctctgccttcttgtagccacataacttcgagtcagttatctcctataacacacaggcctctttaaatgagttcttaataaaatatttgagccgttgttttaaaagctattcatggctgggtgcaatggctcatgcctgtaatcccaacactttgggaggctgaggcaggcggatcacttgaggtcaggagttcgaaaccagcctgaccaacacggtgaaacaccatctctactaaa

SEQ ID NO: 37323 - DNA, 1476 bp, Homo sapiens
actggaactacgcagagccagaccagcgggaccacagaatgggctgaggcggcggcggctgtttggataaagtcaacagcgggacgtggggcgtgacgccgtagtaaaagcccagcttgaaaatggagatgtatgaaacccttggaaaagtgggagagggaagttacggaacagtcatgaaatgtaaacataagaatactgggcagatagtggccattaagatattttatgagagaccagaacaatctgtcaacaaaattgcgatgagagaaataaagtttctaaagcaatttcatcacgaaaacctggtcaatctgattgaagtttttagacagaaaaagaaaattcatttggtatttgaatttattgaccacacagtattagatgagttacaacattattgtcatggactagagagtaagcgacttagaaaatacctcttccagatccttcgagcaattgactatcttcacagtaataatatcattcatcgagatataaaacctgagaatattttagtatcccagtcaggaattactaagctctgtgattttggttttgcacgaacactagcagctcctggggacatttatacggactatgtggccacacgctggtatagagctcccgaattagtattaaaagatacttcttatggaaaacctgtggatatctgggctttgggctgtatgatcattgagatggccactggaaatccctatcttcctagtagttctgatttggatttactccataaaattgttttgaaagtgggcaatttgtcacctcacttgcagaatatcttttccaagagccccatttttgctggggtagttcttcctcaagttcaacaccccaaaaatgcaagaaaaaaatatccaaagcttaatggattgttggcagatatagttcatgcttgtttacaaattgatcctgctgacaggatatcatctagtgatcttttgcatcatgagtattttactagagatggatttattgaaaagttaactgaaagagcaaaaaagagacgcacttcttcacaatctattggacaagttatgcctaatagcaggcaagaggatccaggtcctattcaagagccaaatggagaagggtatatttaatgagcgaacaggtcacagtgaccaaatggcaaatgagaacaaaaggaagctgaatttttccagatctgacaggaaagaattccattttccagaattgcctgtcacaatacagtcaaaagatacaaaaggaatggaagttaaacagataaaaatgctgaagagggagtcaaagaaaacagagtcatctaagataccaactttacttaacgtggatcaaaatcaagaaaaacaagaggtaactctttttgtatatagcttttactaaggcatgttgtttagaggacttgactcagtgtataaatttagttattactattggaaagctatataaaaattcaaaattttataatct

SEQ ID NO: 37324 - DNA, 531 bp, Homo sapiens
actggaactacgcagagccagaccagcgggaccacagaatgggctgaggcggcggcggctgtttggataaagtcaacagcgggacgtggggcgtgacgccggtccggcatcctaagacgtgtggtttgagttgcgggcgagaccaggctttttttaggaccttgggcctgataagtgggcgactgcagtagtgcgggaacctattatttgacaggaacatgacaggaagtgtagggaccccatgcttgatggatggtgacttatagtgtggtagtctcagtgttgatgggcatgaccgagacagcaggagtacccctaagttctggtgagaggtggagcctcagaaggacaccttactcaagctgtctttagttcccaaagacaaaaaggctcagtggaaaagattccttttttttttttaatgtctctatatttgagactgtgggtttattgtggatatgcattatctagttttaataaataaaagtataaacgtttaacattttcagaaaaaaaaacctcgtgcccaat

SEQ ID NO: 37325 - DNA, 819 bp, Homo sapiens
tcttgagtgacagtgaatagttagatcgaataataggctaaccaagaagcttaaaaggaaaagctgggaaatgagatgttcataaggaaatttaagaagctctggtatatttctgggaatctagaaggctatgtgcatgtgtagggttgtgtgctgcatgcttaggaaagaactaagaaggtcctaagctgtcagttctgattaatctctagactttgtgcaagcaagaagtaaaggctaaggaagggttgtaaactgcttggctgaatgtgaaaggtatgccctaacacatgtagttaggctgtcaatacacactgagtcttatactggttttaagcatttaaggaagtctctgcccagtcattagctgatcacaaatgaacagcagagactttagtgaccacatatgatagaaaattaatattttagataattagttccaggaaagtcactaaaagaaacaacaataaacagtaacaacagtaaacagtaataacaacaaataccctggtaggggaagaatcctgatttttcgagttgtcacattaccttatttaaaatgtttagttttcaagagactgttattacaaagcatgcaaaaaaccacttaagtatggtccacacataggagagaaagcagtaaattagaaaatgttccctgaggaagcccaaatgttagactttagtattaggcaaagactttaaatcagccatttaaaatatgttcaaagggcctggtatggtggcttgcacttactgaggagggacaattgccactgcactccagcctgggtgacagagcaagacctcatttcttta

SEQ ID NO: 37326 - DNA, 761 bp, Homo sapiens
ggaactttctacaacaatggaactggtctatgtttgtactgtctaatccatagccactagccacacatgactactgagcacttgaaatgtgattagtatgactgagaaactggatttttagttgtactaagtaattgttaatttaaattgaaattcaagtagccacacgagcctagtgactactatatttgacagagaagttttttgttcttttgttttattttgttttgttttcgagatggagtctcgttctgtggcccaggctggagtgcagcagcatgatctcggctcactgcaacctccgcctcccaggttcaagcaatccccctgcttcagcctccagagtagctgggactacaggggtgcaccaccacacctggctaatttttatatttttagtagagacagggattcaccatgttgaccaggctggtctcaaactcctggcctcagatgatctgcctgccttggtttcccaaagtgctcggattagaggtgtgagccactgtggccggccctaacagtgaagttttaaagtataaaaaataatataagagaagatgaattatatctcattaaagctgttaaagcaatataagcatttaaaatgtgctcagtatattatgtttaaaatttaattgtaatgtagaaatgagtttggatttcaaaatagagaatgtagacacagcagaagtattggagtttttatttaaattgcttattttctagcacaataaaaagcgatccagcattgagttttc

SEQ ID NO: 37327 - DNA, 817 bp, Homo sapiens
cacaatcaaggggtcacccacttagttccagttgagcttaaataagtgagcatctcatgtagatgccatagttgggcaggaagcagccccaccatgcatggcttcctgagcactgcacaggctgccgctgggatttgtgtctatggcttcgcccaaggttcccagcactccctccctccagcaacctggcagttttagtgcctctggttttcttccctgacacttaggaagacgaaagtataaagatctagaagactgggacaccatgcatgttcattttgaagttggaattggtcttctgcctacctctgatctggcagaggtatctgcattttggtttgttaacaaggtaaaactcctggtgtcactgacctcctcctgtcagataacttacatgattaaggttaagagtaaagcagagtgttcacgtccagcttccttctcagccttaacaggaaaaggcttgtgctttttttctaactatgctttgacccttaactcctatggcatgatggggccctgggagaagccaggcagcacaagccagtcatgctgagctgcctccagataatcctggctccaggccagagcccgtgtctgccctcatccctctctcctactgtgagctctccagtcctttcccaacagcgatgtggttgtctgcttagccacatgcctgtatagttccttccagaagaaatgtataatggtggaagatgtatttctgtgtgaaaattttcaccaagtcatacaacacagctgatgctggagccaggattaaaattggggtgtacaagtctcccagtgtgagtatccc

SEQ ID NO: 37328 - DNA, 501 bp, Homo sapiens
  misc_feature (6)..(6): n is a, c, g, or t
  misc_feature (27)..(27): n is a, c, g, or t
  misc_feature (35)..(35): n is a, c, g, or t
gtgggngtcgccttcgtcttcctaagngtcagggnaagaaaaccagaggcactgacctcctcctgtcagataacttacatgattaaggttaagagtaaagcagagtgttcacgtccagcttccttctcagccttaacaggaaaaggcttgtgctttttttctaactatgctttgacccttaactcctatggcatgatggggccctgggagaagccaggcagcacaagccagtcatgctgagctgcctccagataatcctggctccaggccagagcccgtgtctgccctcatccctctctcctactgtgagctctccagtcctttcccaacagcgatgtggttgtctgcttagccacatgcctgtatagttccttccagaagaaatgtataatggtggaagatgtatttctgtgtgaaaattttcaccaagtcatacaacacagctgatgctggagccaggattaaaattggggtgtacaagtctcccagtgtgagtatccc

SEQ ID NO: 37329 - DNA, 393 bp, Homo sapiens
gtttattttccatgtatttgtgtagttttaggagttccttctggagttgatttctagttttattccactgtggtctgaaaaaaatagttgatatgatttcaattaaaaaaaattattcggccaggtgtggtagctcatgcctgtaatcccagcactttgggaggccaaggtgggcgaatcatctgaggccaggaattcaagaccagcctggccaacatggtgaaaccacatctctattaaaaatacaaaaattagccaggtgtggtggtgcatgcctgtaatctcagctactcgggaggctgaggcaggagaattgcttgaacccgggaggcagaagttgcagtgagccaagattgtgtcactgcactccagtccatgtgacagagcaagact

SEQ ID NO: 37330 - DNA, 402 bp, Homo sapiens
tcagaagggagatcccaaaggtggtggatggcactcttaacttcctgtttaatgaaatcatgattttgtcttctggtgggaacatttctttttccaggatgaagacttctaggtcagcagagcataaagtcatggaagcaggaagaaaacattttgctaatgggacactaggggaagtcatgagtagtgtcacttcaattttgaaccttgatttctggacctaagaattttggctatcagacaaacagcaccaaatattggatgctgattcagaacatagtcttctggagaacactgcctcaaccctcaaggtattatcacctagctggtcctgtaaccaagacttcaaatggccattcaaccattctatcaagatggctacttcaggatagtgggggatgt

SEQ ID NO: 37331 - DNA, 352 bp, Homo sapiens
tgagacagagtgtccctctgtcgcccaggctggcatgcagtggcgcaatctcagctcactgcaaactccgcctccgggttcacatgattctcctcctcagcctcccaagtagttgggaatataggtgtgcgcccagctaattttttgtatttttagtagagatagggttttgccatgttggccaggctggttttgaactcctaacctcacgtgatctgcctgccttggcgtccgaaagtgctacaattacaggcatgagccacagtgcccagcctccagggatgacacctgtaaatactagctgaaaacataataagtaggctcaaaaaagatttaggaatagaatttaaag

SEQ ID NO: 37332 - DNA, 285 bp, Homo sapiens
taagacctcaataaaaatcctggaagaaaacctaggaaatacctttctcaacatcagctttggcaaagaatttatggctaagtccccaaaagcaatgaaaacaaaaccaaaaattgacaagtgagacctaattaaactaaagagtttctacatagcaaaaaaaaaaaaaaaaaaaagtcaacagaataaacaggctacataatgggagaaactattcaccaaatatgcatccgataacagtctaatatccagaatctacaaggaacttaaacaaatgagcaagaa

SEQ ID NO: 37333 - DNA, 321 bp, Homo sapiens
gtgctaggcacagtataagggctgaatgaacatcaattgttaataactatttttcctctttcgtaaacactataataacaagtcacttttgctctgctcacaatttccaataaaagatcacttggataatctaatggagttctacattttattttgaactattttggcaatattcataaaaattccatcacaataggtactataaggcaagacagtcaaatgacaattagattttaacagctagtggattataaagtttactattatccatctttttcttcaaataaacatttgaattattgctctataattaaacctgag

SEQ ID NO: 37334 - DNA, 1164 bp, Homo sapiens
ctctcccctgcctcacatttccctattgcccattgctgctttgtttttctccccagcagttgttacttcgtaacacacaccatcgtttatttatattgtttacatattttacttatatttatagtattatttgtattgtttatggtctctcttccctcatcagaatgtaggctccaagtgggcagggatgtatgctcttctgttcaccactgtattcccattgccagaaacacagtaggtgctcagtaagtatttgatgggaggagcttctgcagttcattctgcacgtcagccatggctggtcctgctcttcagcctccaagcccagcagcttcctggtgggctgcagttttctcatcggaaatagagaagagtagcagtgccgattctgcctcccttgcagggtcgttttagtgcatctagttggaaaaatacaggcaggtttgcaggggaacacagttttcaaagtgtaaaagctcagtgcaggtgctaggtcatggtgttttttgtcacactgggatcctgcgggagaggtaagtttagctgattggagtggaagatccagcccattcttcgtggtgcctgccgcagagcctgcaagcctgcagaaagacagggagtagccacgtctttctgtagttcacacctgtgtgtctccccacctgataatccctcagcacttctgtttgccttgcatgtaaagcccgacctttgcatggcaggcacacagactgaaactctttcctcctccagcctttcttggactcatccacagaatgacaaagaagtattctgtgaatattggttgaatgaagggaagggcacggctttttaaaaaagatgaaaaaaaaaaaagttatgaaaagctttaaaacttgctattggctgggcgtggtggctcacacctataatcccagcactttgggaggccgaggcgggcagatcacctgaggtcaggagtttgagaccagcctggccaacatggcaaaaccccgtctctactaaaaatacaaaaattagctgggcgtggtggtgggtgcctgtaatcccagctacttgggaggctgaggaaggagaatcacttgaacctgggaggcggaggttgcagtgagccgagatcgcgccattgcactccagcccggacaacagagcgagacttcatct

SEQ ID NO: 37335 - DNA, 794 bp, Homo sapiens
tctttagctaacttcttccagcccatcacggaggactctgttgatctcactagagcaagctcccagttttccgtatgtctgccttctcacgagccaaataatcagtttaggggtgattaaaagaatataatggctgggtgcggtgcctcacacctgtaatcccagcagtttgggaggccgaggcgggcagatcacttgaggtcaggagtttgagaccagcttggccaacatggtgaaaccccgtctctactaaaaaattaaaaaaatgagccaggtgtggtggcgggtgcctgtaatcccagctactggggaagctgaagcaagataatcacttgaacccaggaggcggaggctgcagggagctgagatcgcaccattgcattccagcctgggcaacagagtgagactctgtctcaaaaaaaaaaaaaaaactggtttataataatagccaatacttatagaatacttacaatatcaatataccaggtactctgctaataagtgttttacactggccgggcatggtggttcacacctgttatctcagcactttgggaggccgaggtgggcggatcacctgaggtcgggagttcgagaccatcctggccaacatggggaaaccccgtttctactaaaaattatctgggtgtggtggtgtgtacctgtaaccccagctacttgggaggctgaggcaggagaatcgcttgaacccgggaggtggagcttgcagtgagccgagatcgcgccactgcactccagcctgggcagcagagggagactgcgtctaaaaaaaa

SEQ ID NO: 37336 - DNA, 2229 bp, Homo sapiens
cagagtcaacagctgttgcagcatgagcgatacgcttggttctcctaactagcaccttcccctctcccctgactcagctggtagcccctcctccccgcacctgcccaaaggtcactggacaggcatttgtctggccttcccttttactgctggctgggaaggaggagcatcagaccacagatcctggaaggcacttctctccctgactgccgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcaggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatctgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaagtctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcctaaaaaaaaaaag

SEQ ID NO: 37337 - DNA, 2560 bp, Homo sapiens
tcctgtaatctcagcatgggaacaagcctttgtgtcacactgtgcaaccttcctccctttcttaaatgcttggggtgagagagaagagaggctagggtggggcatggaggacacagagagagagagtgctgtgtattccttccccgctactgtcctgtcctcagctaacttgctctgggacagcttccccagggctacagatactgcactcagctgactgtcctttcttctgggcccctggtcccagagcagagctgacaaaggagattcctgagagagcaccttcttatcacagaaagtgctgagccaagagctcctagctgccccttttgcagatgtgaagggccagtgaaccttggacccagatggttgcttaatactcctttccccctccctcactccttcctttgcgggctgcctcacctcctccacccttcttgcttaaatccataggcatttgtctggccttcccttttactgctggctgggaaggaggagcatcagaccacagatcctggaaggcacttctctccctgactgccgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcaggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatctgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaagtctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcctaaaaaaaaaaag

SEQ ID NO: 37338 - DNA, 2181 bp, Homo sapiens
tcctgtaatctcagcatgggaacaagcctttgtgtcacactgtgcaaccttcctccctttcttaaatgcttggggcatttgtctggccttcccttttactgctggctgggaaggaggagcatcagaccacagatcctggaaggcacttctctccctgactgccgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcaggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatctgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaagtctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcctaaaaaaaaaaag

SEQ ID NO: 37339 - DNA, 2356 bp, Homo sapiens
atctgggttttcaatcacggctccgccatcttgggtcatcgtacggaaggagagacaaaactgcagtacaggtttttgagagctgtcaaatctctgctatatcagtactggctaaattaggtgttaaatgattgagcttcaagatgggcaaatcatgacttcggactacattcctccttgcctggcggctgggaaattccgtccgcgctgctgctaagacttcagatgaaagacgctccggggactccggcatttgtctggccttcccttttactgctggctgggaaggaggagcatcagaccacagatcctggaaggcacttctctccctgactgccgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcaggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatctgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaagtctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcctaaaaaaaaaaag

SEQ ID NO: 37340 - DNA, 2086 bp, Homo sapiens
gtaaggatgactgtcgatatcattgaattacatgaagtaattgtactcatggtacgctagatgttagagctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcaggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatctgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaagtctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcctaaaaaaaaaaag

SEQ ID NO: 37341 - DNA, 2097 bp, Homo sapiens
cagagtcaacagctgttgcagcatgagcgatacgcttggttctcctaactagcaccttcccctctcccctgactcagctggtagcccctcctccccgcacctgcccaaaggtcactggacagggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcaggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatctgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaagtctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcctaaaaaaaaaaag

SEQ ID NO: 37342 - DNA, 2410 bp, Homo sapiens
tcctgtaatctcagcatgggaacaagcctttgtgtcacactgtgcaaccttcctccctttcttaaatgcttggggtgagagagaagagaggctagggtggggcatggaggacacagagagagagagtgctgtgtattccttccccgctactgtcctgtcctcagctaacttgctctgggacagcttccccagggctacagatactgcactcagctgactgtcctttcttctgggcccctggtcccagagcagagctgacaaaggagattcctgagagagcaccttcttatcacagaaagtgctgagccaagagctcctagctgccccttttgcagatgtgaagggccagtgaaccttggacccagatggttgcttaatactcctttccccctccctcactccttcctttgcgggctgcctcacctcctccacccttcttgcttaaatccataggcatttgtctggccttcccttttactgctggctgggaaggaggagcatcagaccacagatcctggaaggcacttctctccctgactgccgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcaggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatctgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaagtctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcctaaaaaaaaaaag

SEQ ID NO: 37343 - DNA, 2456 bp, Homo sapiens
tcctgtaatctcagcatgggaacaagcctttgtgtcacactgtgcaaccttcctccctttcttaaatgcttggggtgagagagaagagaggctagggtggggcatggaggacacagagagagagagtgctgtgtattccttccccgctactgtcctgtcctcagctaacttgctctgggacagcttccccagggctacagatactgcactcagctgactgtcctttcttctgggcccctggtcccagagcagagctgacaaaggagattcctgagagagcaccttcttatcacagaaagtgctgagccaagagctcctagctgccccttttgcagatgtgaagggccagtgaaccttggacccagatggttgcttaatactcctttccccctccctcactccttcctttgcgggctgcctcacctcctccacccttcttgcttaaatccataggcatttgtctggccttcccttttactgctggctgggaaggaggagcatcagaccacagatcctggaaggcacttctctccctgactgccgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcaggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatctgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaagtctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctactcctcttttcttttaaaagggcccacaatgctccaatttcctgtctcctttagagagacatgaaactatcacaggtgctggatgacaataaaagtttatgttcctaaaaaaaaaaag

SEQ ID NO: 37344 - DNA, 2776 bp, Homo sapiens
tcctgtaatctcagcatgggaacaagcctttgtgtcacactgtgcaaccttcctccctttcttaaatgcttggggtgagagagaagagaggctagggtggggcatggaggacacagagagagagagtgctgtgtattccttccccgctactgtcctgtcctcagctaacttgctctgggacagcttccccagggctacagatactgcactcagctgactgtcctttcttctgggcccctggtcccagagcagagctgacaaaggagattcctgagagagcaccttcttatcacagaaagtgctgagccaagagctcctagctgccccttttgcagatgtgaagggccagtgaaccttggacccagatggttgcttaatactcctttccccctccctcactccttcctttgcgggctgcctcacctcctccacccttcttgcttaaatccataggcatttgtctggccttcccttttactgctggctgggaaggaggagcatcagaccacagatcctggaaggcacttctctccctgactgccgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcaggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatctgtctcttaaccttcattaactgtgcctatgtcaaatggggaaccctggtacaagatattttcacctatgctaaagtattggcactgatcgcggtcatcgttgcaggcattgttagacttggccagggagcctctactcattttgagaattcctttgagggttcatcatttgcagtgggtgacattgccctggcactgtactcagctctgttctcctactcaggctgggacaccctcaactatgtcactgaagagatcaagaatcctgagaggaacctgcccctctccattggcatctccatgcccattgtcaccatcatctatatcttgaccaatgtggcctattatactgtgctagacatgagagacatcttggccagtgatgctgttgctgtgacttttgcagatcagatatttggaatatttaactggataattccactgtcagttgcattatcctgttttggtggcctcaatgcctccattgtggctgcttctaggcttttctttgtgggctcaagagaaggccatctccctgatgccatctgcatgatccatgttgagcggttcacaccagtgccttctctgctcttcaatggtatcatggcattgatctacttgtgcgtggaagacatcttccagctcattaactactacagcttcagctactggttctttgtggggctttctattgtgggtcagctttatctgcgctggaaggagcctgatcgacctcgtcccctcaagctcagcgttttcttcccgattgtcttctgcctctgcaccatcttcctggtggctgttccactttacagtgatactatcaactccctcatcggcattgccattgccctctcaggcctgcccttttacttcctcatcatcagagtgccagaacataagcgaccgctttacctccgaaggatcgtgggtaagccgtgcatccttaagtccgctcagctattgcagagcttggtttttgcctttttctgtaaatccagcctccaaagacatctttgccttagccccttcttatgaacccttcggcttagtggaatcactcccctcacactgagttccattcagtgacacttgaactcagcccagctgacctcttctcaattccaactcaaagttctctttgtagggtctgccacaaggtacctccaggtcctgtgtatgtcagttgctgcagaaatggatttggaagatggaggagagatgcccaagcaacgggatcccaagtctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcctaaaaaaaaaaag

SEQ ID NO: 37345 - DNA, 1267 bp, Homo sapiens
tcctgtaatctcagcatgggaacaagcctttgtgtcacactgtgcaaccttcctccctttcttaaatgcttggggtgagagagaagagaggctagggtggggcatggaggacacagagagagagagtgctgtgtattccttccccgctactgtcctgtcctcagctaacttgctctgggacagcttccccagggctacagatactgcactcagctgactgtcctttcttctgggcccctggtcccagagcagagctgacaaaggagattcctgagagagcaccttcttatcacagaaagtgctgagccaagagctcctagctgccccttttgcagatgtgaagggccagtgaaccttggacccagatggttgcttaatactcctttccccctccctcactccttcctttgcgggctgcctcacctcctccacccttcttgcttaaatccataggcatttgtctggccttcccttttactgctggctgggaaggaggagcatcagaccacagatcctggaaggcacttctctccctgactgccgctcacactgccgtgagaacctgcttatatccaggaccaaggaggcaatgccaggaagctggtgaagggtttcctctcctccaccatggctgttccactttacagtgatactatcaactccctcatcggcattgccattgccctctcaggcctgcccttttacttcctcatcatcagagtgccagaacataagcgaccgctttacctccgaaggatcgtggggtctgccacaaggtacctccaggtcctgtgtatgtcagttgctgcagaaatggatttggaagatggaggagagatgcccaagcaacgggatcccaagtctaactaaacaccatctggaatcctgatgtggaaagcaggggtttctggtctactggctagagctaaggaagttgaaaaggaaagctcacttctttggaggcacctgtccagaagcctggcctaggcagcttcaacctttgaacttactttttgaaatgaaaagtaatttatttgttttgctacatactgttccagacttttaaaggggacaatgaaggtgactgtggggaggagcatgtcaggtttgggcttggttgttttagaagcacctgggtgtgcctacctactcctcttttcttttaaaagggcccacaatgctccaatttcctgtctcctttagagagacatgaaactatcacaggtgctggatgacaataaaagtttatgttcctaaaaaaaaaaag

SEQ ID NO: 37346 - DNA, 1058 bp, Homo sapiens
cagagtcaacagctgttgcagcatgagcgatacgcttggttctcctaactagcaccttcccctctcccctgactcagctggtagcccctcctccccgcacctgcccaaaggtcactggacaggcatttgtctggccttcccttttactgctggctgggaaggaggagcatcagaccacagatcctggaaggcacttctctccctgactgccgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtgtgcctgattgtggggaacatgatcggctcaggcatctttgtttcccccaagggtgtgctcatatacagtgcctcctttggtctctctctggtcatctgggctgtcgggggcctcttctccgtctttggggccctttgttatgcggaactgggcaccaccattaagaaatctggggccagctatgcctatatcctggaggcctttggaggattccttgctttcatcagactctggacctccctgctcatcattgagcccaccagccaggccatcattgccatcacctttgccaactacatggtacagcctctcttcccgagctgcttcgccccttatgctgccagccgcctgctggctgctgcctgcatctgtctcttaaccttcattaactgtgcctatgtcaaatggggaaccctggtacaagatattttcacctatgctaaagtattggcactgatcgcggtcatcgttgcaggcattgttagacttggccagggagcctcaactcattctggttattcctcaatgtgttcatcatttgcagtgggtgtcactgtaatgactcggtggtcagctcccgttcgggggtcgcgtaggtagttagcatgccagagtctcgttcgttctcgaatc

SEQ ID NO: 37347 - DNA, 1482 bp, Homo sapiens
tcctgtaatctcagcatgggaacaagcctttgtgtcacactgtgcaaccttcctccctttcttaaatgcttggggtgagagagaagagaggctagggtggggcatggaggacacagagagagagagtgctgtgtattccttccccgctactgtcctgtcctcagctaacttgctctgggacagcttccccagggctacagatactgcactcagctgactgtcctttcttctgggcccctggtcccagagcagagctgacaaaggagattcctgagagagcaccttcttatcacagaaagtgctgagccaagagctcctagctgccccttttgcagatgtgaagggccagtgaaccttggacccagatggttgcttaatactcctttccccctccctcactccttcctttgcgggctgcctcacctcctccacccttcttgcttaaatccataggcatttgtctggccttcccttttactgctggctgggaaggaggagcatcagaccacagatcctggaaggcacttctctccctgactgccgctcacactgccgtgagaacctgcttatatccaggaccaaggaggcaatgccaggaagctggtgaagggtttcctctcctccaccatggttgacagcactgagtatgaagtggcctcccagcctgaggtggaaacctcccctttgggtgatggggccagcccagggccggagcaggtgaagctgaagaaggagatctcactgcttaacggcgtagtagcctagatatagtagggagaacatagatacgagctacggagcatactatatagtattacaccccacaaagggtagtagctacataataacacgtgcctaccatatataggtactactactactaggtacatactagggctagtacaggggagcctactatactaccgatactatatagggagagccctatatagtatgatagacgggagactaggggcaaccacgcaatataaagaaaatactaggggccaaggataatagcctaataatacctaggaagggacctataggtgaagggatataccctatgactattaacatacaggagctactagagacactaccctagctacaatacaatatagaaagcacacaaccaagacacaaaaagacccatgcaatatagcaacaatacaatacatatattggcccgagacattaacaatttgcataacaaagacactacttactatccacccggaaatcataggaatataagacacccacctatattgctttgaccaagaccagacactagatagagtatagggcaagcacttgacaataaaaagtaactactattaaacctatcaaattaaacttgtgcccatatttgtcaacatcgagagaaaccctggtaaacaaagataattattacacataatgtaaaagataatggaagatcaccagacataagatacaaatatataagaaagacaaaac

SEQ ID NO: 37348 - DNA, 640 bp, Homo sapiens
gttagacattttacttgagtcttttcatatcacggtatgcctttattttaccctcatatataattaattttcatctgggcatatatttccagattagaaatcatttcttttcatacattttaaggaatttatacatttgcatctgaaattgtattcattatcttctagaaaccaagagtggacttggtatccgtctgattatattttctttgttggtaaagagcctcttttttccctttttattttcatcttctctttctctagtgtttataatcttatttttatgaatgtagtctaattatttagaacactgtctccgagtatgtgtttatttgggtttgtgttttgaacattgcctccaggtgcgagtttatgtgtgtttatgtttcctatttgaggttggacacttagaaaattttctcaattcgaaaactattttccttcagcactcagaaatttttatcaaagattatttccacgattatttcctgtccttggtttttcgtgttcttaacctagaattcaattgtttaatgttagaccttacacatcttcaatgtatcatatatatttcactcatattatttattgtcatatcttttggactattgtgtgaaagcaataaatgtatattacttta

SEQ ID NO: 37349 - DNA, 973 bp, Homo sapiens
gttagacattttacttgagtcttttcatatcacggtatgcctttattttaccctcatatataattaattttcatctgggcatatatttccagattagaaatcatttcttttcatacattttaaggaatttatacatttgcatctgaaattgtattcattatcttctagaaaccaagagtggacttggtatccgtctgattatattttctttgttggtaaagagcctcttttttccctttttattttcatcttctctttctctagtgtttataatcttatttttatgaatgtagtctaattatttagaacactgtctccgagtatgtgtttatttgggtttgtgttttgaacattgcctccaggtgcgagtttatgtgtgtttatgtttcctatttgaggttggacacttagaaaattttctcaattcgaaaactattttccttcagcactcagaaatttttatcaaagattatttccacgattatttcctgtccttggtttttcgtgttcttaacctagaattcaattgtttaatgttagaccttacacatcttcaatgtatcatatatatttcactcatattatttattgtcatatcttttggactattgtgtgaaagcaataaatgtatattactttatttattggtaatgctcttcattttcaaatttaatacacacaaattgtgcatacccacacacatataccacagatatattcattttcaggatttctttaagtgttattttaaaaataatcatattcttattttgtgaactgtgggatttcttgaaactttttgaaaactctcattagtctgtgtttgtgtggtttctttaaattatctcttccttcagaattacttttgtgttttgaatttgagtctttgccattcataaggcgggctttccttgaataccagataactctgagtttcctgttcatatttaagaataaataacctaatttgaag

SEQ ID NO: 37350 - DNA, 369 bp, Homo sapiens
ccagtcctagctgcttttactggtgattttctaaattttatttttcagtttcctgataatttattctttcccccaaactatagtgccaatagcctgagtaagaatgagactttcttacttagtgtagttcttctttcttttagcctccttgcactgaatgaagctattatctctttctttttaaattgaatattttgaataggcaatatagttcaaaaataaaaagaataagaaggcatgtcatgaaaattctcctttccactcctttcatcatgcttagttcctaaacaccccaaccccaataatcagtattcttagtttgtattctatcttttcagagtttctttttttttttcaagactgagtctt

SEQ ID NO: 37351 - DNA, 368 bp, Homo sapiens
gtctgatccctctctggagtataagctcactgagtacagagacctgtctcaccatggtctccctagcgcagcctggcacatgacagaggctgaaatatttacggaatgaacaaacggagaatgacctgtaacactcaggccttgcatttcatctgaggctcaaagagatggagtttgtccagagattgcaggctctgagccctcacatctcctatggccttatttccatctggcttctctggggtcctgggtatgaggtcctagctcaagtcaagacatggagacatcagagctgggtaccacctcttgcaccctcattgcaccctagccctctctggggttcctgcagtcctcccagaacctctgca

SEQ ID NO: 37352 - DNA, 825 bp, Homo sapiens
ctagtagtgggagaaagggagaacaagtatttgaaaaatggccaaaagctaggctgaaattcagactgtttataactcctgtggcttccattaatctctggtggcttgagcaggtcagagaggtaaactgtcctctcaaaaggactaagtgtacaatgagattccgagatacccatgaagataagcctcagagagcaaaactatgccagcatgtggccacttttgaaccatacatcataaatagggtagccatagagcagatttatctcagacaactcagttttattgcctgtttttctggcaggcataattattaagattgcagctcttgctttcaaaatgtgcctcggttgagatagtaaattacatagtcactctaatccataaggcaaagggacatgagacaaatcccctgagacaggggaaatgttctctgtattttttgaggcagaagttgaaatgagcagaatcagggcaaagtggaagagagcagggaggaataaacccattgtgaagtctctccttaccatgagctgggttccatgggggagcactttaatgccagtgctccataccgaagctagagatgaagaagtgagtagaagcagatgactttagggagcctctgccaaacatctaattctataaattctgctgggagggagcaagtgtgctgaaatttgagagaagctttaaaaggaaactagtataaggattctccactgataggcatttgagcttccaatgatgatatacaacaatacaagaaatctgcaagttttataaagcacaaaattagaaaaaactactttaaatttcaaatgg

SEQ ID NO: 37353 - DNA, 297 bp, Homo sapiens
acaaaacttcttgaaagagttatgtttgttgcttttttactgcacactctttctgaatccactcctcttgagtcttggccctctctttttccctgaaactactctcactatggtatcaatgactttcatatggccaattcccctggtcacttctttgtatacatatattttttcttttttaaaaattgaggtaaaagtcatttatcataaaattcctattgtgtataaattggccagcctgaagtattttgttatagtatcggaatggagtaaaatacttaaattttctatgtcttc

SEQ ID NO: 37354 - DNA, 439 bp, Homo sapiens
gctcgactgatccacccatctcagcctcccaacgtggtgggattacatgaggtcaggggttcaagacctgccttggcctgttgaagtgctgggattacagcgtgagccaccgtgcccagccatggacatagagaactgctttctgaatgctttggaagaacacaggattggcattgctgggagggcctctgccaaagagggctctccaggccgagggaagacagaggtggatacaaccctttgtgaggagtgtggggcactgggaccctctagacagccagtgcttgccacacccttgtgcctgccagaactgcagccttgaggcagtcccttgcctggttattgaagtggagatgggatggtggggggtgagttggatgtcccccgggacactattactcagctttgaagctgcagcagttcccagcacacgtgaagt

SEQ ID NO: 37355 - DNA, 368 bp, Homo sapiens
gccatatttgaccattgtcttacagattggtggttatttatttaatcagttcagcctgtgttttggcattaaatagataatatcacatgatttgttcattcattacttaacaattattaggagcctattatattctaagtgctgcgctgggtatgtggcatattaaatgagataggacttccctttaagtacatcattgtctaatgatcacacaccaaataattgtactataccatgataagtctaggaatggagatgaacacaaggtttgtcatttatattagtgtatttttacaagaccaaaaagtgtttttctatatgagttgtatcttctctgttgagaattctttctgcattctagtaaaaaa

SEQ ID NO: 37356 - DNA, 214 bp, Homo sapiens
acgatgacatcacaaaggaacacttactaagaaacacttaaggcctgaatgaatcatgttaaatttacatagtcaatcaaggatgtctgcatttagagaaaagcactctaaaagattaacactacctgtttttaagaaatcaattactttatcatcagtcataacccaactggttaatgaaccatactagtatttatatcatgctagagtacaa

SEQ ID NO: 37357 - DNA, 666 bp, Homo sapiens
ccgtctcaataataatactgatacttaaaatatctttgcgaggcccaagtaggtttacagaaaatcatcttaggacaattttttaatttgagaaagtcactttggcagttctttgcacacaattttgacaagtgtatgtattataagttgtattgtattcatatttaaaaggaaattgggtagtttgccttttgaagaatgcgctttttaaaaaggaaccatatcagatccttatgaagcagccgatgcctgccatggttcctacaggtcctgtacagactcggggctttgtccaagtctccactaaacatgctaagcttcgatgcgccctggagaatttccacggggtgatccacgcacctccatgagaccctgcagcttgcttgtatgactggaagcattggataagcttcgcgtgctggctctccagttctttccttctctttacgactgttgtagcttttagctaatggagtggtgcggtccaagtgcggccacctacgggaggtgcagggctgcctcggaagctggcaggggaccccagtctttgcgttcataaagacatttagaaccggatgaatgttgttccttttttgaagttgttattaaagtaggtgcaacaaccaaaaatcaataaataataaataaattgactaaatatttttt

SEQ ID NO: 37358 - DNA, 208 bp, Homo sapiens
tcaacagtcctcaccagcctcggcaacatagtaagaccccatctctgaaaataaaaaatgaaaaattggcccagcatggtggcacacacttgtagtctcagctactctgaaggttgaggcaggaggattgtttgggttcctgtcatatgtaatcaacagtcctcaccagcctcggcaacatagtaagaccccatctctgaaaaaaaaa

SEQ ID NO: 37359 - DNA, 357 bp, Homo sapiens
ggaaagtctagagtctgcagggtggaccaggaggctggagacccagggaatagtcgatgttgtagtttaaggctgaaggctgtctgctggcagagttcttccttctgtgggggaggtcagtctttgttctgttaggatcttcaactgatagatgaggcccaccattgttgcaggatctgctttactccaagtccaccgatttaaatagtcatccgctgggtacggtgcctcaggtctataatcctagccttttgagaagctgaggctggaggattgcttgagcccaggagttcaagaccagcctgggcaatgtggtgagaccctgtctgtagaaaaaatcagaaaaattagttgggc

SEQ ID NO: 37360 - DNA, 395 bp, Homo sapiens
gacttgatcctgtaatgggttgagacttttcagatcttggtatgaaatgaatatattttctatgtggatctgatgtgaatgttttgttttgttttgttttggagacagggtctcactctgtcacccaggctggagtgcagtggcgtgaccatggctcactgcagcctctatctcccaagttcaggtgatcttcccatctcagcctcccgagtagctggtactacaggtgcataccaccacgcccgggtaatttttgtactttttgtagagatgggtaatgtattgagaccctgtttctacagaaaaatttttaaaaattagccacatgtggtgatacatgcctggagtcctagctactcgggaagctgaagtgggaagattgtttgagcgtggga

SEQ ID NO: 37361 - DNA, 387 bp, Homo sapiens
ctcagtgcggtgtgtagatccctgcagctctcaaggggaaagcatttccctcatggggaaaattatggatgccccgatggaacctattgtctactctctgcataacactagctttggtgacctggtctctggggataaaattaaaattagtgccaggcacatacaaccctttcttcttccctgccatctttatagaaaccctcaatagagttctaatgcccacatttgacaatgatgtcttttgggaggtcaggaagcagagagagtaaaaaaaattctctcccaatgtggttttacaaatgggcattagccacaggctgttccagctcaagggtgaagagtagcacaaactcttttctttctctgcaataaaaagaatgaaattac

SEQ ID NO: 37362 - DNA, 416 bp, Homo sapiens
ttcttttaaaaaatgtattatttagtttttgtggagatggagtgtcgctatgtttcccaggctggagcacagtggctattcacaggcactatttttgcacactacagctttgaacttctgggctcaagggatcctcctccctcagtctccctaatattgggaatacaggtgtgcacccccagcctggctctatctagtttcttaaaaaaaaacaaatataataaaatagagaaagaaaggaaaatgaaaggaaatgaaagaaaacaaatttcaagtaaaaaaaaagtaaagtggagaaaaacaatagatttttaaaaggacttccagttgcaatgttcagttcagatctcaactctttttcttttctttgagacggagtctcactccagcctgggggacagagctagactccgtct

SEQ ID NO: 37363 - DNA, 762 bp, Homo sapiens
tcgtcgacattgaccctgtggacctgctttctgtcattgccttccctgccctcagtctcaggagcctgagactggcttctagatgggtttggacaatggatagcactggcaggaggagagtagagttgctgtgtttattttcctggtttcctcctgcaagatcatgtcatgttggctctcccagagggcatggctcatatcatggggccctctttgtctttccaagcctgtagatgatagcagcttcaggaggttgcactatcttttgactgtgcccacacccttcacaccttgtaaatagtccctttcttaaactctccttaaattacccagtttgggggtgctatctgtttcctgctgggatcctgatggctgtgttgcccaaacctaaatgtcagtcatgcttgcagttacagctgtgttattttcctgtagtactgatttccctcttttattaaaagttctgtggtggctgggcatggtggtttatatgtgtaatcccagcactttgggaggccgaggcaggaggattgcttgagtccaggagtttgagaccagcctaggaaacatagtgagactctgtccctaccaaaaaaaaaaaaagaaaaaattagccaggaatggtagcacaggcctgtagtcacagctacttgggaggctgaggtgagaggattgcctgagcccaagagttcaaggttacaatgaactatgatcctaccactggactccaccctaggtgacagagtaagacccagtctctta

SEQ ID NO: 37364 - DNA, 441 bp, Homo sapiens
acttatgctgagctttaaatgacaaagattcatataatccaagagagaagtattatttagagggattcttttaccatgtgatatataataaatgcatccaatgttatacatcaatttaaaaaacaagtaaataactttaaagaaaagataactactggccaggtgcagtggctcacacctgtattcccagcactttgggaggctgaggcaggcagatcgcctgtcaggagttcaaggccagactggccaacatggtgaaacctcatctctactaaaaatacaaaaatgagtcgggcatggtggcagagacctgtaatctcagctactcgggaggctgaggcaggagaatggcttgagcccaggagctggaggttgtagtgagccgagattgcaccacttcactccagcctgggcgactgagtggagcggaactctgtctca

SEQ ID NO: 37365 - DNA, 376 bp, Homo sapiens
tactatctatctttagagatctcaaagcaatgagtatgttgaaaataatagaatagaggacatgtgatgaattaggagtcaagccagttattcatacacctatacaaaagtgcctggagtttttaaaaaagctgtaggaagagaggatgtaaacaaatgctgcttataaatcatttttcttcaggcagtgggtaaaatgagtgatgcataggaatttgcatttctacattggcttacgctatcacatttaatcataacttgattttcttaataaaacatttctttctatagaacacatttattatttaccataatcatgttttaattttttgaaacatcctagtctatcatagttttagatatattgttgttcatt

SEQ ID NO: 37366 - DNA, 504 bp, Homo sapiens
tagggctgctgtagggattaaatgagatggtgcagatatagatctggctcatcacagcttcagccagcatgggagctgagtttgccacccttgggatgaaggagggctgggaagatccgccgtgcggcctcagcgaggcctgctgtatgtatgctgggcctcagtttccccaactaggctccctgagaacccatctccttggaccggcttctgagatgacccagcactggccccacatgcaacatgtgaagtgaaggggctgaaactctatgcagcagttcagctctgcctccaggtcaccagcacagagacagaggtcaccctgcccgccccaccggccgggattagcccgaaatgccttctgcctctttatggaagagacaagcagatggctgttgagcctgttgggattagagctggaccaagggagggagaggccccagaaccagcttactgcagggaggggccacctttggccctgactcagcagcccccagctcggca

SEQ ID NO: 37367 - DNA, 525 bp, Homo sapiens
gaataccccgtgctaccagaatggctgtcttagtacttcgcctgacagttgtcctgggactgcttgtcttattcctgacctgctatgcagacgacaaaccagacaagccagacgacaagccagacgactcgggcaaagacccaaagccagacttccccaaattcctaagcctcctgggcacagagatcattgagaatgcagtcgagttcatcctccgctccatgtccaggagcacaggatttatggaatttgatgataatgaaggaaaacattcatcaaagtgacatcctcaggacacacccatgtggctcctggacaatccaagagcagccaaatcctgcttttccagtttggctccacaagtcctccaggacagagccctcaaagcaactcccaacgagttctcaggattcaggctctggcttcaaccaaacagaactcattttgaacaccctgactgcatttttgcttttagaaagttagaataaatatggcgctttgggatcacatagttgatggagagga

SEQ ID NO: 37368 - DNA, 668 bp, Homo sapiens
gaataccccgtgctaccagaatggctgtcttagtacttcgcctgacagttgtcctgggactgcttgtcttattcctgacctgctatgcagacgacaaaccagacaagccagacgacaagccagacgactcgggcaaagacccaaagccagacttccccaaattcctaagcctcctgggcacagagatcattgagaatgcagtcgagttcatcctccgctccatgtccaggagcacgtaagcactgagaaaaacgttgctttttgtccaattctctgttgataatgaccacacaatgacctcatggcattaaaatacatgagaaacaaaaaaaaaaaaaaaaaaaaaaaaaacaaaaaaaaaaaaaaaaaaaaaaaaaaaaaaaaaaaaaaaaaaaaaagggggggggggggcggacccaaagaagaatacaaaacaaacccaggggggcagacgaggcgacaccccacaagaagagaagaaagaagcacggccacatagagtgtgtctcacagaaagacaccgggcgggcaaacaacagcgaggggggggttccccccaaaaaaaaagcgcgcgcgggggaacacaacgagctacgcatcacaaccccccgaggggtgtgcgagacacacagggggcaccaagacagcgacgcccagggcgcatatta

SEQ ID NO: 37369 - DNA, 2694 bp, Homo sapiens
tatgctttaactggacagaagaaatatttctcagacaatgtcgatgctgctgatgacaactgagatgcctggagctcacccttgatggagacttccttggtgattggagatgggggactctggtggcagaaatggctttggggtaggtgtgaagtcgcttcagtccctctgagttgcctcttctggatggaacgtgtgtatcaacaacaatgaaatgcacctccgtgtgcatggaggcggctgatgagaatacagataggccagtcctcgctcttccctccagaaccggccgctcccggtctgacgttggagcacgtgaactaagagtgacaattttttctacttgcttctgtgaataaagtgttctacagtcagcccagcactaaactcaccagaaaagaggagggaacagcacggagccattcatctggaattactcgatgtgcagaggctgccccttggccgcacttgggaacatcgtggacatcttccttcctctcaggctcctcctgacagactcctggcagcactggagacctcaggactatggagatcagaattgtaatggctttgtcatctcagtgtggccactcctgaggcaagaggctcctcctgggagcaggagagagagagtttgtgatgttggttggaaaataggatttatggatgcaggagggccgtgctaggcccctctgcccgcttctctccctgctgttggcggtgaccaggtctcaggagcggagacgaggctgttgtgagtgaaacagaagcccctggcatagggccagaccctaggcctgaaaaggatgcaaagcctgctgttttcaggctgttgggaagaatcgtgcgtaccgagtgattatgatgaaacgtatcccagagaggaaatgaatgggacctgaaaagtgggtctgccacatccctggtagcccgcctccaagagcactacactccccccagccccaccggccacactacatgacgtgggaaggctgtccgttcatccttaccctggggactcaagtgtgctctgcggagtgagtcacagccctgatgtgcaccctgcactactctttccccaggtgcgccggagacgcaggcttgctcatttccgtcctgacacagctcgctgttcctgcggtggtcagagtccccctgtgctgtgtcagctcctggacactactagtctttcacatgataaagcgcgagcactttttcgcttttgcagtatttggggaaattctaacacatttcccggggatttgcccaggtccctccacctcccacggtgggtaactgtgtggattctgcacctggcaatcggcgctcccctttggaaacacctgggggccctgtttcttccagcctggtccttggtttctaccccagccgctttcagccggcacctgcatgggactgcctggagggccacggtccagggaaggacaggtgggaccctgaccatgacagatctttctaaaacaataaagtcccattgatgacaactgcagtgggatgaatgccattgcagcggtcatgctgggagctgccgagagcttacaacaaaagcagttcctctcaagacactgcttgcatcttccctccacgcctctcggtgcatttggaacttgtttatgcgctggtataactcgagtcagctgcttatttctgtgcccttgcactcacaggttccttcattaacattttaaataagtggctaaaaaaactcctctggaggttgtttttgaaagagacaggaaaaagaaacacacagtacctggattgttttgacttattttcaagcgactcagctgaaagccggtgttgcatacacaatttcctcacgctgacccagcctgactaagacttgataaaaggcacagcccttggcagcaggcagtgccaatgtggacagtgtacactaagctgtgagtgtgtgcacgggcgagcacatgtatgtgtactcatacatccagatgaactaaagggacactgggctttgtgctggcaaaggttacgatgctgctgtagcttggctgtgggccccaggcagtgtcagatggaacctgctttgatggcgtgttgttcagtgtactcagtggggtctcacatggcccgaggacccactgtgagcactccgcccgctgtggcacagaacacggctggggtcatcacagcccaggtctttattgaaaggcggctcatatagaacccatttggccaggtctgggccatctctctgcctctgccctatcttggctgcctggaggggcccaggcccaagaggattctttacccctggaagagctccccaggcattcagcctatggcccttgacatttggctgcaggttaccgtcagaatcaacaccatatcctgaggaagccctggtatttccccaagtctgcctatgtattagacactctaatcaatgctaacacagttcagtttttgagggaactagttttgtcataatactacacccctctattgtttttaaataagaaaaaaaaaaaccccacgaaactttccatcaaagcaatggtccgtgttggcctgatgctttaagaagtttgaggacggtaggtatggaggcaccttaacaccagtttttgagcagaagtctagaagctgatttagaactacacagctatggatacacctgatgaaaaccgcaaaaggcgatgacaggcc

SEQ ID NO: 37370 - DNA, 1580 bp, Homo sapiens
tttcacatccatcagagagtccacactggagagaaaccctacaagtgtgatgtgtgtggtaagggcttcagcacaattcaccattaatatgccatcggagagtccacacaggagagaagccatacaagtgtgaggcgtgtgggaaaggctttacccgtaatacagatctgcatattcatttcagagttcacacgggagagaaaccctataaatgtaaggagtgtggtaagggcttcagtcaggcttcaaatcttcaagtccatcagaatgtccacactggggagaaacgattcaagtgtgaaacgtgtgggaagggcttcagtcagtcctcaaagcttcaaacccatcagcgagtccacactggagagaaaccatatagatgtgatgtgtgtggtaaggacttcagttatagttcaaatcttaaactacaccaagtaattcacactggagaaaaaccatataaatgtgaggaatgtgggaagggcttcagttggagatcaaatcttcatgcacatcaaagagttcactcaggagaaaaaccctataaatgtgagcagtgtgataagagcttcagtcaggccatagattttcgggtacatcagagagtccatactggagagaagccatacaaatgtggtgtctgtggtaagggcttcagtcagtcctctggtcttcaatcccatcagagagtccacacgggggaaaagccatacaaatgtgatgtgtgtggaaagggctttagatacagttcgcagtttatataccatcagagaggccacactggagaaaaaccttacaaatgtgaagagtgtgggaaaggctttggtaggagcttgaatcttcgccatcatcagagggtccacacgggagagaaaccccatatatgtgaggagtgtggtaaggccttcagtctcccctcaaatcttcgagtccacctgggtgttcacaccagggaaaaactctttaaatgtgaagagtgtggtaaaggcttcagtcagagtgcacgtcttgaagcccatcagagagtccacactggagaaaaaccatacaaatgtgacatatgtgataaggacttccgtcaccgttcacgtcttacatatcatcagaaagtccatactggtaaaaagctttagaaatgagaaatgtgttaccaacttttgtctgaatgcacatcttcaagtttttggctagtccatgctggtggtaaaccctgtaaaactactgagagtggaagggggtttgttcacacttggaatctttctaacaaatccatcaagatgataacacagaaccatgaacaggaatagaactcgtatttaggggagaaatagggctggtggctctcttggtaagatctagttaatataaatgatcacctttcattgtgaatatatgcctgaagataatgtgtggaaggatatttgccatatgctaactggttttttggccagggagagttttgggttattatcccttttctttaattttcattttatacttacagtgatcattattttcataaaagctgtaaagctatgaaaaatgaataaaattactaaaaattttctgtaaaaaaaaaa

SEQ ID NO: 37371 - DNA, 1454 bp, Homo sapiens
tttgtccagagtgtgggaagggcttcagtcaggcttcaaatcttcaagtccatcagaatgtccacaccggcgaaaaaccatatcagtgccccgagtgtggtaagggcttcagtcaggcttcaaatcttcaagtccatcagaatgtccacactggggagaaacgattcaagtgtgaaacgtgtgggaagggcttcagtcagtcctcaaagcttcaaacccatcagcgagtccacactggagagaaaccatatagatgtgatgtgtgtggtaaggacttcagttatagttcaaatcttaaactacaccaagtaattcacactggagaaaaaccatataaatgtgaggaatgtgggaagggcttcagttggagatcaaatcttcatgcacatcaaagagttcactcaggagaaaaaccctataaatgtgagcagtgtgataagagcttcagtcaggccatagattttcgggtacatcagagagtccatactggagagaagccatacaaatgtggtgtctgtggtaagggcttcagtcagtcctctggtcttcaatcccatcagagagtccacacgggggaaaagccatacaaatgtgatgtgtgtggaaagggctttagatacagttcgcagtttatataccatcagagaggccacactggagaaaaaccttacaaatgtgaagagtgtgggaaaggctttggtaggagcttgaatcttcgccatcatcagagggtccacacgggagagaaaccccatatatgtgaggagtgtggtaaggccttcagtctcccctcaaatcttcgagtccacctgggtgttcacaccagggaaaaactctttaaatgtgaagagtgtggtaaaggcttcagtcagagtgcacgtcttgaagcccatcagagagtccacactggagaaaaaccatacaaatgtgacatatgtgataaggacttccgtcaccgttcacgtcttacatatcatcagaaagtccatactggtaaaaagctttagaaatgagaaatgtgttaccaacttttgtctgaatgcacatcttcaagtttttggctagtccatgctggtggtaaaccctgtaaaactactgagagtggaagggggtttgttcacacttggaatctttctaacaaatccatcaagatgataacacagaaccatgaacaggaatagaactcgtatttaggggagaaatagggctggtggctctcttggtaagatctagttaatataaatgatcacctttcattgtgaatatatgcctgaagataatgtgtggaaggatatttgccatatgctaactggttttttggccagggagagttttgggttattatcccttttctttaattttcattttatacttacagtgatcattattttcataaaagctgtaaagctatgaaaaatgaataaaattactaaaaattttctgtaaaaaaaaaa

SEQ ID NO: 37372 - DNA, 1197 bp, Homo sapiens
tgccccgagtgtggcaagaccttcaatcagcagttaacccttaacatttgtagacttcatactggagaaaaaccatataaatgtgaggaatgtgggaagggcttcagttggagatcaaatcttcatgcacatcaaagagttcactcaggagaaaaaccctataaatgtgagcagtgtgataagagcttcagtcaggccatagattttcgggtacatcagagagtccatactggagagaagccatacaaatgtggtgtctgtggtaagggcttcagtcagtcctctggtcttcaatcccatcagagagtccacacgggggaaaagccatacaaatgtgatgtgtgtggaaagggctttagatacagttcgcagtttatataccatcagagaggccacactggagaaaaaccttacaaatgtgaagagtgtgggaaaggctttggtaggagcttgaatcttcgccatcatcagagggtccacacgggagagaaaccccatatatgtgaggagtgtggtaaggccttcagtctcccctcaaatcttcgagtccacctgggtgttcacaccagggaaaaactctttaaatgtgaagagtgtggtaaaggcttcagtcagagtgcacgtcttgaagcccatcagagagtccacactggagaaaaaccatacaaatgtgacatatgtgataaggacttccgtcaccgttcacgtcttacatatcatcagaaagtccatactggtaaaaagctttagaaatgagaaatgtgttaccaacttttgtctgaatgcacatcttcaagtttttggctagtccatgctggtggtaaaccctgtaaaactactgagagtggaagggggtttgttcacacttggaatctttctaacaaatccatcaagatgataacacagaaccatgaacaggaatagaactcgtatttaggggagaaatagggctggtggctctcttggtaagatctagttaatataaatgatcacctttcattgtgaatatatgcctgaagataatgtgtggaaggatatttgccatatgctaactggttttttggccagggagagttttgggttattatcccttttctttaattttcattttatacttacagtgatcattattttcataaaagctgtaaagctatgaaaaatgaataaaattactaaaaattttctgtaaaaaaaaaa

SEQ ID NO: 37373 - DNA, 177 bp, Homo sapiens
caattgaaaatcaaaccatgcataagacatgatccctgtccaccaggaagatcacagtctagcagagataagaggaagaaggcaaactgaactgtactccactgtagagagtgcagtaatagagcatggatctgaagaggtgtgattcattttccttaggtgtctgcctctgctttt

SEQ ID NO: 37374 - DNA, 241 bp, Homo sapiens
ctcagcctccaagtagcctgggctgcaggtgtgtgccaccatgattggctaattttttttttaattttgtgtagaaatgggttctatgttgccttgcctaggctagtctcaaactccaggcctcaagccatcttcctgcatctgcccccgaaagtgttgtgattacaggcgtgagccactgtgcctggccccaaaacagtgtttttaaaacttttatctttgctactttcttagtaagtaa

SEQ ID NO: 37375 - DNA, 425 bp, Homo sapiens
ttttacaatgctgtgaacaacattcactcctggaaaacactccaatgtcttacatcttgaggctgtggggatttttttttcttttggtttaaatgttgcctttcctatctttctgcatatcaatttttcccctgcccaagtcacaggcttggtagtaaccatcatgtttactgctgttccttcacatgtggttctctgaggcttctgagcaccagaattttattaaacagagctactcacaccataaagatggaattctgccagatctgaatcatagaataacaccagaattgacttcagaaatcatcttctctaaagatttgcaagatttttaaacagcacatgcctttgtaaaatgaaatcatcagtggaacaccgtatataaaataaaattaataaaaactactatggctggagaggtgaaa

SEQ ID NO: 37376 - DNA, 501 bp, Homo sapiens
gccctaatttagccaatttagcacactggccctaatttagccaatgtgcccactgtatcaagagagttgatgagaaagacacgagacagagccctgatgcattgtgtgatcgcctgcatccagccatgcctgaagtccaccttgatgtccttgttccatgcgccacatttccattttcacttatgctgcctgagttttgtttctgtcacttacaacccagagtcctgggtaactggagtctggagaacagcatgggtcagaggtcaggtttggctggaatgaagtgaaatggagccacatgtcttaagaagagacacaatgatcttccagtgtgaaagagccaagaccagttttgccaggagctggggccgacagtggcccccgtcacttgctgatgtctgtggtcaaggaaagcttgagggagagcaagtggaacgcagggcttctacactttcacaccccctgatttgtggttgctttatttagctagttagttttgaa

SEQ ID NO: 37377 - DNA, 1208 bp, Homo sapiens
gcacagctgtaatcccagctacttgggaggctgaagcgggagaatcgcttgaacccgagtggtggcggttgcagtgagctgagattgcaccattgcactccagcctggatgagagagtgagatcccatctccaaaaaaaaaaaaaaagaattaaaaaaataaagatttaaggaagtataatttcaaacatgagaatattctgctagcaccagcaagagaaagacctgcaaggcagaaacgaagcatgatctgactttgttttagtaaagatttaagattagcagtgagaaagccatgcaaccacaggctttgcaagttgttagagttagttccccggaatgtgtatgaagcagaaaagaacctgtttggcactgataccttcagtcacctccattcgcacaatcactgtcagaaacatcatctcatctgaccacctgtctctgtctccaccaccattcttgtcttttgcttgggctacttcagttgccgcctaactacgtgattcatctcatcaatcactcttaactaagagcctttgcaccactattgatttccctggagctctcttccttctccttcacctagttaccttgtttttatcgctcagagctcacttaaacctcactcatatcttttcctgcttcaccacctctccaccccaaattagatcacatttttgttacacatttccaaaggactctgtacttttttttcaaatcacttaattacatagtcatttcattgtttgttaaatacctgtctctctgcaaacactccctgagaactttcacgagagtgttgggcccgccattatttccttagtgcttcccagagacagaacacaaaccagattttcaggaaatagtgttgaattagtaaatatcagatgtggacgaaagcctggcaaagtacacatacatgttgatgcccactccctctccagctctctgtggcacctatggtctagtatattaggcacattctggggtatcagccccgctttcaacaattctgtcttctccaggattttgcccactccacttcccaaacatatgtgggaactcctaaaagccatgtttgtaaatgtgaagttcgatctagagatagaccaatatacttaagcatgaaacattcctcattagctgttttaaaaatgaaaaagtaccacaaaattgagaagtatcgtttatgtttcttaagttgctttt

SEQ ID NO: 37378 - DNA, 475 bp, Homo sapiens
ccaggtcactctgactggaggccccagctcttaacctctcagaagtacactgccttttctagagtgtagagttggaaggaactccagagatcgcttgattcagtccttatttttagatgtggaaatggaaaattaaatggcttgcccaaggtcacagagccactagctgagaagctaacttggcctcctgatgcttccttcgtgcccccactgcagacccacgcctgctccatgagcatccaataactcttccataaagatttatcaaaaattcgaggatggagcatcagtctcgacagaatttattttcaggtgctgcaaggcaagactctacatgggcttgggattgttcctacacaaagacaagctggccaagttgaatgattcaggagttgctttaaatcaccagatacatgaagcaagtaggtggcggcatttttctaaacagggacaagttacacatttcaactacggc

SEQ ID NO: 37379 - DNA, 686 bp, Homo sapiens
cttctatctgtatttgatcatggagtgtatactcagaagccaacagatgattcagaatgtgcaggattgtgcaggatcccacagagaaaatgcaaagacaccacaagaatatgtcagtgttacatctgagaccctttacagcagcatctgttgggttttatgtgttaagtgtacaaatttaaccttcttttgcaagcacttcttatagtttaaaaaaatttagaaaatagataagacagaacaatttgtaaatgttacatgtgggttaacagaaatgttattttcacatttgatttcatttctgaaaatttaaagggagaagacagctaattttaagaagtatttgttcaggaaataccctatataatagtcaaataatgaaaacattcttgtttataatatttttgcaataaaaagcaatgtaactatattaccaataaaaagtaaaatgactaccatttatctagcatttaccatgtactaagtataatccagcccttcggttagatctctcattgtatccttacagcagcctgtataattgtaattgaagaaattatgattcagaaagattccttgttcttagtggcctgttttgggggcctggaaccagtatttgattctcttgtcactctgaccccaaaactgaacaaccacccttagccctttgatgtaattttcccact

SEQ ID NO: 37380 - DNA, 1000 bp, Homo sapiens
ctggtgcgttagtggctcctgttgtcaggtcttaatttcacacctttaacacccgcagtggccatgtgctgagtgacagttgcagttgtaagagccagtgatgtaaatggcagtggggtgttgagttcacttggcttcagcgctagggaggagcagggccgtgcgactcacaggacgctatgggaactgctgaattcatgtgaaatgccgtttgcaaacccagtaagaacatttcactgattcagagccttcttacactttcagttgggatgacctggggggaagtcagtttttatgatttaattcaataccttttctccatctatttagtatgagatcatcacaacaaacagctttcagcacaataaaaagttcagtttcaaactggagtcgatggaagttgatctctctccttctccgattagaaaatctgagatagcagccggccctgcgagaatctccatgattagtccacctcaagatggacgaatgggcagcgtctcctcccggggccccgagcatcccggcctgacaacgagtcagaggagcgtgggaaagcctctcaggattccacctctgcaaattccctacaagggacccccactaacgccaacaccacagttaccagggagagcaggaagaggggactctccaagcttcgggggctcccaggccaggctgcccccccggccgcccatcagcatctccagcctgctgcagaggcagtgtttagtgtgaagttttgaagtcatttcaaagacaaagttgtgtttttaccgcgacttccatgcctcctgcgggacctgctcaccttggggcagtgacacctgaaagatgagcacccagccacccgctctgcccccttccagtcctccagccttcgtgcccaccagcatgtgtacgttagacagccagtgcgactgtactttccctcttgttgaaataattaagtaatgtagtggaataaagtatttttctgattatcaggacgagcataaaa

SEQ ID NO: 37381 - DNA, 561 bp, Homo sapiens
tcctaaccctcgtaactctcgcatgttaaaaaacaaaacaaaaaaacttgagcggcagcgtctcctcccggggccccgagcatcccggcctgacaacgagtcagaggagcgtgggaaagcctctcaggattccacctctgcaaattccctacaagggacccccactaacgccaacaccacagttaccagggagagcaggaagaggggactctccaagcttcgggggctcccaggccaggctgcccccccggccgcccatcagcatctccagcctgctgcagaggcagtgtttagtgtgaagttttgaagtcatttcaaagacaaagttgtgtttttaccgcgacttccatgcctcctgcgggacctgctcaccttggggcagtgacacctgaaagatgagcacccagccacccgctctgcccccttccagtcctccagccttcgtgcccaccagcatgtgtacgttagacagccagtgcgactgtactttccctcttgttgaaataattaagtaatgtagtggaataaagtatttttctgattatcaggacgagcataaaa

SEQ ID NO: 37382 - DNA, 839 bp, Homo sapiens
cgcagagctgcccgccttcgggccctgcgcggggaggctggtcccaaccttgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaagaccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtatgagatcatcacaacaaacagctttcagcacaataaaaagttcagtttcaacaaaaccacacggatgcctgctgccacctcactcatcagcccccgacagactggagtcgatggaagttgatctctctccttctccgattagaaaatctgagatagcagccggccctgcgagaatctccatgattagtccacctcaagatggacgaatgggcagcgtctcctcccggggccccgagcatcccggcctgacaacgagtcagaggagcgtgggaaagcctctcaggattccacctctgcaaattccctacaagggacccccactaacgccaacaccacagttaccagggagagcaggaagaggggactctccaagcttcgggggctcccaggccaggctgcccccggcgccataatttcagctgtgaaagcgtagtaa

SEQ ID NO: 37383 - DNA, 776 bp, Homo sapiens
cgcagagctgcccgccttcgggccctgcgcggggaggctggtcccaaccttgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaaggtaaaaagaatgaatgcttgatttgtaaagctccttgtcgtacagttttgctttcaaagcataccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtatgagatcatcacaacaaacagctttcagcacaataaaaagttcagtttcaacaaaaccacacggatgcctgctgccacctcactcatcagcccccgacagactggagtcgatggaagttgatctctctccttctccgattagaaaatctgagatagcagccggccctgcgagaatctccatgattagtccacctcaagatggacgaatggggttgaccttgtctaagccccctgtgcccggagagtgtgtcatttccagaggttcaccatgtttctgcatagacgtctgtcctcactggctgctcctccta

SEQ ID NO: 37384 - DNA, 751 bp, Homo sapiens
cgcagagctgcccgccttcgggccctgcgcggggaggctggtcccaaccttgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaaggtaaaaagaatgaatgcttgatttgtaaagctccttgtcgtacagttttgctttcaaagcataccgacgcagatatccaggcattcttcatgagcatagacagtctgtgtaagaagtactccagggaaacctcccagtatctcaggctttcccgaggctgttgccgtctcaagttatgcccagccacatcctccaaggaggtgcccagaggctcgacccatggaagccaagcagcagccagagatccccaagaacactgggtcagcacaacacgggcacccagaccaggatgccggcggtcccagagccagccagaggcccatggaaacaccatccaggacgcacctcaccccctcaccctgctccatcccagcaggaccctcattcacaccaagtccccttggggccggaagttgcttgagttcataaaacatgtctgttatcacagacatcagagccacaggccgtgcgctccagggtggttttgccaagtgctgcagaggccaggtgctgtctcaggagagaagacccagcagacccg

SEQ ID NO: 37385 - DNA, 522 bp, Homo sapiens
cgtggatcccgcacaggggtacccgtgtccgcttgcgccgtcggaccttgtggactcgattgctctgcaccagggttgatttcctccattccttacgccctctgccatgatgacgtcagacgcagcaaaggccttcagtcacgctaccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaaggtaaggcgccccaccccccgtgagtgcgcagtcgaggcacccactgccatgtgcattggtcgtctggctctccaagatcaagaatgaaagatgactgcagatgcagagggaagagctcgttcatttaccagaaactttcatcagagcaaaaatgctgtgggaaaaccgaagggaagaagggagaca

SEQ ID NO: 37386 - DNA, 663 bp, Homo sapiens
tgggaaatgtgttcctaacagacagtgggagtccgaatctcgtaagccgcaatattggaattttacccattgttttcttgttgcattcttagtctgagatagcagccggccctgcgagaatctccatgattagtccacctcaagatggacgaatgggcagcgtctcctcccggggccccgagcatcccggcctgacaacgagtcagaggagcgtgggaaagcctctcaggattccacctctgcaaattccctacaagggacccccactaacgccaacaccacagttaccagggagagcaggaagaggggactctccaagcttcgggggctcccaggccaggctgcccccccggccgcccatcagcatctccagcctgctgcagaggcagtgtttagtgtgaagttttgaagtcatttcaaagacaaagttgtgtttttaccgcgacttccatgcctcctgcgggacctgctcaccttggggcagtgacacctgaaagatgagcacccagccacccgctctgcccccttccagtcctccagccttcgtgcccaccagcatgtgtacgttagacagccagtgcgactgtactttccctcttgttgaaataattaagtaatgtagtggaataaagtatttttctgattatcaggacgagcataaaa

SEQ ID NO: 37387 - DNA, 953 bp, Homo sapiens
cgcagagctgcccgccttcgggccctgcgcggggaggctggtcccaaccttgcgtgggcttcgcgtgggcccggcctcgccgctgcggtcgcccgcctggcatggccaactgggtgttctgtaatcgctgcttccagccgccccacaggacgtcgtgcttcagcctcaccaactgcgggcacgtgtactgcgacgcctgcctcggcaaagaccgacgcagatatccaggcattcttcatgagcatagacagtctgtgtaagaagtactccagggaaacctcccagattttagaatttcaagaaaaacacaggaagagattgttagccttctatagagaaaagatttctaggttggaagaatcccttaggaagtcagtgctgcagatagaacaactacaaagtatgagatcatcacaacaaacagctttcagcacaataaaaagttcagtttcaacaaaaccacacggatgcctgctgccacctcactcatcagcccccgacagactggagtcgatggaagttgatctctctccttctccgattagaaaatctgagatagcagccggccctgcgagaatctccatgattagtccacctcaagatggacgaatgggcagcgtctcctcccggggccccgagcatcccggcctgacaacgagtcagaggagcgtgggaaagcctctcagtgtgaagttttgaagtcatttcaaagacaaagttgtgtttttaccgcgacttccatgcctcctgcgggacctgctcaccttggggcagtgacacctgaaagatgagcacccagccacccgctctgcccccttccagtcctccagccttcgtgcccaccagcatgtgtacgttagacagccagtgcgactgtactttccctcttgttgaaataattaagtaatgtagtggaataaagtatttttctgattatcaggacgagcataaaa

SEQ ID NO: 37388 - DNA, 315 bp, Homo sapiens
tttttttttttcaagacaggctccagctctgtcacccaggctggagtgcagtggcacaatctcagctctgcaacctccacttcctgattcaagccatcctcccaccaaatatgagtacttttactaactcccttcaaatacaaaatgagaacttagctacagtcagattttaaaatatattaaaaatgattataacaagaaaaccaataaatttcaaagtctgacatggtttaatccctgcttaaaacatttaaaatcaattattttgcttttccattcagtaagactaatacaggacattcagatagtgataca

SEQ ID NO: 37389 - DNA, 481 bp, Homo sapiens
caggtttccaaagggcattaaatctttgctaaatgaatgactgccaccaagttccactttgaaaagccctgcccaggaaccccatttgtataaggcaaaatacaaagacaccaagaattcctcaataccctaagattaattggggatcggtaaagactagaagatgaagaggcgccaaggccagccatgtactcatttctgctcatcaagccttagcctgggtttatcgctaggtgatgggtctgaaccctaggtgcggcccggggctggaggccatccaggagacaatgagcccctttcccagagaagccgagtgcccaaggcactgggctgtcgccgtcagaagactgccgagcggaagccctgcccaccgaggtggcggagacaggcaggcctgggcagccgctggggcggagggacggctcttggaaacggaatccgtactttaattaaagtttatgcagttttccaaaaaaaaaaa

SEQ ID NO: 37390 - DNA, 332 bp, Homo sapiens
tccatggtaaactctgaacacagagcagccaaggttcccctctgccctgcgtctgcacccatgctgcagcgttccagagcactcctcaacatcaatcagttcaggtgcggcccggggctggaggccatccaggagacaatgagcccctttcccagagaagccgagtgcccaaggcactgggctgtcgccgtcagaagactgccgagcggaagccctgcccaccgaggtggcggagacaggcaggcctgggcagccgctggggcggagggacggctcttggaaacggaatccgtactttaattaaagtttatgcagttttccaaaaaaaaaaa

SEQ ID NO: 37391 - DNA, 401 bp, Homo sapiens
agaggtaatttatgatagacgtattaataattgtgtttcagtaaagagaatccaggcttaacagtttcctttccctctgctcctgtccataaccagcattcccttccctctcactgtgaccagatctcttttaagttacatgcctagagaggagatggacatttgagcataaatccctcattactagttaaataagtattattgtgtttcctaccaatactaaactagtagtatctttgtaaacaaagaagagcatacggtaacatttccagtcttatatgtatagacttatcaaacagcatgatttttaactctttgatattagaagaatcttctggttaaacacagcatgttgaccacatacagaagcattctatttactctccctcccaagacccaac

SEQ ID NO: 37392 - DNA, 408 bp, Homo sapiens
gtccaaatggctgatgattcatgccatagacatcccaaaccagctggtaggcagagctcttggcattccaaatggaaacgtggaacagacacagatcacctggccacacagacctcagctctaaagacagatgactacttacctgttaaagttccctgtgcactattttttaaaatctagagatagataataaataggttaagttacattttaaattagcccaagagcatttgagaacagaatcatttttagaatcttaattctgagattcactgttgggcttaagtcactgcttctgtgatggttagttttgggtgtgaacttgactgtattaagggatacttacctgggaaagcattatttactctccatgcttcagtagatactgagcccttcccttttctgctg

SEQ ID NO: 37393 - DNA, 392 bp, Homo sapiens
atcagccccatgaggataccaataaaaagaaaattatcaaaatcctcaaccaccagctgcaacaaacagaagcccccaaacaaaatcctcctggcccctaccattattataaaaaactggacactggaagagaggttgctataagttaaagagagttaaatgacccctccctcaaaaccctcaaggtgtatattcctttattaagccattcttgaattgctataaatacccaagactgggtaatttgtaagaaaaaaaagaattaattggctcacagttctgcaggctgtgcaagaaacatgcagcatctgcttctggagaggactcaggaagcttccaatcatggcaaaaggtgaagcaggagcaagagagaatgggggaggtgccacaca

SEQ ID NO: 37394 - DNA, 566 bp, Homo sapiens
gcagatatacagaatgcagagcttgtctcctgtctgttcagggttggaaaatgaacagttcaaatccccgggaaacagagtttctagattgtctcatttacgccaccactactcaaagaagtggcacagattcaggtttaatccaaagttttattcatttctctctgctcaagagccttcccacaaaataggcactagcctgtcctcacttactggaagtgggaagagaaataggataagaagttctctgccatggaggcaaaatagttggaaagggtacagtgaaaacatgaggaagctcagaaagactcatgatattccatgcccagatcttccttggagctataaaatagaataatttttctttcaagtaggttagctagctctcccccaataaaaataccactatcagagtagaaacaaggtagacatttctaaaacatatgtgcttcattatgaatccatggatggctcaattcttaaatgtaaatagatctctaggaaactcaaagtacagtgttttcaatctaaaaagaagtattggcagtttcacttgcaaaattaaa

SEQ ID NO: 37395 - DNA, 367 bp, Homo sapiens
gggtcatttgagtaattcccctttcagaaaatttgttgaactgttaattaatctcactttgtaagctaacataaaatctttgtgaaattttaaccaaatctggttctttactgataaccatatgcatgctagtccatgcatgatcctatttattaatttatcaagataataaactcacatcattactctgctcagtcaagaaccagatattgtggtgggagatgcatatggaggattttaataccttaaagcaagaagactaaacaggagaatcgcttgaacctgggaggcagaggttgccatgagccgagatcacggccattgcactccagcctgggcaaaagagtgaaactccatctcgaaaaaa

SEQ ID NO: 37396 - DNA, 380 bp, Homo sapiens
ttacctcaggtgggtttggagaagactctgcatgtccctccgaaacagagcaagacataagattatccaccagcctgctttcgtctgctgactggcccactgtagctgaagagagtgagcatgccccggggccagcctttccaggtggaaatgaacaactgcccccaaagcctgcgccggaggctggagttgccattgctgcttgtgtggagatggagcagctgtatgacccacttgactcagacatgccagccatggacacagctggcctgttcaaagaaagtcatgaagatatgaagaagtcagatgaagaggaagagaaacagaagatggaagattctctgtgggcaggtgtggaggcgtgtcaaaaggtagacact

SEQ ID NO: 37397 - DNA, 368 bp, Homo sapiens
tgtctctacacaaaatacagagtatatttttctaagcctgtgatccaaaattatttgcctaatttgacctctagaaagtccgactactataacttagctttctgtttaaagtttcaggggtaaagtggaagaaaatatgcaagtcaacatggtgtattattacaggtcagattttcttctcctgttaaatactatcaatacatttgttgaacctttagtctctatttttgcctctctgtctcaaacagtttgtaaaggtctcttgcatttcttcagtaaaacaggagctctatttaatggcagaaatgtcatactgcatcttggaattcttaaagcaaaacattttactacattcagaaaaaaaatta

SEQ ID NO: 37398 - DNA, 424 bp, Homo sapiens
atggagaggacactactgtatttcagacttgtggctcctgccaaaaattgacattgttgtgttgcgatgatctaggtcacgttgcatgggttcctgtctgctgctggcatcttgactacattggacctttgactccttgggtctattgatactaccttactgctgttgataccttttcatatcatagtgttgatgtaccagtctgataagccaacttctccacacttgtgaactttgaaactaatttgtgttatgtgttcactcagcttgtgggaccatttgcaccctgatgatggtatgccttctatcccaaaagccactctacagtgggctgttagtcaggatatttagtgggccttcctcattccctaccatcagtggaaatccaatattgttgagtgttggagtggtcacaaaattgact

SEQ ID NO: 37399 - DNA, 437 bp, Homo sapiens
gcatagtgttgattctaacactgtttaaaatttttgagttaattaccaaatttaagtatttgtgaacttcacctaaaattctagacatacaacttctcttaaaattcagaaggtctggtaacactgattccactttgctgcatgacagcagacagtgggacctgagtgggggcttttcctactgtgatagggcaggtgtttctctgtttacacattgtctacctggtatggtttatctttttgcaagtctcatcaacacagatcttcaacttagtttatttaaccaaaagtattgatgctagagctacccatatttcacattagccttttccagctagagaaactttttttaccctggaaacctaaaggctagccttgtgaaatttacttttgaaactattactccatcttattttagtaaatctaggaaaaaaaat

SEQ ID NO: 37400 - DNA, 1327 bp, Homo sapiens
gtattcattaaaagaaaactaactggaaaacaggttagattaattcagtactattaaaaaagaattcagagctgttaatattttatcacaggataggatacttaaaatatagcattctgtgctgagatctaaggtgaagtctataaagattaaagttcccttttttctgatgttcaagttgattgttgttcagtatggcatatatgacaaaagtatatttgagtcaaatgtggctttctaaaatggatgcaacatgtagatccatacaagttggggtaggatatacccaagcgtgtatatatttgctcagcatgtgaaataataaaaataatacaaaactactcattcttcaaggtagttacagtttcaatgccactcttcctgtccccatattcattaagacagaagcttgatgcttaaacacacactggtatgaaaatgttttgtgttttctgttatattgtcagaagtgacattgatttgaaaggatgagagccttattttcttgcaacccttactgaaaggcatgatttcaggtgaaaatcttcagtgatttttaacatatgtcacatgtttgcagtaaggtcagtctttccaatcacagatagagttatgcatctatattctaccaaatattagcaaaaccaatgcaatacgtgtctgtctttgcaatataaagtaagcttggtgattatatttagtggagttacttgaaataggtcatttagtttacatacagtttaattctcatgccacaattaataaggtatcacatgactgcaaaatacactgcagcaaactttctagcatctgatattggataaggatagcttgtgctagaagttggagattaatctggtctgctgactggcagcattagagactgtatctgatggttggtgtgaggatgttgttgacagttctgaaagttagccatcaattcctgtgcagggtggagtcagacccagtgacttccttttcaatgtcagcaagagttttctcatgcctgctttggtcactttctcttggaaacttcacgcatttgacttgcagcttcttgacccgaggaatcaactgagctcccagtgctggctaccttgggcaaataaaatctgtggttgagagagttctctttgctgtgccacagtccctgtgatgtgccaaatggcaccagcatttgcagcaaagctcgttaaatctttttggaatgggcaaatattttttcaacttgagccctgctgagccaaaccaaatacttgctggcagaataaagttcaaactggcaactgttttggagaccaaagtaatgccatatatctttttttaa

SEQ ID NO: 37401 - DNA, 342 bp, Homo sapiens
atcacaaatagttttaagaaacatgagaaaaagagtctgcaggcaatttgaaatagactcttaagtacctgacaaacctgagaaaaataggtagggaagaaatcagtgcattgaaacccaacaaaacttcaatgtaccatcccttttcaatcacttggaaggaaaatgatgtgtttagtacatcctccttcttcatgtttggatctttaaatagggtatttggattcacagactgtagcctcctcagattgtctctcctcccagcacactgccgtgctttttaaatgacaccagacttccaagcaagattgattgtaaatttgaaaaggttatatgtgatgt

SEQ ID NO: 37402 - DNA, 611 bp, Homo sapiens
tggaaaaccctgaatacagtgggaaagaggtaaacctttgtggttgtaagctactgagactttggggttatttgttactgtagcatgatctggcctattctaatttatacagtgggatttttttttcccccacaaacactaaggaagtagcatgtggaaggccagaccttctgttgccatcagtaggggggtttctgtagtctgaggacctatgagccttttgggttacctttgacttgcacttgggcttttatgttgatgccaagcagtatgtttatacttctctaaaatgtatttttctctatataaatagtgtttttgttaactctcaccggctccagtctcaacttttgcctctaatttttcccataatattcactaactctagtgatagctgtctatgcgcattgtactgagactaattcagagagtgggttggatgaactttggtttgatttgtacgtaattgttaaaaactgtgtttaagaaaacagttgtacccttggcaaaacctggaagtctctatgttaacaattttcccaatttttgttttaggaagccattctgcatattatgtttttaaataaaaggatttgactttgggctgacaa

SEQ ID NO: 37403 - DNA, 943 bp, Homo sapiens
  misc_feature (136)..(136): n is a, c, g, or t
atggagtcctagttgcaagggaagccacgctgtgaggatgcttaagcagctcagtagagaggccacatgacctcctgccaataacagcaccaggtgtataaggggccaccttggaagcagagcctctaggctcagngtggctaatggctaccgtattgatcagtgcagaggaagaacacttccatcactgcagaaagttctgttggacggtgctgctctagaaaatgaggtatagctgggctattcctccaccttgtctttcctttttcttccaaaatctaggaatcacaccatgcaccatgtgctgggcacacagtagctgtacaagacccacgaagaagcaatgatggggtcattcttctgccttaagcccaaagggtccttggtttgaccattgctcccaggtggacatatgcaaggcagcagaatacagccccatcacaagaaagggtctttatggaattccctgaaccccagcgctggctgagtctgaaagcaggctgatgaagcaaagcagaagtctcagaatctgaaatctttgaagacctggagctcagtagctatttggcgaatgatcggggaacttggaccattcttctgtcttctcatcctcttccttttcctgtccactgaatgtcacctcctacggcttctgtatcctccgaggatccttcctgtgtccccagtcttgctttctgcctgttcactgagtctctagaatttctcatcacacagtgatgaaaactctgaccattcctgaaaagtactgcactttgctatcattgcaaaagcaaggagaccaaaagtgtgtgtgtgtgcatgtgtgcgtgtgtgtgtgtgcatgcatgtgtgcacacgtgtatgtgtgtatgtgcaggcatgtgtgtgcctgtgtgtaaggcacagaattatctcctgtggaaacacttccttacccattcga

SEQ ID NO: 37404 - DNA, 964 bp, Homo sapiens
ggctggtacggcccgggattttgggccggaacctgcgagctggggcgcggcctcggggaggggcgggcgggacagacccagccgccccggctcccccgccgtccgcgtctgcgccggccccggggcctggtcggcggcggcggggccggtcgatggcccgggcggcggcggcggcatgcggctcctgttcctggcggtgctgcggccacacaccggcaacgcggtcacggcccagcgcgttcgggcccatctagaggctgcagggcacgtgtgcgttttgaaggatgcctttgactttgaaagccgatctgagattgcaaacctcatcttggctgagaactgcgaggctgccctggctcttcatctctataggggaggcaggcttttgcaaggccaccgaatcccttttggagtcatctttggtggaactgatgtaaatgaagatgccaaccaggcggaaaaaaacacagtcatgggcagagttcttgaggaagccagccgcatgctaagggtaaggtctatgtccagagtcaaggaattgcaacaacaccaaacgccgcttttaactggaatacctttcttcaacgctctgagattaaccaaagtgctgataatttgcacatatttcttctgatatgtggacttcgacaagttaaggatcctctctatctggtggacgcattttcagcctggcatcaggaggagcccaatgtgcacctggtgattgtgggtcctgaaaacattgaaagaaaaacttctagtttgatgctaaaattctggctaatcaagagagaaggcctcagactgggagccatgagcaggcaacaacagtatctagaaggcatttaataatgtggttttctttttcattgttttcattctgatgatcacatctcaggtacagtgcttgataccagctttccaattatgaaaattgcctttcaaaataaattgacttcacaaa

SEQ ID NO: 37405 - DNA, 819 bp, Homo sapiens
ggctggtacggcccgggattttgggccggaacctgcgagctggggcgcggcctcggggaggggcgggcgggacagacccagccgccccggctcccccgccgtccgcgtctgcgccggccccggggcctggtcggcggcggcggggccggtcgatggcccgggcggcggcggcggcatgcggctcctgttcctggcggtgctgcggccacacaccggcaacgcggtcacggcccagcgcgttcgggcccatctagaggctgcagggcacgtgtgcgttttgaaggatgcctttgactttgaaagccgatctgagattgcaaacctcatcttggctgagaactgcgaggctgccctggctcttcatctctataggggaggcaggcttttgcaaggccaccgaatcccttttggagtcatctttggtggaactgatgtaaatgaagatgccaaccaggcggaaaaaaacacagtcatgggcagagttcttgaggaagccagatttgctgtcgctttcacagagtcaatgaaggaaatggcacaagcgcagtggccgcatgctaagggtaaggtctatgtccagagtcaaggaattgcaacaacaccaaacgccgcttttaactggaatacctttcttcaacgctctgagattaaccaaagtgctgataatttgcacatatttcttctgatatgtggacttcgacaagttaaggatcctctctatctggtggacgcattttcagcctggcatcaggaggagcccaatgtgcacctggtgattgtgggtcctgaagtcgatccagtgtttacaagggaagtgaa

SEQ ID NO: 37406 - DNA, 1080 bp, Homo sapiens
  misc_feature (55)..(55): n is a, c, g, or t
catggctactgagatggtagaaggagagcctccatacctcaatgaaaatcccttngagggccttgtgcctaatagcaactaatggaaccccagaacttcagaatccagagaaactttccccaatatttcgggatttcttaaatcgatgtttggaaatggatgtggaaaaaaggggttcagccaaagaattattacagcatcctttcctgaaactggccaaaccgttatctagcttgacaccactgatcatggcagctaaagaagcaatgaagagtaaccgttaacatcactgctgtggcctcatactcttttttccattttctacaagaagccttttagtatatgaaaattattactctttttggggtttaaagaaatggtctgcataacctgaatgaaagaagcaaatgactattctctgaagacaaccaagagaaaattgcaaaaagacaagtatgacttttatatgaaccccttctttagggtccagaaggaattgtggactgaatcactagccttaggtctttcagcaaacagcctatcagggccatttatcatgtgtgagatttgcattttactttgctgactttgttgtaatagatcccattcattgtcccctttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgttacatgtaatattttagttcagaacttgacctgaaggaagggaagaaaagtatgtgatttttaccttttttaacaaatgtgaaaaaagtcagttttagaaattttgtggtagtaagtttggcatttgttacatgtatagagagaagactaataatctctattgataactaaatcattgagatagaaaaagattcccattgaccgtgtatttcttcccatttcgtcttccctt

SEQ ID NO: 37407 - DNA, 957 bp, Homo sapiens
  misc_feature (55)..(55): n is a, c, g, or t
  misc_feature (895)..(895): n is a, c, g, or t
  misc_feature (929)..(929): n is a, c, g, or t
catggctactgagatggtagaaggagagcctccatacctcaatgaaaatcccttngagggccttgtgcctaatagcaactaatggaaccccagaacttcagaatccagagaaactttccccaatatttcgggatttcttaaatcgatgtttggaaatggatgtggaaaaaaggggttcagccaaagaattattacagcatcctttcctgaaactggccaaaccgttatctagcttgacaccactgatcatggcagctaaagaagcaatgaagagtaaccgttaacatcactgctgtggcctcatactcttttttccattttctacaagaagccttttagtatatgaaaattattactctttttggggtttaaagaaatggtctgcataacctgaatgaaagaagcaaatgactattctctgaagacaaccaagagaaaattgcaaaaagacaagtatgacttttatatgaaccccttctttagggtccagaaggaattgtggactgaatcactagccttaggtctttcagcaaacagcctatcagggccatttatcatgtgtgagatttgcattttactttgctgactttgttgtaatagatcccattcattgtcccctttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgtaactggagctgttgtaactggagctgttgtagctggagctgttgtanctggagctgttgtaactggagctgttgtaactgnagctgttgtaactggagctgttgtaact

SEQ ID NO: 37408 - DNA, 934 bp, Homo sapiens
  misc_feature (55)..(55): n is a, c, g, or t
  misc_feature (931)..(931): n is a, c, g, or t
catggctactgagatggtagaaggagagcctccatacctcaatgaaaatcccttngagggccttgtgcctaatagcaactaatggaaccccagaacttcagaatccagagaaactttccccaatatttcgggatttcttaaatcgatgtttggaaatggatgtggaaaaaaggggttcagccaaagaattattacagcatcctttcctgaaactggccaaaccgttatctagcttgacaccactgatcatggcagctaaagaagcaatgaagagtaaccgttaacatcactgctgtggcctcatactcttttttccattttctacaagaagccttttagtatatgaaaattattactctttttggggtttaaagaaatggtctgcataacctgaatgaaagaagcaaatgactattctctgaagacaaccaagagaaaattgcaaaaagacaagtatgacttttatatgaaccccttctttagggtccagaaggaattgtggactgaatcactagccttaggtctttcagcaaacagcctatcagggccatttatcatgtgtgagatttgcattttactttgctgactttgttgtaatagatcccattcattgtcccctttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgggtataaaaagtttagggacccacgctggttgggtaccatgggaaataatttttaaggttcaagaaaacttggaccctttaagggaagagggggaaaaaaaaaagttnttg

SEQ ID NO: 37409 - DNA, 493 bp, Homo sapiens
  misc_feature (55)..(55): n is a, c, g, or t
catggctactgagatggtagaaggagagcctccatacctcaatgaaaatcccttngagggccttgtgcctaatagcaactaatggaaccccagaacttcagaatccagagaaactttccccaatatttcgggatttcttaaatcgatgtttggaaatggatgtggaaaaaaggggttcagccaaagaattattacagcatcctttcctgaaactggccaaaccgttatctagcttgacaccactgatcatggcagctaaagaagcaatgaagagtaaccgttaacatcactgctgtggcctcatactcttttttccattttctacaagaagccttttagtatatgaaaattattactctttttggggtttaaagaaatggtctgcataacctgaatgaaagaagcaaatgactattctctgaagacaaccaagagaaaattgcaaaaagacaagtatgacttttatatgagaccgcaagggggatctcaggca

SEQ ID NO: 37410 - DNA, 853 bp, Homo sapiens
agggaaatagaatcctagaatcacaagccttggatagcaggggctgagaagatcactaggccactctcatgcacccataacaaactgcagctgctcctaaaccaaccccccagcaaaaggctatctgcttttcagggaaaaaatattagagttatcctgatggcctcttatggtgtctaacagcctttctaaaccaggagactctcacctgtgactaatgaaaatctctcctgagcttgggtcaaaggtgttttggagcatcattactgagacaactgcagcacatggaatctgcacagttacaggactgtgggactcaaatctcaactcctccacttacaagtgacttgggcaagtgacttaacctttcttggctctagtatcctgatctggaaaacacagttataacccatactgtggttgtggggtgtaagagtcattacttgcaaagcagttcagaagcattcaataaatagtagctgccgctggacttattctgatgttgttggtagtgatggtattctttacctcttgtatccagaaaaaagctagggtagccaccaatttgtaaaacctcatccagttggtatttgactgacttcagcaatctctggagataaagagctgggaggattgctccccttctttgtccagctcactgaagtgcatgctgattgtgcagcagaggacctgctattcacagagtagggagaagttgatcgaggtcaggaacgcaggcacaaagggacactgtcagagctgacctcacgaatgctaatctcctttatcccttccaagaatggactgtaatcgtctccagattaaaatgtgcagtagaggtgaccaaaacaaa

SEQ ID NO: 37411 - DNA, 455 bp, Homo sapiens
tgggtgtcagaggtcctgttacttaccagggttgggggtgtagagtcatgtgaagattcagaagcattcaataaatagtagctgccgctggacttattctgatgttgttggtagtgatggtattctttacctcttgtatccagaaaaaagctagggtagccaccaatttgtaaaacctcatccagttggtatttgactgacttcagcaatctctggagataaagagctgggaggattgctccccttctttgtccagctcactgaagtgcatgctgattgtgcagcagaggacctgctattcacagagtagggagaagttgatcgaggtcaggaacgcaggcacaaagggacactgtcagagctgacctcacgaatgctaatctcctttatcccttccaagaatggactgtaatcgtctccagattaaaatgtgcagtagaggtgaccaaaacaaa

SEQ ID NO: 37412 - DNA, 565 bp, Homo sapiens
caccaaaagatcccctggaaattaggtgggaaaaccttaccttttgtggggccttgtgtttgtcttaaaagttcatgcacatggccaggtgtggtggctcacacctgttatcctgtcctggatcccttgagtcaaagagtttgagaccaacctggacaatacagtgagaccccgtctctacaaaagataaaatattagccaggggtggctgtgcgcatctgtagtcccagctagtactgtggctgaggcgggaggagcacttgagcctgcactgagctgtgatctcaccagtgtactccagcctgggccacagagcaagaccttgactcaaaaacaacaacaacaacaaaaattcttgaagattttgcattctgtcccactatccattggttttcatgtcaagataatgtgagaaattctttacaattgcttccagaaggaatagccttttgatttagtgcacaggtgtccagtcttttggcttctcaggcccacattggaagaagaatgctcctgagccacacataaaatacactaatgctaacaacagctgatgagcttaaaa

SEQ ID NO: 37413 - DNA, 272 bp, Homo sapiens
ttatgattttttttttttaaaaaaaacagagagtaacccaaagcttaccaggtgatccttcttagtaaaagggatttgtgggctgtggatcagcttcccactgattcatctgagatgaagacaggaccctccatcctgcaaaaatgggtttgaaaaaagaaaggaactctccatttacacgtgagaatggctcagcctaagaatgctgcttgcaggttcactgttctgcatttagaatccaggcctagagaagcagcacggcttgcctctgc

SEQ ID NO: 37414 - DNA, 580 bp, Homo sapiens
ctgtaagaatcataatcacaccctcacagtctatttctgttctccttcttctatttctaaaagggaacgtattccactattacacttagtcttttgttactttaaaactagaacaaaaaattcttggatccaccttctgaagttagatttagagaagatttaagctctaacaagagaagccaaggttcattctttccaaattttctctccacagtgtttctgtgattttttttttaagatctagatgctatttcctcaagtgatgtataaagatgcctcaacggatgagcagagctaaatttacttagactctgcctttttttctttaagtagagtagggggttattaattgtctggttctgtaatatctattccctgttccttcacccacccatgcctaaaaatctttggaggcattaagtaaagaaagtcacattctagagaaagagtactcacagctgccttttgttttgttttgctttactctctccatttaatgtggtagtatcccacactaccttttaaaaaaaataacttttttgatccttcaagtaatacatacttattgtagaaaaaaaaa

SEQ ID NO: 37415 - DNA, 288 bp, Homo sapiens
ataatattatgcagcgattaagtgtaacattttcaaagaatatttaatgatgtggtaaaatgctcacgatataatgttaagtggaaaaatcaatatctaaaactgcatctgcagcatgatcccaattttgtaaatttttatatacagaaaaaaacagtggcagaaaattatccaaaatgttaacagagtttgtgagattgtggacaagttttggtttattccttaagctgatctgtattttcccacattttctaaataaataattctttcttctatttgaatgccaat

SEQ ID NO: 37416 - DNA, 765 bp, Homo sapiens
gattccatctgcacagggcggagcttgggcctctggctgtcacagttgccctgacagacactgaggtgaccttggccaagtcacgcattcatttccatctgagtttctagtttaagataagaggaagaggacctggagctcctctggggctgcttcggcccagggtcctcctgctttctgagggtaacagtgtctgtgcccatgaaaacatgtgatgttagtcacagacctgccgtggcagaaatcccccatgcttccctctgctgggggcaggtgttatcattcacagccctgcggtggttgtctgtctgcttgtcaacaagcagtgaaataagagtaaagttgcctaatactgactcagatgcacaatccagttaacccagatgtgtgagatcttccggtttgaaagaactgtattggcaaggcaaaatcaacctattgtagaatatatttattgtatatcagcatggggattattaatattgctaataaaaccattatttgtaaaaattaagattaatagaagaatcgttctattttctcatagttttaaataggataaaaatatattctattcaaaatcctatttaaaatatatcctattcaaaattaaaagaaaatgtaagaatggtttccttttttttgagactctgctctgccacccaggctggagtgcagtggcgcaatcttggctcactgcagcctctgcctcccaggctcaagcaattctcctgcctcatcctcccgagtagctgggattacagg

SEQ ID NO: 37417 - DNA, 738 bp, Homo sapiens
acagtaattcccctgcctctcccataagcctgcgacttcttggagggtagaaatcaggcatgggggtcactttccattttgcggtgccagtgcagtaggtagaaagcaagtgcttgtgcagtgagtgaactgatggcacattagtcaacccacagagtaggagtaactggcaaaagattcatttgatcaggtaatcagatagtcgttttcaagtaaattgggacagcaactagagtaggaacaatcaccgcctactgactctcataaacgcctaagtctttgggagaaggcttgggcatctgctaaagacttcccccaagcctaggagtcaggccgctttttggatggaaacatctggaacgtaggttcctggaagcgcattgctgagccgtggcactggggcggggcctgcttctgtgcgccctcacaggcgcctcctgagataaggtgcactttggccaggttccaaaaggtggtgtgcggtcactgatctcttgaacgacctcatgatctttaggaaagggctttgctggaaaacactgcagaggcgtatttacagaagccagcacaacagagctggaaccgacttcactcacatctgtgcggggtgctgtggagattgtctaaacagagacctctcaccctgcatttcagcttccctgtcacgtgcttcaacttcagcagcaccaactgctgcagattccctgaagacccttccaatgaactcagaatggttta

SEQ ID NO: 37418 - DNA, 626 bp, Homo sapiens
tgaagtccagatgctgagctgggccatcctgtccttacctgtatgggatctttgttgtcagtactcaggccttcatgtgtacaacatgtgacgcttgccctagataagcccagtggtcaatttcccagggcctggatgttgtacacagcggagaagatgaagttgcttggggatttgatgaggaagaagagtaagaaaacaaattggggatggtagtagtggtaatggtgggggttaaaagtgaaaccacttgcagcagtgtggacacctcaccagccccagaaagcaggaggctgaggtgcacgcagttccctactggccactgcacagcagcacacactgtgtccagcaagttgggtggggtcttcaggaaaaaaagaattgcctcttccctcagtcatttaaataacatgttcagttagacaattacagaaattcagaaaacacagaagaggataaaaaagaacagacactatcactgttaatatttgaggtatttcttttcactattttttcatacacacacacacactctctctctcaataccttttttccactcaatgttactttgtgagcactccctcatcattaaatgtttctcagtgtttgaaaatgggacactgta

SEQ ID NO: 37419 - DNA, 452 bp, Homo sapiens
gaccagaggatgggacaatctgggttgtttttctttttttaatcaccatatgcccagctcccaagccccatgcctggcaccttcaggggtctcagaactataggtcttgccaccccctgtgacctgtgggcaggaacttcatctccgtgcaaacactcaaggccctcctcggcttgctcctcccttgtcgtccagccaggaaagcatcagagaaggcttcctggaggtgtctgagataaggctgaaagaacgaggcaagtagccaggtgcagaaaggtcaaaagaacattccagattgaggaaagagccagatatgcagatgaatgtgtcaggttccagccccaactgaggcccaaggagggtggatggatggacaggtagctgaaaaaacagacggggggccgtaagcaggtgaatatggttttactcagcagctctctcatcagcagctc

SEQ ID NO: 37420 - DNA, 247 bp, Homo sapiens
actcatgcctgtcgaccatagctctttgggagacaagacaagaggattgcttgaggccgggagttcaagaccagcgacacagcaggaccctgtctctacaagaaataaaaaaaattagccaagcatggtggcacatgcctaaaagtcctagctactggggaggctgaggtgggaggatcacttgagtgatcattgatgatgccactgcactccagattgggtgacagagcaagaccctatctcttta

SEQ ID NO: 37421 - DNA, 409 bp, Homo sapiens
atctttagattagagatgctcaacctacagaaaactctggaatcagggatttggaattcattcttaatttttgaggtcacagtcccttactttctgatatggccgtagcttcacccttgccagcgtcaaaagtgggatgagtaaccctttcgcactggagattttcagaacctactaggttacagagagatgctaaaaacctaggaagctgagagaaatttctgttgtgctggatgtggggggtagatgtcacttgaggagggggtaaacattgaatctttttgataatttggtagtgttcaaggggaatgctgaatgggcatgctaactggaaagactgcagtgggagtagggtagtgttggggtcctgtggacccagggacagatcaggcaggcagacaccccatta

SEQ ID NO: 37422 - DNA, 709 bp, Homo sapiens
ccagctccgttctggaaaagaaattgcgacgaaaagagacggcagccgtgacctctgctctgtatttccttcctcttcggagaggaagatggaatttagtagtttattgaggggcgggagatcctggctagcgcagagtgtagccatcgttttcggctctggcacactcgagggctgtcattcacatgtgtaatagatacgaattcggaaagatccagtggaaagaatactgcaacaacttctcgcaattacttcgataattcgcaattgctctattaacatcgtatcaggaatggtgggtcactttggactcttgtgtagataagatagactaagggttaaaggacgttcagcctcccacccaccaagaaacacacaggagaaagagtgagaggaagagctggaagtgattttaaatacactgtgattgctaaagcaagtcaatcatctccaaactgtggtctgcttcaattactagttagaaatgatttgtgaaagacctcacagaagactgcccacaccacgatgcattgagaaattgttttctagtacagtggtctttgaaagcaattgctaccgtcctcagaaactgtgcaggatcatgtatagggatgaagaaaaacacaaattggagtgctttatttgtacttcttttccagcttacaaaaaataaagatattatgcttcattaacatttaatgactagatt

SEQ ID NO: 37423 - DNA, 228 bp, Homo sapiens
catggaacaaaaggaaggtcaaggtggccagagcatcaagagcacaacagagtttgagaagatgaggcgggaggaaggcaaggacctcatcagccatgtaagacgcctgctcccactttgccttccaccatgagtcaaagtttcctaagtcttccccagaagccgccatgcttcctgtacagcctgaagaaccattagccaattaaatctcttttctttataaattac

SEQ ID NO: 37424 - DNA, 811 bp, Homo sapiens
catggctcttcctgaaatcctgagagcttattcctgcccttgaacttctattggttttataggaaaggctcttggaaccccagcacctgagcacaatcccattctaagatttcctgagtggtatcatttaaatttacagaaagagaactcccaacttttaacctggcacatattacccaaaatgaagactccatatatcagccatggccaagtttctgaccaatgagataaataaaacagacacgactggatgtgaaacagtcatttggaccatgaagtgaccttggaaaaggaagccaggactggtgtccatataagaagatagccctgtgaagacacagactcagagagaattctaatatggagatggaaacaaaatctgtagtcatgctgctccaagctaaggaatacctggggctaccagaagctcgaagaagcaggagaagttcctccctagaggcttcagagaacatgacatctgacacattgatttcagttggctgaccttcaaagcgatgaggtgaatttctgttgttttaagccacccagagacagccctaagaaattaatgcacatgctaatactagttttctctaagtttcattgagaatattgaaaaatatatatttaaatatctggatcttattgagaatacaaagaagactttcatacgttggtatttctgaatcttcatttataaagtgttaaataacttatgcccaaaagaaaaaatcggtcagaaattacctcatatcagtaagttctatagtaaaggaataaatgcatctaagaatgaaaaaaagaaatattt

SEQ ID NO: 37425 - DNA, 650 bp, Homo sapiens
catggctcttcctgaaatcctgagagcttattcctgcccttgaacttctattggttttataggaaaggctcttggaaccccagcacctgagcacaatcccattctaagatttcctgagtggtatcatttaaatttacagaaagagaactcccaacttttaacctggcacatattacccaaaatgaagactccatatatcagccatggccaagtttctgaccaatgagataaataaaacagacacgactggatgtgaaacagtcatttggaccatgaagtgaccttggaaaaggaagccagaagagttcttcttagctataactacctggaagaaaaagttgctgatcacattgagaactgaaattaatagcagaagaaagtgaagagtgaagaatatagctgctctattttgtttactacagggccttgtaaagaattaactaggtttaaatgaaatgccttttgatgtattttacttgaaatagcattcttgcttcaattaagcagtccccagaaaagcaataacacggtaggatcaaataagccagaatttgcttatcctccaagttctctggcgtgctaaaaagtcaaactcaggatgcaatatctgtgcttttgttgatgagtgcccaataaacaaggaactctga

SEQ ID NO: 37426 - DNA, 1617 bp, Homo sapiens
ggcggcggcggcgggcgcggcgcgatgtgcgagcgggcggcgcgcctgtgcagggccggcgcgcacaggctgctccgggagccgccgcagcagggccgggcgctgggcgggctgctgcgctgggtgggcgccaggatgggcgagccccgggagtcgctggcccccgccgcccccgcggaccccggcccagcctcgccgcgcgggggcaccgccgtcatcctggacattttccgccgtgcggacaaaaatgatgatgggaagctgtccttggaggaattccagctcttctttgcagatggcgtccttaatgagaaagaactggaggatctctttcacacgattgactctgacaacaccaaccatgtggacaccaaggagctgtgtgattactttgtggaccacatgggtgactatgaggatgtcctggcctccctggagaccttgaatcactctgtcctgaaggccatgggttataccaagaaggtatatgagggtgggagcaacgtggaccagtttgtgacccgcttcctcctgaaggagacggccaatcagatccagtcgctgctgagctcagtggagagtgcggtggaggccatcgaggaacagaccagccagctccgacagaaccacatcaaacccagccacagcgcggcacagacctggtgtggaagccccactcccgcctctgcccccaaccacaagctcatggctatggaacaaggcaagacccttccatctgccacggaggatgcaaaggaagagggtctggaagcccagatcagccgcttggcagagctgattgggaggctggagagcaaagcactgtggttcgacctgcagcagcgcctgtcagatgaagatggcaccaacatgcacctgcagctggtccggcaggagatggccgtgtgccccgagcaactgagcgagtttctggactctctgcgccagtatctgcgggggaccactggcgtgaggaactgcttccacatcactgccgtgaggctctcagatggcttcacctttgtcatctatgagttctgggagacagaggaggcgtggaagaggcacctgcagagccccctgtgtaaggcgttccggcacgtcaaggtggacacactgagccagcctgaggccctctccaggatcttggtgccagctgcttggtgcacggtgggacgggactgacagcctcccagaggcccgtggaggagcccaccagccccttcttcttgtgaaggaaatcccgtttttttctagacagacactttggtgcagaagcttcttttcaatccatcctccacaagaaggtgtttccctgttgttaagtgaaggaggccgcccctgcccccacctgagaaggcagagcagtgtctgtgctgccaggtcctggtgaagcccaaggttgaagggggcggcttcctggagccagcacccctgcctcctggtcctggcctctcccctacccctcacatggccacgcatgacccacactgaccacaccctgccctcttcggtgacattcttctacctagtaggagtcatgcccctgtagtgcccaacctagccaggtagccaccactgtgcccaggcgccaaataaaccctggttgggaagaaa

SEQ ID NO: 37427 - DNA, 2066 bp, Homo sapiens
ggaaaggggagcagctctgtcccacggattcagatgtcactggaaaggcagaacgaggaggcacctggtcttgtaggttcaggccagccttggagctgccctccacccatccctgcctaatgcagccggaacttcgtctgcggctgcttttctgaactcttggcgtcctgtttctcctcctgcaccccaaaattaacgcagtcctgcccgtggctggcattgtcaccaggccttgcaaacacctctgtcggactttgcccaacctccctggaaacacaccaggggttttggaaggactgcagtggtaaaggttgtggcgctccctgggacactgattcggagtgtggttgtgtgcagctgagcgtttggcggtgggtgaagccacgtggactgatgactgtggacctacacctgcagggatggccgtgggcctgcgtgtgtgtgtcagcgtggctgggagcaggctggtggtactggcagccgcttccacgtgggtgaggggagggcctctgtctgcaacatccctcatcagttccccctggatcccagcccggggagggggagagggaaggggggctcagcttcccaggaccctaagctgctcctgggagaagagaaggatcccagtatccggtcagaggctgcaggaagcgcttgcctctccctggcccagggctgactccgcctctcttttctgcagattttccgccgtgcggacaaaaatgatgatgggaagctgtccttggaggaattccagctcttctttgcagatggcgtccttaatgagaaagaactggaggatctctttcacacgattgactctgacaacaccaaattactttgtggaccacatgggtgactatgaggatgtcctggcctccctggagaccttgaatcactctgtcctgaaggccatgggttataccaagaaggtatatgagggtgggagcaacgtggaccagtttgtgacccgcttcctcctgaaggagacggccaatcagatccagtcgctgctgagctcagtggagagtgcggtggaggccatcgaggaacagaccagccagctccgacagaaccacatcaaacccagccacagcgcggcacagacctggtgtggaagccccactcccgcctctgcccccaaccacaagctcatggctatggaacaaggcaagacccttccatctgccacggaggatgcaaaggaagagggtctggaagcccagatcagccgcttggcagagctgattgggaggctggagagcaaagcactgtggttcgacctgcagcagcgcctgtcagatgaagatggcaccaacatgcacctgcagctggtccggcaggagatggccgtgtgccccgagcaactgagcgagtttctggactctctgcgccagtatctgcgggggaccactggcgtgaggaactgcttccacatcactgccgtgaggctctcagatggcttcacctttgtcatctatgagttctgggagacagaggaggcgtggaagaggcacctgcagagccccctgtgtaaggcgttccggcacgtcaaggtggacacactgagccagcctgaggccctctccaggatcttggtgccagctgcttggtgcacggtgggacgggactgacagcctcccagaggcccgtggaggagcccaccagccccttcttcttgtgaaggaaatcccgtttttttctagacagacactttggtgcagaagcttcttttcaatccatcctccacaagaaggtgtttccctgttgttaagtgaaggaggccgcccctgcccccacctgagaaggcagagcagtgtctgtgctgccaggtcctggtgaagcccaaggttgaagggggcggcttcctggagccagcacccctgcctcctggtcctggcctctcccctacccctcacatggccacgcatgacccacactgaccacaccctgccctcttcggtgacattcttctacctagtaggagtcatgcccctgtagtgcccaacctagccaggtagccaccactgtgcccaggcgccaaataaaccctggttgggaagaaa

SEQ ID NO: 37428 - DNA, 423 bp, Homo sapiens
tttttttggagacagggtcttcttgctccatcacccaggctagagtgcagtgacatgatcataggttactgcagcctccaattcctgtgatcaagtgatcttcccacctcagtcttcctagtagtagggattatagccactaggtacaacacctgactggcatttaattttaaatcttgtgtttccactttaaaatatacagccatttgcctcccctggaaagactgctgacacaagtgttctattatagaccccaactggcttcaaaccactctgtcatttccgtaaactggttgtatagtattatattatatttacttagtactataggctgctggcttacttaaaagatatatgtaatatgtgtgtatcttacttgttagaccaagtcatactataattaatcaggcagaagtataaatt

SEQ ID NO: 37429 - DNA, 322 bp, Homo sapiens
ggtagtaaatctaatctgtcaataattgttaagtactattttgacagcatcaaaaggtaagtgatcatttttcttttatactgaaatgatgaagtgatgctacttgcaagaaatgagaatgtattaacactttttccttttaggcatgggtccgcaaaaccgaatgctgaactatgagccagaaaaaaacagtctgtaaatatggcctgagaaagagtaattgatttttaatttatagggctgctatctttttttttttttcgagatagagactcactctgtttcccaggctggagtgcaagggtgtgatctcagctcattg

SEQ ID NO: 37430 - DNA, 592 bp, Homo sapiens
ggtctgtctgaccccagcccccccacagtgtgaccgtccgtggtacctgccgggttccaaccttggtctctctgaccccagcccccccacagtgtgacctgaattttctgcaacctcctgtggccttgtcctggcaggaggtgggtaactgtcatgagtttctcagaccacaaaaaccacaaccaccaccgccccccacaaaaacggaaacgccccttctttcagcgctggccatgagggagcggtggtgatggatggctgaccgtggagaattctgcattccaggggactgaggtcagggcaggcgggagctgcgtggccctggtttccaggactcaggctctggtgcattctcggggaggctgagctccccttcccgggtgccctccgtctactgagtgtgccgagctcattgctttcctgcctcccgtcctctctgcccctgtggctctcccagggaaatacccacgggaccccaggtgaaggttcctgctgcccgcccctctggggctggccctgctgggaggaatgccggcccccacccccaccttctccttgagtttctgtgaattaaaatatttgcaaatccaaa

SEQ ID NO: 37431 - DNA, 529 bp, Homo sapiens
  misc_feature (208)..(208): n is a, c, g, or t
tggttgtgaggtactcatcttcctttagttacccttagttatgtggcacacatgtccttattgcctagttcgtcatccacactttggatcttgtgaaaatgctgttagtatccaaccttaaaatatattagtatatgggtttttattaaaagaattactttgaattttctatttaattcatatgtaaataaaggaacatttcatttcncttaaaaaaattatatcagcctattatttcataattttaaattaaaaagtttagacaatatgtaatctaatagttttgaagatagttgcccagaaaggcttcgtgagttccacaagagtttggattgaattgctagtagttggcagcagctaagggatatggatggttgattgctctgtaggaggtttagtaagaaagaagccaagttctgggcaaggccttttgagctctgcttcccttttgcccccaaggtggctgaccaagcccagtgccctggattctaaataagatgtctttgaaaaagatgttgcattgtttaaa

SEQ ID NO: 37432 - DNA, 140 bp, Homo sapiens
gacaggccaaccaggatcttcttccttaattttctaagctggaaatggcaaagaaagctcttttggccctatatctggttgcctacctgtaccaataaatcccttcagccataagtatttaacaataacattataaagca

SEQ ID NO: 37433 - DNA, 372 bp, Homo sapiens
gaacctttttttttttttttttttgagacagggtctcactctgtcacccaggctggagtgcagtggcacgatctgggttcattgcaacctccacctcccaggctcaagcgatcctcccacctcagcctcccaagtagctgggtctataggcacatgccatgacacctggctaatttttttgtattttttatagacaggttttcacagtgttgctcaggctggtctcaaactcctaggctcaagcgatccgctggccttggccttccaaagtgctgggactacaggcatgagccaccatgcccagctagaaacttcttaaaaatgaagtcatgtttgtgaaatccagatcctcttttctatttgcgtttaaga

SEQ ID NO: 37434 - DNA, 701 bp, Homo sapiens
ctgattgcagagcttagagctactggtactggtcgaggaagagttgcaggaaggagacaggcagttcaggaggtggcactgctgtgtgtgagctgtctgtgttttccttctcagagtgcagagaagtgctgctgccactgctgacggaccagctcagcggccagttagatgacaactccaacaagcctgaccacgaggcaagctcgcagcttctgagcaacatcctggaggtgctggacaggaaggatgtgggtgccactgcggtgcacattcagcttataatggaacggctgctgagaaggatcaaccggacagtgattgggatgaaccggcagtctccccacatcgtgagtatctctttgttggatcccacggccgctgctgtttctctgtcccctttgcctatcgggaggccttcggggccagtggcttgagactattcttcacatgggcctctcacatcatgggtcattggttataaccttagcagatcttgattctgacatggattttctgttgagagaaaataatccagcctaggcaatatagtgagaccccatccctacaaaaaatttaaaaaattagctgggtgtggtggtggcacgtgcctgtggttgcagctactcaggaggctaaggtgggaggatcacttaaacgtgagatgtcgaggctgcagtgagctgtgattgcaccattgcatc

SEQ ID NO: 37435 - DNA, 403 bp, Homo sapiens
ctgattgcagagcttagagctactggtactggtcgaggaagagttgcaggaaggagacaggcagttcaggaggtggcactgctgtgtgtgagctgtctgtgttttccttctcagagtgcagagaagtgctgctgccactgctgacggaccagctcagcggccagttagatgacaactccaacaagcctgaccacgaggcaagctcgcagcttctgagcaacatcctggaggtgctggacaggaaggatgtggtgagttgagtcatcactgatgctgcacagagttcacactgtcccctttgcaccagacaggagtgactccgtggccttcctattctcaggtagtttccagctccggtattagggcaggctgtgcccattttagagataattagggaggccag

SEQ ID NO: 37436 - DNA, 419 bp, Homo sapiens
tcctaaaaatgtttagctgcttttcctgcttaaatgctcagatgacccataggacaaaggcacagttcaactccttcaattacagatgagctaactgaagctgagagaagagatgtgactggttcaaggtcgtagagatagttattgagagaatgggattaatacccactcttgcaagcttcagtccaactgttttttctgctaccagataattaataggtgccaccctcagagtctcagacctttcatatgggctctggaaaaagagaatgtgtatctgacttattgaggaggatgccaggagtttgtttgcctgagtcctgctgacagttttctcttggtccactgtgttctagaataactcagtttcacttcagtgaggtagaataaaaagggatcatctgaacaggaaaatggcc

SEQ ID NO: 37437 - DNA, 935 bp, Homo sapiens
ataggaacagcaaattgtatgaaggtaaatagatgaggataattaatggcagataatggctggttgtagtaaagtttcttatgcggattcctctggtgcagtctccaggctcaggctctaggttgtcactaacttctgccttccctggagagagggcaggagagaaaactctacaaatttatgtcatgcttttaggcagacagagggaaagcaaagagctttatctgtatctgcttcttcacaattgccttcagcaaaaaataatttttacaagtggcatactttggagtgacatattttgttacccttcattaatgacatttatttcaggaactgtatgtcagagaaaatccgtattatgtgtttgttgagtgaatacttgttcaagagaccaaaaaaaaaattagtaattacagtacaatacaacgtttgccacgatattgttctgtgtagacagcttcaagcaaaaatggacttagtttagagatagcttagcccagttagaagtcactgaagtaaggtgttgggagaaataaaaaaaaaaagaactaaaatagtgtaatccctttgaaaatactttatagaacatagctgagtctacaaattttgtttcaagatcatcatttgtatttaagaaggaggctgggcacagtggtccacacctctaatcacaagtgctttgggaggctgagacaggagatcgcttaagcccaggagttcgagaccagcctgggcaacatagcaagactctttgtctacaaaaaagttttaaaaatcagtctgtggtgatggcacttgcatgtagtcctagctgctagggtggctgaggcggaaaatcacttgagcccagaagttccaggctgcagtgagctgtgatcacgccactgcactctaggtgacagagcaagaacctgacttaaaaaatgaaaaaaaaa

SEQ ID NO: 37438 - DNA, 323 bp, Homo sapiens
agtgccaataactaggagctaatagagaaaagctaactaatggtgaaggtttgggcatagaaaagaggacactgttaagagtgaaacttgggaaatgagtagatgttatcagaaggagccagagcaccacaacggaggaatacatgtgtccatgtataatagcataaactaaggtggattcagtgaactgaaacaatgatctcctagaattgtgtatataaaatttgtgctttccaagtaatgtaaattgtagatcaattgttttcaattgaagggaaatttgggggagtaataaaagaattctatgccatgattgaactgta

SEQ ID NO: 37439 - DNA, 1025 bp, Homo sapiens
tgagacagggtcttgctgtgttgcccaggctggtcttgaactcatggcctcaagtgatcttcctgcctcatgctcccaaagtgttgggattataggcatgagccactgtgcccagctctagtgtaccattttaattctctcttttttttttaaacatactaacaccaaccggaatctcttgtttcttttgctttattcttttgagttattttctggattgttacctttctcccacctagttcaacccctcagaatcaccaagctaaaggatattaatgctggatctttttgtaaagacaagaaccttttcatagtgtgaataaccgccccctgctatatttgtcatagtctgaaatcagattgtcacatgttgtgttttctaggaatgtggttcctgttttaacgtagtacatgtcaggtaaaaggtaagccagagatagccattcaggagagaactgccagaaatgaaacgcttcctggtgaagggcagtgggtttgggtatgtacagtgccatgatgtttctttttcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctg

SEQ ID NO: 37440 - DNA, 448 bp, Homo sapiens
ctagaggtcccctgatgcaagagaaccccatgggtcgtgggtatatctgtccccttagtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcaggtaggtctcccaaggccctgggggtgtgaattcttcagagagaagcaggagctagcaagctggttctgtgaaaggccatacatacaagatttacctgccttggatagatgttgttcctgcaggggactatgttttagactatacaacattcttgtattttgcacagactgaaaacttttttcccatgcatgttccttcttactcctcc

SEQ ID NO: 37441 - DNA, 438 bp, Homo sapiens
  misc_feature (23)..(23): n is a, c, g, or t
ctcggctctacctggtcttcagnccaagtgcaggggccagaagacaaagtcaattccatgtgagtagtaaaattaataacatgtacatgaaatttatgaggctgctgttttttagtttttcaagactccgtctcaaaaacaaccctaaaaccaaaaaacaaatctgtagcttgtccattgattcacacctgggaaagaaactcatacgtacagaattgattataatgacaaaagtggctccttgaagtaagcgcaggcttaactacaatttttgccatgaatttaagctggcattttttagttgagctttcatccttgaagatgacaccaaaagctaatgacaagataattttgttgctcatgataggcatccttttttgatctcctattacatatgtgcgcagcactgtttgacatctattatttcattgtaatcct

SEQ ID NO: 37442 - DNA, 414 bp, Homo sapiens
attttacagatgaggaagctgaggcttagctaagaagctaagtgactggccctaagtcacacaagagcttttgctgggaagacggcaaacaagctgatggatgccctaaaggactccgacctcctgcactggaaacacagcctgtcagagctcatcgatatcagcatcgcacagaaaacggccatctggaggctgtatggccgcaggtaggtctcccaaggccctgggggtgtgaattcttcagagagaagcaggagctagcaagctggttctgtgaaaggccatacatacaagatttacctgccttggatagatgttgttcctgcaggggactatgttttagactatacaacattcttgtattttgcacagactgaaaacttttttcccatgcatgttccttcttactcctcc

SEQ ID NO: 37443 - DNA, 2248 bp, Homo sapiens
caagaccagccgggccaacatggtgaaaccccatctctacaaacaatacaaaaattagccgggcgtggtggtgcgtgcctgtagttccagctactcgggaggctgagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctg

SEQ ID NO: 37444 - DNA, 1077 bp, Homo sapiens
gttgaattggccttcacaaggccccgttgaattgggttgttttgcagttggagcagagatcttcagcagcaaaaggaaacaagttaggtggtcatgggaattcagaaagggcaacttatctttacttacctttcttaattcatgacatctgttttgcttttggcatatatctgctctacaaagtttaatgcaacttgccatgaaagaagagaaacctttatcacatttagcactggcattaacaaaagatgtatactacacttagtaactgggtgagatgttgtcctgtaatagcaaaatcaccagggcagtggaacacagaagctacttgacaagcacctgagaatcttatttctcaattgaaggccatatgggagcttcatgctttttttctgaaacacctgccactcagtggctgtcaggtgaagcagaacaatgactcatttatttcagcctggttttaatgatgttgatatgtttgacaggtctcattgagattcttgatatttcttgaaagagtatttgagaggattcattttgtcccttttaaattctttcttatgaccacattgatatttcactagaacatcagccattgccactgttatgatatattttgatgatttctcttgccagagctggctttatgtgctggggcagaagagatccgatagctatgttctgctggagcattctgtgaagaaggcagtacattttgggttaccgagagcttttgctgggaagacggcaaacaagctgatggatgccctaaaggactccgacctcctgcactggaaacacagcctgtcagagctcatcgatatcagcatcgcacagaaaacggccatctggaggctgtatggccgcaggtaggtctcccaaggccctgggggtgtgaattcttcagagagaagcaggagctagcaagctggttctgtgaaaggccatacatacaagatttacctgccttggatagatgttgttcctgcaggggactatgttttagactatacaacattcttgtattttgcacagactgaaaacttttttcccatgcatgttccttcttactcctcc

SEQ ID NO: 37445 - DNA, 2606 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgattagtttgtcttattttgttgctagtaactacgtatttgttttattccccttttcttcccttttggtagcaaaggacaccaactttttcttaataaatgggtattttgctaac

SEQ ID NO: 37446 - DNA, 3138 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgaaaaaaacacacaaaaaaacacaaacacacacccaaacaaaccaaaacacaaaaacccgcgaaggccgagaggcgcgggacgaaccagaaaccgaagcggcgcacccgcaccgcaggacgcgcacgcggacgagccggcaaccccgcgacgcggcccacccgaccacacgggcacgacgaagtcgcacctggcgccgcggggagaaccggccgaggcccgcagcgggagcggccgaaccaaggcgcgggacgcggggaggggcacacggagcaggggcgcagccgcgaggggaaagaagcgaacacgaccgccgcgcgccacaacgagagaaccgacaccggcagggagaaagcgaggggccagtaccacaaacgcagccgaacgcagcaacaggggagagccacggccgggcgaaacccacggcaaacgactgggcccgcgacccgggcggcacggaacacagcgccgcgaggagaaaaacaagagcaagcggcgacccgcggcacggggaccacggtgcgtggagcagaggcccccgccccagcgcaacaaggcgcggcgagaagcacgcccggggcgtacccgcggcggccgagcccaccagcaagaggacaagacaccagggacgcggtcgccaggcagggc

SEQ ID NO: 37447 - DNA, 2567 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgattagtttgtcttattttgttgctagtaactacgtatttgttttattccccttttcttcccttttggtagcaaaggacaccaactttttcttaataaatgggtattttgctaac

SEQ ID NO: 37448 - DNA, 2745 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagaactaaagactgaggtcctgggagctaaatcctgtatccaacacctgtaaatgtcagaggcaggtctccaaccgaaacctggttgactccaaagaagagcagtgggaatgggacataatcttgatgacttacagctcaaggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgattagtttgtcttattttgttgctagtaactacgtatttgttttattccccttttcttcccttttggtagcaaaggacaccaactttttcttaataaatgggtattttgctaac

SEQ ID NO: 37449 - DNA, 2528 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgagagcttttgctgggaagacggcaaacaagctgatggatgccctaaaggactccgacctcctgcactggaaacacagcctgtcagagctcatcgatatcagcatcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgattagtttgtcttattttgttgctagtaactacgtatttgttttattccccttttcttcccttttggtagcaaaggacaccaactttttcttaataaatgggtattttgctaac

SEQ ID NO: 37450 - DNA, 2683 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcaggtaaggggtctcttgtacatctcacggagatgtggtggtggatcttctcatcctgtgttttcctctttacggtcagttgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgattagtttgtcttattttgttgctagtaactacgtatttgttttattccccttttcttcccttttggtagcaaaggacaccaactttttcttaataaatgggtattttgctaac

SEQ ID NO: 37451 - DNA, 2633 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaagtaaggggtctcttgtacatctcacggagatgtggtggtggatcttctcatcctgtgttttcctctttacggtcagttgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgattagtttgtcttattttgttgctagtaactacgtatttgttttattccccttttcttcccttttggtagcaaaggacaccaactttttcttaataaatgggtattttgctaac

SEQ ID NO: 37452 - DNA, 2505 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgacccgaccccatgcgccccccagcaagcaacctctgcatgctatctgctaaccagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctg

SEQ ID NO: 37453 - DNA, 2374 bp, Homo sapiens
  misc_feature (2338)..(2338): n is a, c, g, or t
  misc_feature (2345)..(2345): n is a, c, g, or t
  misc_feature (2349)..(2349): n is a, c, g, or t
  misc_feature (2369)..(2369): n is a, c, g, or t
  misc_feature (2373)..(2373): n is a, c, g, or t
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaacagaacgctggtcacctgagctcggaatttcttcacatccnatgtcantagnctgttttcccttggtgctgnacana

SEQ ID NO: 37454 - DNA, 2636 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagagacgggattttgccatgttacccaggctggccgggaactcctggactcaagcaatcctcccgtctggtctcccagagtattgggattacaggagtgagccactgcgcccggccgtcatgtgttatttcattttgcagacacagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctg

SEQ ID NO: 37455 - DNA, 2503 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtagaattccagcagacagtcattgccattgtggagttgccattgcgtagcctggatgtcagttaatgctttccccttgtctctcgtcttattttcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctg

SEQ ID NO: 37456 - DNA, 2302 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctg

SEQ ID NO: 37457 - DNA, 2170 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcaggctctggccctctccaaggagtaccggttacagtacttggcctctgaaacagtgctgaacttggcttttgcgcaggtagtcttcctgtgcaagccctccaaggaggcctgtggaggtgtgaacctggtgacaaactgacactttccagtggcactggctttcctgagctgtgtattcagtaaggaggactcgcctcttcagtgagaacacctgcatcatattaatgattagctgacacagagtgatgcttgatttagcaacaaggggatgtgaataaagaaatgaggaacacagatgttcattgaaagcttttggaaatc

SEQ ID NO: 37458 - DNA, 1834 bp, Homo sapiens
  misc_feature (1724)..(1725): n is a, c, g, or t
  misc_feature (1741)..(1741): n is a, c, g, or t
  misc_feature (1825)..(1825): n is a, c, g, or t
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagaactaaagactgaggtcctgggagctaaatcctgtatccaacacctgtaaatgtcagaggcaggtctccaaccgaaacctggttgactccaaagaagagcagtgggaatgggacacaaccccgacgcaccacagcccaagcaacccgacgagaccccccccacaagggaccaaccaaannaccccccccgccaccncaggcccaccccccccccacccaaaacacccccccccaccgcggaaagagcccgggaaaactacccagctaaagccccccaacncagaaacac

SEQ ID NO: 37459 - DNA, 1617 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcaggtaggtctcccaaggccctgggggtgtgaattcttcagagagaagcaggagctagcaagctggttctgtgaaaggccatacatacaagatttacctgccttggatagatgttgttcctgcaggggactatgttttagactatacaacattcttgtattttgcacagactgaaaacttttttcccatgcatgttccttcttactcctcc

SEQ ID NO: 37460 - DNA, 1684 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccattttgggcccctttggtctcaaaaaaccttttgcccaaccttttttgataggcaaatatatttggttgtttcaactgttttcaggaataaccatttttttattc

SEQ ID NO: 37461 - DNA, 1675 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgccccccttttgggggccattggtgcacaaaatacatcttgtcagaaccaataaatgatgggcgaaataaattggggtggttaccctgtttccggaataa

SEQ ID NO: 37462 - DNA, 1660 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccggtaaggctcatctttctgtgagattgtttccataaatggtcgagcctttgtctctttttctgcccacctctgtcattaaccagcgatagatttagaatgggtttcaaagtgtggttttattcttggcagtttcatataactttaattattaatcagaccactaaattctgtgtggtaggtttctctctgttccctgtatcctaataacatctgtggaaattccctttaccaatttgataagagatcattgtttagtttattgagcaacattaatttagcacatagtcacttagaaaaattttagcaaaggcttatttttaaaccagggattggtgaactttcccgcccttgggccaaatctggctttctgcctacttaggggcttcaggctgagtggattttacatttttaagtgattgcagaaaaaaaaaat

SEQ ID NO: 37463 - DNA, 1152 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactagtaagtttatagacctttgtccttgcgcaaattgaaggaaccgatgacaataaaaagtctgctgtttggcctggtgcggtggctcacgcctatagtc

SEQ ID NO: 37464 - DNA, 1182 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcaagactccgtctcaaaaacaaccctaaaaccaaaaaacaaatctgtagcttgtccattgattcacacctgggaaagaaactcatacgtacagaattgattataatgacaaaagtggctccttgaagtaagcgcaggcttaactacaatttttgccatgaatttaagctggcattttttagttgagctttcatccttgaagatgacaccaaaagctaatgacaagataattttgttgctcatgataggcatccttttttgatctcctattacatatgtgcgcagcactgtttgacatctattatttcattgtaatcct

SEQ ID NO: 37465 - DNA, 921 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggtatgtgaattctgtaatttatcatgaacttctgttctagtcctgtgatgtgtctagtcctgtgatgtgtgttgtggcataggcccgttatgtgcataggtttgttggtcagtctgtgtcagcctttactcttggtcccctctgcctcactaacgaagc

SEQ ID NO: 37466 - DNA, 705 bp, Homo sapiens
  misc_feature (18)..(18): n is a, c, g, or t
  misc_feature (32)..(32): n is a, c, g, or t
  misc_feature (40)..(40): n is a, c, g, or t
  misc_feature (46)..(46): n is a, c, g, or t
  misc_feature (55)..(55): n is a, c, g, or t
tagaggatcccccgcgtnctgagttccctcanctatgatntacggnctttaggtncttggtcgtcgtgaaaaagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgattagtttgtcttattttgttgctagtaactacgtatttgttttattccccttttcttcccttttggtagcaaaggacaccaactttttcttaataaatgggtattttgctaac

SEQ ID NO: 37467 - DNA, 762 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtatgaaactcttctaagaagagcagagagtattttcattgaagtgagcagctttctaagtcatgtctatcattgttctgctatatctgtgaacagacacagtggggatgttggaggtgttgcagtttgtatttattgccttactgttttgatctatatttaaatcattaactgtggaaaagcaccttctgttttgtctacaatagtaagagtcagagcctggtcctggggtttttaggggttcccagctctttctcaca

SEQ ID NO: 37468 - DNA, 2492 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctg

SEQ ID NO: 37469 - DNA, 2568 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgcatctgttacacaacaacacaaacaaaaaaacttgggggcctcggctcaaaaatttaacaattcgttggggggcaa

SEQ ID NO: 37470 - DNA, 2545 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgattagtttgtcttattttgttgctagtaactacgtatttgttttattccccttttcttcccttttggtagcaaaggacaccaactttttcttaataaatgggtattttgctaac

SEQ ID NO: 37471 - DNA, 2524 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactaagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaaaaattgttggttcattgtcagaaactgaagaacacagaaatggtgatcagtgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgattagtttgtcttattttgttgctagtaactacgtatttgttttattccccttttcttcccttttggtagcaaaggacaccaactttttcttaataaatgggtattttgctaac

SEQ ID NO: 37472 - DNA, 2556 bp, Homo sapiens
tttagcaggtagcgaggcctgggtcccgagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatgagccgcacaggcgagggcgccgtcagcctcatggagcggcggaggctcaaccagctgctcctgcccctgctgcagggcccagatattacactgtcaaaactttacaagttaattgaagagtcttgtccacagctggcaaattcagtgcagatcagaatcaaactgatggctgaaggcgagttgaaggatatggaacagttttttgatgacctttcagattctttctctggaactgaaccagaggttcacaaaacaagtgtagtaggtttgtttctgcgtcacatgatcttggcctacagtaagctttctttcagccaagtgtttaaactgtacactgcccttcagcagtacttccagaatggtgagaaaaagacagtggaggatgctgatatggaactgaccagtagagatgagggtgaaagaaaaatggaaaaagaagaacttgatgtatctgtaagagaagaggaggtatcttgcagtgggcctctgtcccaaaaacaagcagaattttttctttctcaacaggcttctttgctaaagaatgatgagactaaggccctcactccagcttccttgcagaaggaattaaacaatttgttgaaatttaatcctgattttgctgaagcgcattatctcagctacttaaacaacctccgtgtccaagatgttttcagttcaacacacagtctcctccattattttgatcgtctgattcttaccggagccgaaagcaaaagtaatggggaagagggctatggccggagcttgagatacgccgctctgaatcttgccgccctgcactgccgcttcggtcactatcaacaggcagagctcgccctgcaggaggcaattaggattgcccaggagtccaacgatcacgtgtgtctccagcactgtttgagctggctttatgtgctggggcagaagagatccgatagctatgttctgctggagcattctgtgaagaaggcagtacattttgggttaccgtacctcgcctccctgggaatacagtcccttgttcaacagagagcttttgctgggaagacggcaaacaagctgatggatgccctaaaggactccgacctcctgcactggaaacacagcctgtcagagctcatcgatatcagcatcgcacagaaaacggccatctggaggctgtatggccgcagcaccatggcactgcaacaggcccagatgttgctgagcatgaacagcctggaggcggtgaatgcgggcgtgcagcagaacaacacagagtcctttgctgtcgcactctgccacctcgcagagctacacgcggagcagggctgttttgctgcagcttctgaagtgttaaagcacttgaaggaacgatttccgcctaatagtcagcacgcccagttatggatgctatgtgatcaaaaaatacagtttgacagagcaatgaatgatggcaaatatcatttggctgattcacttgttacaggaatcacagctctcaatagcatagagggtgtttataggaaagcggttgtattacaagctcagaaccaaatgtcagaggcacataagcttttacaatgtcctactgtccgtggcagagctgtactggcgatcttcctcccctaccatcgcgctgcccatgctcctgcaggctctggccctctccaaggagtaccggttacagtacttggcctctgaaacagtgctgaacttggcttttgcgcagctcattcttggaatcccagaacaggccttaagtcttctccacatggccatcgagcccatcttggctgacggggctatcctggacaaaggtcgtgccatgttcttagtggccaagtgccaggtggcttcagcagcttcctacgatcagccgaagaaagcagaagctctggaggctgccatcgagaacctcaatgaagccaagaactattttgcaaaggttgactgcaaagagcgcatcagggacgtcgtttacttccaggccagactctaccataccctggggaagacccaggagaggaaccggtgtgcgatgctcttccggcagctgcatcaggagctgccctctcatggggtacccttgataaaccatctctagagaggacatccctgctgggctgctgtgcagagtataagattttggacttgttcatgtcccctctctccctataaatgatgtatttgtgacaccctatcttgtcaataaacagcattctgattagtttgtcttattttgttgctagtaactacgtatttgttttattccccttttcttcccttttggtagcaaaggacaccaactttttcttaataaatgggtattttgctaac

SEQ ID NO: 37473 - DNA, 4243 bp, Homo sapiens
ttcggcgccctgctctttcctcatgttggcaatccccggccacggagaccaccgtcctcatgtcccagactgaggccgacctggccctgcggcccccgcctcctcttggcaccgcggggcagccccgcctcgggccccctcctcgccgagcgcgccgcttctccgggaaggctgagccccggccgcgctcttctcgtctcagccgccgtagctcagtcgacttggggctgctgagctcttggtccctgccagcctcacccgctccggacccccccgatcctccggactccgctggtcctggccccgcgaggagcccaccgcctagctccaaagaaccccccgagggcacgtggaccgagggagcccctgtgaaggctgcggaagactccgcgcgtcccgagctcccggactctgcagtgggcccggggtccagggagccgctaagggtccctgaagctgtggccctagagcggcggcgggagcaggaagaaaaggaggacatggagacccaggctgtggcaacgtcccccgatggccgatacctcaagtttgacatcgagattggacgtggctccttcaagacggtgtatcgagggctagacaccgacaccacagtggaggtggcctggtgtgagctgcagactcggaaactgtctagagctgagcggcagcgcttctcagaggaggtggagatgctcaaggggctgcagcaccccaacatcgtccgcttctatgattcgtggaagtcggtgctgaggggccaggtttgcatcgtgctggtcaccgaactcatgacctcgggcacgctcaagacgtacctgaggcggttccgggagatgaagccgcgggtccttcagcgctggagccgccaaatcctgcggggacttcatttcctacactcccgggttcctcccatcctgcaccgggatctcaagtgcgacaatgtctttatcacgggacctactggctctgtcaaaatcggggacctgggcctggccacgctcaagcgcgcctcctttgccaagagtgtcatcgggaccccggaattcatggcccccgagatgtacgaggaaaagtacgatgaggccgtggacgtgtacgcgttcggcatgtgcatgctggagatggccacctctgagtacccgtactccgagtgccagaatgccgcgcaaatctaccgcaaggtcacttcgggcagaaagccgaacagcttccacaaggtgaagatacccgaggtgaaggagatcattgaaggctgcatccgcacggataagaacgagaggttcaccatccaggacctcctggcccacgccttcttccgcgaggagcgcggtgtgcacgtggaactagcggaggaggacgacggcgagaagccgggcctcaagctctggctgcgcatggaggacgcgcggcgcggggggcgcccacgggacaaccaggccatcgagttcctgttccagctgggccgggacgcggccgaggaggtggcacaggagatggtggctctgggcttggtctgtgaagccgattaccagccagtggcccgtgcagtacgtgaacgggttgctgccatccagcgaaagcgtgagaagctgcgtaaagcaagggaattggaggcactcccaccagagccaggacctccaccagcaactgtgcccatggcccccggtccccccagtgtcttcccccctgagcctgaggagccagaggcagaccagcaccagcccttccttttccgccacgccagctactcatctaccacttcggattgcgagactgatggctacctcagctcctccggcttcctggatgcctcagaccctgcccttcagccccctgggggggtgccatccagcctggctgagtcccatctctgcctgccctcggcttttgccctatccattccacgttctggccctggaagtgacttttcccccggggacagctatgcctcagatgcagcttcaggccttagcgatgtgggagaagggatgggacaaatgaggagacccccagggaggaatctccggcgcagaccccgatcccggctgcgggtcactagtgtctcagaccagaatgacagagtggttgagtgccagctacagacccataacagcaagatggtgaccttccgatttgatctggatggggacagcccggaagagattgcagctgccatggtatataacgagttcattctgccttcggagcgagatggatttctcagacggattcgggagattatccagcgagtggagaccctgttgaagagagacactggccccatggaggctgctgaagacaccctaagcccccaggaggagccagcaccattacctgccctgcccgtccccctcccagacccatccaatgaagagctccagagcagcacctccctggagcacaggagctggacagccttctccacctcctcatcttctcctggaactcctttgtctcctggaaacccattttcccctggaacccccatttccccaggtcccatcttccccatcacttctcccccatgtcatcccagcccctccccattctcccccatttcttcccaggtctcctcaaatccctctccacaccccaccagctctccacttccattctcctccagcacacccgagtttccggtcccactctctcagtgtccctggagttctctccccacgacttctccacctacgttctctcccacttgttctcaggtcactcttagttcccctttctttcctccgtgcccctccacttcttccttcccctccaccacagcagcccctctcctttctctggctagtgccttctcactggctgtgatgactgtggcccagtccctgctgtccccctcacctgggctcctttcccagtctcctccagcccctcctagtcccctccctagcctgccccttccccctcccgttgctcctggtggccaggaaagcccttcaccccacacagctgaggtggagagtgaggcctcaccacctcctgctcggcccctcccaggggaagccaggctggcgcccatctctgaagagggaaagccgcagcttgttgggcgtttccaagtgacttcatccaaggaaccggctgagcctcttcccttgcagccaacatcccccactctctctggttctccaaaaccttcaacccctcagctcacttcagagagctcagatacagaggacagtgctggaggcgggccagagaccagggaagctctggctgagagcgaccgtgcagctgagggtctgggggctggagttgaggaggaaggagatgatgggaaggaaccccaagttgggggcagcccccaacccctgagccatcccagcccagtgtggatgaactactcctacagcagcctgtgtttgagcagcgaggagtcagaaagcagtggggaagatgaggagttctgggctgagctgcagagtcttcggcagaagcacttgtcagaggtggaaacactacagacactacagaaaaaagaaattgaagatttgtacagccggctggggaagcagcccccaccgggtattgtggccccagctgctatgctgtccagccgccagcgccgcctctccaagggcagcttccccacctcccgccgcaacagcctacagcgctctgagcccccaggccctggcatcatgcgaaggaactctctgagtggcagcagcaccggctcccaggagcagcgggcaagcaagggggtgacattcgccggggatgttggcaggatggtgagggcgggcccaagggagggagagcccagggaatggtacctggctgcagcttcgccttcctcccaccttggaggtttcttcatcactttttcttttccctccagtgaattcagaacagaagccatgtatctcccccacaccagggcccaccatggagcttgtgttctcagaatctgatgctttctgatcaacaaaactgagcaaggaagatcccaacactgaaggggtagaaggccaggggggcatggagagtgcagctccattatagtgaagagccaaacatatgtgaactgtttgctgtgtggaggtgttagttctgctgcctaccatcttcatctctagcacctcccctgccaagagtcaaccactaagcaatcccacccaagcctggatgcttctagaggggcccactcccagctgggagagtgtaggggatatgctcacaccacattagcagcaaccaataaaaatgctggaaacaagaaaac

SEQ ID NO: 37474 - DNA, 3863 bp, Homo sapiens
ttcggcgccctgctctttcctcatgttggcaatccccggccacggagaccaccgtcctcatgtcccagactgaggccgacctggccctgcggcccccgcctcctcttggcaccgcggggcagccccgcctcgggccccctcctcgccgagcgcgccgcttctccgggaaggctgagccccggccgcgctcttctcgtctcagccgccgtagctcagtcgacttggggctgctgagctcttggtccctgccagcctcacccgctccggacccccccgatcctccggactccgctggtcctggccccgcgaggagcccaccgcctagctccaaagaaccccccgagggcacgtggaccgagggagcccctgtgaaggctgcggaagactccgcgcgtcccgagctcccggactctgcagtgggcccggggtccagggagccgctaagggtccctgaagctgtggccctagagcggcggcgggagcaggaagaaaaggaggacatggagacccaggctgtggcaacgtcccccgatggccgatacctcaagtttgacatcgagattggacgtggctccttcaagacggtgtatcgagggctagacaccgacaccacagtggaggtggcctggtgtgagctgcagactcggaaactgtctagagctgagcggcagcgcttctcagaggaggtggagatgctcaaggggctgcagcaccccaacatcgtccgcttctatgattcgtggaagtcggtgctgaggggccaggtttgcatcgtgctggtcaccgaactcatgacctcgggcacgctcaagacgtacctgaggcggttccgggagatgaagccgcgggtccttcagcgctggagccgccaaatcctgcggggacttcatttcctacactcccgggttcctcccatcctgcaccgggatctcaagtgcgacaatgtctttatcacgggacctactggctctgtcaaaatcggggacctgggcctggccacgctcaagcgcgcctcctttgccaagagtgtcatcgggaccccggaattcatggcccccgagatgtacgaggaaaagtacgatgaggccgtggacgtgtacgcgttcggcatgtgcatgctggagatggccacctctgagtacccgtactccgagtgccagaatgccgcgcaaatctaccgcaaggtcacttcgggcagaaagccgaacagcttccacaaggtgaagatacccgaggtgaaggagatcattgaaggctgcatccgcacggataagaacgagaggttcaccatccaggacctcctggcccacgccttcttccgcgaggagcgcggtgtgcacgtggaactagcggaggaggacgacggcgagaagccgggcctcaagctctggctgcgcatggaggacgcgcggcgcggggggcgcccacgggacaaccaggccatcgagttcctgttccagctgggccgggacgcggccgaggaggtggcacaggagatggtggctctgggcttggtctgtgaagccgattaccagccagtggcccgtgcagtacgtgaacgggttgctgccatccagcgaaagcgtgagaagctgcgtaaagcaagggaattggaggcactcccaccagagccaggacctccaccagcaactgtgcccatggcccccggtccccccagtgtcttcccccctgagcctgaggagccagaggcagaccagcaccagcccttccttttccgccacgccagctactcatctaccacttcggattgcgagactgatggctacctcagctcctccggcttcctggatgcctcagaccctgcccttcagccccctgggggggtgccatccagcctggctgagtcccatctctgcctgccctcggcttttgccctatccattccacgttctggccctggaagtgacttttcccccggggacagctatgcctcagatgcagcttcaggccttagcgatgtgggagaagggatgggacaaatgaggagacccccagggaggaatctccggcgcagaccccgatcccggctgcgggtcactagtgtctcagaccagaatgacagagtggttgagtgccagctacagacccataacagcaagatggtgaccttccgatttgatctggatggggacagcccggaagagattgcagctgccatggtatataacgagttcattctgccttcggagcgagatggatttctcagacggattcgggagattatccagcgagtggagaccctgttgaagagagacactggccccatggaggctgctgaagacaccctaagcccccaggaggagccagcaccattacctgccctgcccgtccccctcccagacccatccaatgaagagctccagagcagcacctccctggagcacaggagctggacagccttctccacctcctcatcttctcctggaactcctttgtctcctggaaacccattttcccctggaacccccatttccccaggtcccatcttccccatcacttctcccccatgtcatcccagcccctccccattctcccccatttcttcccaggtctcctcaaatccctctccacaccccaccagctctccacttccattctcctccagcacacccgagtttccggtcccactctctcagtgtccctggagttctctccccacgacttctccacctacgttctctcccacttgttctcaggtcactcttagttcccctttctttcctccgtgcccctccacttcttccttcccctccaccacagcagcccctctcctttctctggctagtgccttctcactggctgtgatgactgtggcccagtccctgctgtccccctcacctgggctcctttcccagtctcctccagcccctcctagtcccctccctagcctgccccttccccctcccgttgctcctggtggccaggaaagcccttcaccccacacagctgaggtggagagtgaggcctcaccacctcctgctcggcccctcccaggggaagccaggctggcgcccatctctgaagagggaaagccgcagcttgttgggcgtttccaagtgacttcatccaaggaaccggctgagcctcttcccttgcagccaacatcccccactctctctggttctccaaaaccttcaacccctcagctcacttcagagagctcagatacagaggacagtgctggaggcgggccagagaccagggaagctctggctgagagcgaccgtgcagctgagggtctgggggctggagttgaggaggaaggagatgatgggaaggaaccccaagttgggggcagcccccaacccctgagccatcccagcccagtgtggatgaactactcctacagcagcctgtgtttgagcagcgaggagtcagaaagcagtggggaagatgaggagttctgggctgagctgcagagtcttcggcagaagcacttgtcagaggtggaaacactacagacactacagaaaaaagaaattgaagatttgtacagccggctggggaagcagcccccaccgggtattgtggccccagctgctatgctgtccagccgccagcgccgcctctccaagggcagcttccccacctcccgccgcaacagcctacagcgctctgagcccccaggccctggcatcatgcgaaggaactctctgagtggcagcagcaccggctcccaggagcagcgggcaagcaagggggtgacattcgccggggatgttggcaggatgtgaattcagaacagaagccatgtatctcccccactcccagctgggagagtgtaggggatatgctcacaccacattagcagcaaccaataaaaatgctggaaacaagaaaac

SEQ ID NO: 37475 - DNA, 2727 bp, Homo sapiens
ttcggcgccctgctctttcctcatgttggcaatccccggccacggagaccaccgtcctcatgtcccagactgaggccgacctggccctgcggcccccgcctcctcttggcaccgcggggcagccccgcctcgggccccctcctcgccgagcgcgccgcttctccgggaaggctgagccccggccgcgctcttctcgtctcagccgccgtagctcagtcgacttggggctgctgagctcttggtccctgccagcctcacccgctccggacccccccgatcctccggactccgctggtcctggccccgcgaggagcccaccgcctagctccaaagaaccccccgagggcacgtggaccgagggagcccctgtgaaggctgcggaagactccgcgcgtcccgagctcccggactctgcagtgggcccggggtccagggagccgctaagggtccctgaagctgtggccctagagcggcggcgggagcaggaagaaaaggaggacatggagacccaggctgtggcaacgtcccccgatggccgatacctcaagtttgacatcgagattggacgtggctccttcaagacggtgtatcgagggctagacaccgacaccacagtggaggtggcctggtgtgagctgcagactcggaaactgtctagagctgagcggcagcgcttctcagaggaggtggagatgctcaaggggctgcagcaccccaacatcgtccgcttctatgattcgtggaagtcggtgctgaggggccaggtttgcatcgtgctggtcaccgaactcatgacctcgggcacgctcaagacgtacctgaggcggttccgggagatgaagccgcgggtccttcagcgctggagccgccaaatcctgcggggacttcatttcctacactcccgggttcctcccatcctgcaccgggatctcaagtgcgacaatgtctttatcacgggacctactggctctgtcaaaatcggggacctgggcctggccacgctcaagcgcgcctcctttgccaagagtgtcatcgggaccccggaattcatggcccccgagatgtacgaggaaaagtacgatgaggccgtggacgtgtacgcgttcggcatgtgcatgctggagatggccacctctgagtacccgtactccgagtgccagaatgccgcgcaaatctaccgcaaggtcacttcgggcagaaagccgaacagcttccacaaggtgaagatacccgaggtgaaggagatcattgaaggctgcatccgcacggataagaacgagaggttcaccatccaggacctcctggcccacgccttcttccgcgaggagcgcggtgtgcacgtggaactagcggaggaggacgacggcgagaagccgggcctcaagctctggctgcgcatggaggacgcgcggcgcggggggcgcccacgggacaaccaggccatcgagttcctgttccagctgggccgggacgcggccgaggaggtggcacaggagatggtggctctgggcttggtctgtgaagccgattaccagccagtggcccgtgcagtacgtgaacgggttgctgccatccagcgaaagcgtgagaagctgcgtaaagcaagggaattggaggcactcccaccagagccaggacctccaccagcaactgtgcccatggcccccggtccccccagtgtcttcccccctgagcctgaggagccagaggcagaccagcaccagcccttccttttccgccacgccagctactcatctaccacttcggattgcgagactgatggctacctcagctcctccggcttcctggatgcctcagaccctgcccttcagccccctgggggggtgccatccagcctggctgagtcccatctctgcctgccctcggcttttgccctatccattccacgttctggccctggaagtgacttttcccccggggacagctatgcctcagatgcagcttcaggccttagcgatgtgggagaagggatgggacaaatgaggagacccccagggaggaatctccggcgcagaccccgatcccggctgcgggtcactagtgtctcagaccagaatgacagagtggttgagtgccagctacagacccataacagcaagatggtgaccttccgatttgatctggatggggacagcccggaagagattgcagctgccatggtgagggggagagagatgaggacagagtgtttggatctggaacaagagtctccttcctgatgtccgctggggctgaaacccactgatccgacagcaagcatttttaaatctctggttgacacttagcacagtaacgctgaagatgtctcagcccttgtttgggggagatttctgtttatccagtgaggtttggcttctcagctggagcaatttgagactcacattgaccgggtacacacaagtgctacgtataagtgcctggtagatgtgcaatactgtggctgtaggtgaaggatggactgggcagcaggggcaatgagcttacccaggatcttggcaaatgggcgagaaaggctgtgaagggtggaaaggccatgaagggtgtccctgtgcagggacagcataagcaaaggcattccaagtagagagtgtcttggaatatggggctgggagggcttcatgaggaaaccactatcactggaagtaaagattcctataggagagttgtggggagtgaagccgggtaggtagagtgggcccagattgt

SEQ ID NO: 37476 - DNA, 242 bp, Homo sapiens
ctggagttcccaagaaggcgtcctgatggatctttgatagggggtcccaagctgtgttcctcatcccccaccccaattccaggtggctctgggcttggtctgtgaagccgattaccagccagtggcccgtgcagtacgtgaacgggttgctgccatccagcgaaagcgtgagaagctgcgtaaagcaagggaattggaggcactcccaccagagccaggacctccaccagcaactgtgccca

SEQ ID NO: 37477 - DNA, 4136 bp, Homo sapiens
ttcggcgccctgctctttcctcatgttggcaatccccggccacggagaccaccgtcctcatgtcccagactgaggccgacctggccctgcggcccccgcctcctcttggcaccgcggggcagccccgcctcgggccccctcctcgccgagcgcgccgcttctccgggaaggctgagccccggccgcgctcttctcgtctcagccgccgtagctcagtcgacttggggctgctgagctcttggtccctgccagcctcacccgctccggacccccccgatcctccggactccgctggtcctggccccgcgaggagcccaccgcctagctccaaagaaccccccgagggcacgtggaccgagggagcccctgtgaaggctgcggaagactccgcgcgtcccgagctcccggactctgcagtgggcccggggtccagggagccgctaagggtccctgaagctgtggccctagagcggcggcgggagcaggaagaaaaggaggacatggagacccaggctgtggcaacgtcccccgatggccgatacctcaagtttgacatcgagattggacgtggctccttcaagacggtgtatcgagggctagacaccgacaccacagtggaggtggcctggtgtgagctgcagactcggaaactgtctagagctgagcggcagcgcttctcagaggaggtggagatgctcaaggggctgcagcaccccaacatcgtccgcttctatgattcgtggaagtcggtgctgaggggccaggtttgcatcgtgctggtcaccgaactcatgacctcgggcacgctcaagacgtacctgaggcggttccgggagatgaagccgcgggtccttcagcgctggagccgccaaatcctgcggggacttcatttcctacactcccgggttcctcccatcctgcaccgggatctcaagtgcgacaatgtctttatcacgggacctactggctctgtcaaaatcggggacctgggcctggccacgctcaagcgcgcctcctttgccaagagtgtcatcgggaccccggaattcatggcccccgagatgtacgaggaaaagtacgatgaggccgtggacgtgtacgcgttcggcatgtgcatgctggagatggccacctctgagtacccgtactccgagtgccagaatgccgcgcaaatctaccgcaaggtcacttcgggcagaaagccgaacagcttccacaaggtgaagatacccgaggtgaaggagatcattgaaggctgcatccgcacggataagaacgagaggttcaccatccaggacctcctggcccacgccttcttccgcgaggagcgcggtgtgcacgtggaactagcggaggaggacgacggcgagaagccgggcctcaagctctggctgcgcatggaggacgcgcggcgcggggggcgcccacgggacaaccaggccatcgagttcctgttccagctgggccgggacgcggccgaggaggtggcacaggagatggtggctctgggcttggtctgtgaagccgattaccagccagtggcccgtgcagtacgtgaacgggttgctgccatccagcgaaagcgtgagaagctgcgtaaagcaagggaattggaggcactcccaccagagccaggacctccaccagcaactgtgcccatggcccccggtccccccagtgtcttcccccctgagcctgaggagccagaggcagaccagcaccagcccttccttttccgccacgccagctactcatctaccacttcggattgcgagactgatggctacctcagctcctccggcttcctggatgcctcagaccctgcccttcagccccctgggggggtgccatccagcctggctgagtcccatctctgcctgccctcggcttttgccctatccattccacgttctggccctggaagtgacttttcccccggggacagctatgcctcagatgcagcttcaggccttagcgatgtgggagaagggatgggacaaatgaggagacccccagggaggaatctccggcgcagaccccgatcccggctgcgggtcactagtgtctcagaccagaatgacagagtggttgagtgccagctacagacccataacagcaagatggtgaccttccgatttgatctggatggggacagcccggaagagattgcagctgccatggtatataacgagttcattctgccttcggagcgagatggatttctcagacggattcgggagattatccagcgagtggagaccctgttgaagagagacactggccccatggaggctgctgaagacaccctaagcccccaggaggagccagcaccattacctgccctgcccgtccccctcccagacccatccaatgaagagctccagagcagcacctccctggagcacaggagctggacagccttctccacctcctcatcttctcctggaactcctttgtctcctggaaacccattttcccctggaacccccatttccccaggtcccatcttccccatcacttctcccccatgtcatcccagcccctccccattctcccccatttcttcccaggtctcctcaaatccctctccacaccccaccagctctccacttccattctcctccagcacacccgagtttccggtcccactctctcagtgtccctggagttctctccccacgacttctccacctacgttctctcccacttgttctcaggtcactcttagttcccctttctttcctccgtgcccctccacttcttccttcccctccaccacagcagcccctctcctttctctggctagtgccttctcactggctgtgatgactgtggcccagtccctgctgtccccctcacctgggctcctttcccagtctcctccagcccctcctagtcccctccctagcctgccccttccccctcccgttgctcctggtggccaggaaagcccttcaccccacacagctgaggtggagagtgaggcctcaccacctcctgctcggcccctcccaggggaagccaggctggcgcccatctctgaagagggaaagccgcagcttgttgggcgtttccaagtgacttcatccaaggaaccggctgagcctcttcccttgcagccaacatcccccactctctctggttctccaaaaccttcaacccctcagctcacttcagagagctcagatacagaggacagtgctggaggcgggccagagaccagggaagctctggctgagagcgaccgtgcagctgagggtctgggggctggagttgaggaggaaggagatgatgggaaggaaccccaagttgggggcagcccccaacccctgagccatcccagcccagtgtggatgaactactcctacagcagcctgtgtttgagcagcgaggagtcagaaagcagtggggaagatgaggagttctgggctgagctgcagagtcttcggcagaagcacttgtcagaggtggaaacactacagacactacagaaaaaagaaattgaagatttgtacagccggctggggaagcagcccccaccgggtattgtggccccagctgctatgctgtccagccgccagcgccgcctctccaagggcagcttccccacctcccgccgcaacagcctacagcgctctgagcccccaggccctggcatcatgcgaaggaactctctgagtggcagcagcaccggctcccaggagcagcgggcaagcaagggggtgacattcgccggggatgttggcaggatgtgaattcagaacagaagccatgtatctcccccacaccagggcccaccatggagcttgtgttctcagaatctgatgctttctgatcaacaaaactgagcaaggaagatcccaacactgaaggggtagaaggccaggggggcatggagagtgcagctccattatagtgaagagccaaacatatgtgaactgtttgctgtgtggaggtgttagttctgctgcctaccatcttcatctctagcacctcccctgccaagagtcaaccactaagcaatcccacccaagcctggatgcttctagaggggcccactcccagctgggagagtgtaggggatatgctcacaccacattagcagcaaccaataaaaatgctggaaacaagaaaac

SEQ ID NO: 37478 - DNA, 4038 bp, Homo sapiens
ttcggcgccctgctctttcctcatgttggcaatccccggccacggagaccaccgtcctcatgtcccagactgaggccgacctggccctgcggcccccgcctcctcttggcaccgcggggcagccccgcctcgggccccctcctcgccgagcgcgccgcttctccgggaaggctgagccccggccgcgctcttctcgtctcagccgccgtagctcagtcgacttggggctgctgagctcttggtccctgccagcctcacccgctccggacccccccgatcctccggactccgctggtcctggccccgcgaggagcccaccgcctagctccaaagaaccccccgagggcacgtggaccgagggagcccctgtgaaggctgcggaagactccgcgcgtcccgagctcccggactctgcagtgggcccggggtccagggagccgctaagggtccctgaagctgtggccctagagcggcggcgggagcaggaagaaaaggaggacatggagacccaggctgtggcaacgtcccccgatggccgatacctcaagtttgacatcgagattggacgtggctccttcaagacggtgtatcgagggctagacaccgacaccacagtggaggtggcctggtgtgagctgcagactcggaaactgtctagagctgagcggcagcgcttctcagaggaggtggagatgctcaaggggctgcagcaccccaacatcgtccgcttctatgattcgtggaagtcggtgctgaggggccaggtttgcatcgtgctggtcaccgaactcatgacctcgggcacgctcaagacgtacctgaggcggttccgggagatgaagccgcgggtccttcagcgctggagccgccaaatcctgcggggacttcatttcctacactcccgggttcctcccatcctgcaccgggatctcaagtgcgacaatgtctttatcacgggacctactggctctgtcaaaatcggggacctgggcctggccacgctcaagcgcgcctcctttgccaagagtgtcatcgggaccccggaattcatggcccccgagatgtacgaggaaaagtacgatgaggccgtggacgtgtacgcgttcggcatgtgcatgctggagatggccacctctgagtacccgtactccgagtgccagaatgccgcgcaaatctaccgcaaggtcacttcgggcagaaagccgaacagcttccacaaggtgaagatacccgaggtgaaggagatcattgaaggctgcatccgcacggataagaacgagaggttcaccatccaggacctcctggcccacgccttcttccgcgaggagcgcggtgtgcacgtggaactagcggaggaggacgacggcgagaagccgggcctcaagctctggctgcgcatggaggacgcgcggcgcggggggcgcccacgggacaaccaggccatcgagttcctgttccagctgggccgggacgcggccgaggaggtggcacaggagatggtggctctgggcttggtctgtgaagccgattaccagccagtggcccgtgcagtacgtgaacgggttgctgccatccagcgaaagcgtgagaagctgcgtaaagcaagggaattggaggcactcccaccagagccaggacctccaccagcaactgtgcccatggcccccggtccccccagtgtcttcccccctgagcctgaggagccagaggcagaccagcaccagcccttccttttccgccacgccagctactcatctaccacttcggattgcgagactgatggctacctcagctcctccggcttcctggatgcctcagaccctgcccttcagccccctgggggggtgccatccagcctggctgagtcccatctctgcctgccctcggcttttgccctatccattccacgttctggccctggaagtgacttttcccccggggacagctatgcctcagatgcagcttcaggccttagcgatgtgggagaagggatgggacaaatgaggagacccccagggaggaatctccggcgcagaccccgatcccggctgcgggtcactagtgtctcagaccagaatgacagagtggttgagtgccagctacagacccataacagcaagatggtgaccttccgatttgatctggatggggacagcccggaagagattgcagctgccatggtatataacgagttcattctgccttcggagcgagatggatttctcagacggattcgggagattatccagcgagtggagaccctgttgaagagagacactggccccatggaggctgctgaagacaccctaagcccccaggaggagccagcaccattacctgccctgcccgtccccctcccagacccatccaatgaagagctccagagcagcacctccctggagcacaggagctggacagccttctccacctcctcatcttctcctggaactcctttgtctcctggaaacccattttcccctggaacccccatttccccaggtcccatcttccccatcacttctcccccatgtcatcccagcccctccccattctcccccatttcttcccaggtctcctcaaatccctctccacaccccaccagctctccacttccattctcctccagcacacccgagtttccggtcccactctctcagtgtccctggagttctctccccacgacttctccacctacgttctctcccacttgttctcaggtcactcttagttcccctttctttcctccgtgcccctccacttcttccttcccctccaccacagcagcccctctcctttctctggctagtgccttctcactggctgtgatgactgtggcccagtccctgctgtccccctcacctgggctcctttcccagtctcctccagcccctcctagtcccctccctagcctgccccttccccctcccgttgctcctggtggccaggaaagcccttcaccccacacagctgaggtggagagtgaggcctcaccacctcctgctcggcccctcccaggggaagccaggctggcgcccatctctgaagagggaaagccgcagcttgttgggcgtttccaagtgacttcatccaaggaaccggctgagcctcttcccttgcagccaacatcccccactctctctggttctccaaaaccttcaacccctcagctcacttcagagagctcagatacagaggacagtgctggaggcgggccagagaccagggaagctctggctgagagcgaccgtgcagctgagggtctgggggctggagttgaggaggaaggagatgatgggaaggaaccccaagttgggggcagcccccaacccctgagccatcccagcccagtgtggatgaactactcctacagcagcctgtgtttgagcagcgaggagtcagaaagcagtggggaagatgaggagttctgggctgagctgcagagtcttcggcagaagcacttgtcagaggtggaaacactacagacactacagaaaaaagaaattgaagatttgtacagccggctggggaagcagcccccaccgggtattgtggccccagctgctatgctgtccagccgccagcgccgcctctccaagggcagcttccccacctcccgccgcaacagcctacagcgctctgagcccccaggccctgtgaattcagaacagaagccatgtatctcccccacaccagggcccaccatggagcttgtgttctcagaatctgatgctttctgatcaacaaaactgagcaaggaagatcccaacactgaaggggtagaaggccaggggggcatggagagtgcagctccattatagtgaagagccaaacatatgtgaactgtttgctgtgtggaggtgttagttctgctgcctaccatcttcatctctagcacctcccctgccaagagtcaaccactaagcaatcccacccaagcctggatgcttctagaggggcccactcccagctgggagagtgtaggggatatgctcacaccacattagcagcaaccaataaaaatgctggaaacaagaaaac

SEQ ID NO: 37479 - DNA, 422 bp, Homo sapiens
aacccctcagctcacttcagagagctcagatacagaggacagtgctggaggcgggccagagaccagggaagctctggctgagagcgaccgtgcagctgagggtctgggggctggagttgaggaggaaggagatgatgggaaggaaccccaagttgggggcagcccccaacccctgagccatcccagcccagtgtggatgaactactcctacagcagcctgtgtttgagcagcgaggagtcagaaagcagtggggaagatgaggagttctgggctgagctgcagagtcttcggcagaagtgagtctcgggaggatggaggagtgagaggagaacctgggagagcaaggtgtgtggctagccctttcatgccctccgtgcatcctcaggcacttgtcagaggtggaaacactacagacactaca

SEQ ID NO: 37480 - DNA, 931 bp, Homo sapiens
gggcctggtgggaggcccacaaggctcctctcaccttcctcctcctccccgcccttcaccgcagagaaccggaagaaaaccatggataagatcatcaggggcaagctggcactgcccccctacctcaccccagatgcccgggaccttgtcaaaaagtttctgaaacggaatcccagccagcggattgggggtggcccaggggatgctgctgatgtgcagagacatccctttttccggcacatgaattgggacgaccttctggcctggcgtgtggacccccctttcaggccctgtctgcagtcagaggaggacgtgagccagtttgatacccgcttcacacggcagacgccggtggacagtcctgatgacacagccctcagcgagagtgccaaccaggccttcctgggcttcacatacgtggcgccgtctgtcctggacagcatcaaggagggcttctccttccagcccaagctgcgctcacccaggcgcctcaacagtagcccccgggtccccgtcagccccctcaagttctccccttttgaggggtttcggcccagccccagcctgccggagcccacggagctacctctacctccactcctgccaccgccgccgccctcgaccaccgcccctctccccatccgtcccccctcagggaccaagaagtccaagaggggccgtgggcgtccagggcgctaggaagccgggtgggggtgagggtagcccttgagccctgtccctgcggctgtgagagcagcaggaccctgggccagttccagagacctgggggtgtgtctgggggtggggtgtgagtgcgtatgaaagtgtgtgtctgctggggcagctgtgcccctgaatcatgggcacggagggccgcccgccacgccccgcgctcaactgctcccgtggaagattaaagggctgaatcatg

SEQ ID NO: 37481 - DNA, 1767 bp, Homo sapiens
gctagtcgggctgggtgttaatcggccgagtgtcagtcagtgcgcggccaggtacgggccgacgggcccgcggggccggcgccgccatggcggccgtgtttgatttggatttggagacggaggaaggcagcgagggcgagggcgagccagagctcagccccgcggacgcatgtccccttgccgagttgagggcagctggcctagagcctgtgggacactatgaagaggtggagctgactgagaccagcgtgaacgttggcccagagcgcatcgggccccactgctttgagctgctgcgtgtgctgggcaaggggggctatggcaaggtgttccaggtgcgaaaggtgcaaggcaccaacttgggcaaaatatatgccatgaaagtcctaaggaaggccaaaattgtgcgcaatgccaaggacacagcacacacacgggctgagcggaacattctagagtcagtgaagcacccctttattgtggaactggcctatgccttccagactggtggcaaactctacctcatccttgagtgcctcagtggtggcgagctcttcacgcatctggagcgagagggcatcttcctggaagatacggcctgcttctacctggctgagatcacgctggccctgggccatctccactcccagggcatcatctaccgggacctcaagcccgagaacatcatgctcagcagccagggccacatcaaactgaccgactttggactctgcaaggagtctatccatgagggcgccgtcactcacaccttctgcggcaccattgagtacatggcccctgagattctggtgcgcagtggccacaaccgggctgtggactggtggagcctgggggccctgatgtacgacatgctcactggatcgccgcccttcaccgcagagaaccggaagaaaaccatggataagatcatcaggggcaagctggcactgcccccctacctcaccccagatgcccgggaccttgtcaaaaagtttctgaaacggaatcccagccagcggattgggggtggcccaggggatgctgctgatgtgcagagacatccctttttccggcacatgaattgggacgaccttctggcctggcgtgtggacccccctttcaggccctgtctgcagtcagaggaggacgtgagccagtttgatacccgcttcacacggcagacgccggtggacagtcctgatgacacagccctcagcgagagtgccaaccaggccttcctgggcttcacatacgtggcgccgtctgtcctggacagcatcaaggagggcttctccttccagcccaagctgcgctcacccaggcgcctcaacagtagcccccgggtccccgtcagccccctcaagttctccccttttgaggggtttcggcccagccccagcctgccggagcccacggagctacctctacctccactcctgccaccgccgccgccctcgaccaccgcccctctccccatccgtcccccctcagggaccaagaagtccaagaggggccgtgggcgtccagggcgctaggaagccgggtgggggtgagggtagcccttgagccctgtccctgcggctgtgagagcagcaggaccctgggccagttccagagacctgggggtgtgtctgggggtggggtgtgagtgcgtatgaaagtgtgtgtctgctggggcagctgtgcccctgaatcatgggcacggagggccgcccgccacgccccgcgctcaactgctcccgtggaagattaaagggctgaatcatg

SEQ ID NO: 37482 - DNA, 1701 bp, Homo sapiens
ggagagatgatgtttaggtccgggactgtcagtcagtgcgcggccaggtacgggccgacgggcccgcggggccggcgccgccatggcggccgtgtttgatttggatttggagacggaggaaggcagcgagggcgagggcgagccagagctcagccccgcggacgcatgtccccttgccgagttgagggcagctggcctagagcctgtgggacactatgaagaggtggagctgactgagaccagcgtgaacgttggcccagagcgcatcgggccccactgctttgagctgctgcgtgtgctgggcaaggggggctatggcaaggtgttccaggtgcgaaaggtgcaaggcaccaacttgggcaaaatatatgccatgaaagtcctaaggaaggccaaaattgtgcgcaatgccaaggacacagcacacacacgggctgagcggaacattctagagtcagtgaagcacccctttattgtggaactggcctatgccttccagactggtggcaaactctacctcatccttgagtgcctcagtggtggcgagctcttcacgcatctggagcgagagggcatcttcctggaagatacggcctgcttctacctggctgagatcacgctggccctgggccatctccactcccagggcatcatctaccgggacctcaagcccgagaacatcatgctcagcagccagggccacatcaaactgaccgactttggactctgcaaggagtctatccatgagggcgccgtcactcacaccttctgcggcaccattgagtacatggcccctgagattctggtgcgcagtggccacaaccgggctgtggactggtggagcctgggggccctgatgtacgacatgctcactggatcgccgcccttcaccgcagagaaccggaagaaaaccatggataagatcatcaggggcaagctggcactgcccccctacctcaccccagatgcccgggaccttgtcaaaaagtttctgaaacggaatcccagccagcggattgggggtggcccaggggatgctgctgatgtgcagagacatccctttttccggcacatgaattgggacgaccttctggcctggcgtgtggacccccctttcaggccctgtctgcagtcagaggaggacgtgagccagtttgatacccgcttcacacggcagacgccggtggacagtcctgatgacacagccctcagcgagagtgccaaccaggccttcctggtgagtgcgggggcctgaggcctgtgggaccagggcacggatcgtgactaaggatggcaggcactgagtgtcgcatggccctgcctccgccccccagggcttcacatacgtggcgccgtctgtcctggacagcatcaaggagggcttctccttccagcccaagctgcgctcacccaggcgcctcaacagtagcccccgggtccccgtcaggtactgagggacgtgggggtgtgtggctgggttagggacgctggcaggcaggatgccagctccagccttgggtgccttggccacgtctgtcggccagtgttggcttcggttgctgtgtctgggggtggggtgtgagtgcgtatgaaagtgtgtgtctgctggggcagctgtgcccctgaatcatgggcacggagggccgcccgccacgccccgcgctcaactgctcccgtggaagattaaagggctgaatcatg

SEQ ID NO: 37483 - DNA, 1726 bp, Homo sapiens
gctagtcgggctgggtgttaatcggccgagtgtcagtcagtgcgcggccaggtacgggccgacgggcccgcggggccggcgccgccatggcggccgtgtttgatttggatttggagacggaggaaggcagcgagggcgagggcgagccagagctcagccccgcggcctgtgggacactatgaagaggtggagctgactgagaccagcgtgaacgttggcccagagcgcatcgggccccactgctttgagctgctgcgtgtgctgggcaaggggggctatggcaaggtgttccaggtgcgaaaggtgcaaggcaccaacttgggcaaaatatatgccatgaaagtcctaaggaaggccaaaattgtgcgcaatgccaaggacacagcacacacacgggctgagcggaacattctagagtcagtgaagcacccctttattgtggaactggcctatgccttccagactggtggcaaactctacctcatccttgagtgcctcagtggtggcgagctcttcacgcatctggagcgagagggcatcttcctggaagatacggcctgcttctacctggctgagatcacgctggccctgggccatctccactcccagggcatcatctaccgggacctcaagcccgagaacatcatgctcagcagccagggccacatcaaactgaccgactttggactctgcaaggagtctatccatgagggcgccgtcactcacaccttctgcggcaccattgagtacatggcccctgagattctggtgcgcagtggccacaaccgggctgtggactggtggagcctgggggccctgatgtacgacatgctcactggatcgccgcccttcaccgcagagaaccggaagaaaaccatggataagatcatcaggggcaagctggcactgcccccctacctcaccccagatgcccgggaccttgtcaaaaagtttctgaaacggaatcccagccagcggattgggggtggcccaggggatgctgctgatgtgcagagacatccctttttccggcacatgaattgggacgaccttctggcctggcgtgtggacccccctttcaggccctgtctgcagtcagaggaggacgtgagccagtttgatacccgcttcacacggcagacgccggtggacagtcctgatgacacagccctcagcgagagtgccaaccaggccttcctgggcttcacatacgtggcgccgtctgtcctggacagcatcaaggagggcttctccttccagcccaagctgcgctcacccaggcgcctcaacagtagcccccgggtccccgtcagccccctcaagttctccccttttgaggggtttcggcccagccccagcctgccggagcccacggagctacctctacctccactcctgccaccgccgccgccctcgaccaccgcccctctccccatccgtcccccctcagggaccaagaagtccaagaggggccgtgggcgtccagggcgctaggaagccgggtgggggtgagggtagcccttgagccctgtccctgcggctgtgagagcagcaggaccctgggccagttccagagacctgggggtgtgtctgggggtggggtgtgagtgcgtatgaaagtgtgtgtctgctggggcagctgtgcccctgaatcatgggcacggagggccgcccgccacgccccgcgctcaactgctcccgtggaagattaaagggctgaatcatg

SEQ ID NO: 37484 - DNA, 1743 bp, Homo sapiens
gtgtctcctctgccgactgctgaggtcatagagcctggggctgctcccagcccttctattcagagtcctgcggctggctgcccacatcaagccttgcccctaggccggctgtcccctgcaggctgtgagcagtcttgacctgcctttccctcgtttgggccagatgaaccctgcgagcttctgcctccatgctctgcattcgctccgtccatctcagcatccccttaaagtcccagcaaaccgcgctttctctgttctgttctgttgggattcactctgtcttccctgtcttctctgcgagatcttttgggctaagctcttggagctgtggcctgggcctggcgtattagagccgttgtgtacatgtctgtctccccagtagactgagcgtcctgagggcagtggctgggtctcttcatcctgtccccagcttcacccagcacagggccaggcaccgagtaggcgtcggtagatgtttgctgaattgaattgaatccccacggcagctctgtgaggcaggtggcgagctcttcacgcatctggagcgagagggcatcttcctggaagatacggcctgcttctacctggctgagatcacgctggccctgggccatctccactcccagggcatcatctaccgggacctcaagcccgagaacatcatgctcagcagccagggccacatcaaactgaccgactttggactctgcaaggagtctatccatgagggcgccgtcactcacaccttctgcggcaccattgagtacatggcccctgagattctggtgcgcagtggccacaaccgggctgtggactggtggagcctgggggccctgatgtacgacatgctcactggatcgccgcccttcaccgcagagaaccggaagaaaaccatggataagatcatcaggggcaagctggcactgcccccctacctcaccccagatgcccgggaccttgtcaaaaagtttctgaaacggaatcccagccagcggattgggggtggcccaggggatgctgctgatgtgcagagacatccctttttccggcacatgaattgggacgaccttctggcctggcgtgtggacccccctttcaggccctgtctgcagtcagaggaggacgtgagccagtttgatacccgcttcacacggcagacgccggtggacagtcctgatgacacagccctcagcgagagtgccaaccaggccttcctgggcttcacatacgtggcgccgtctgtcctggacagcatcaaggagggcttctccttccagcccaagctgcgctcacccaggcgcctcaacagtagcccccgggtccccgtcagccccctcaagttctccccttttgaggggtttcggcccagccccagcctgccggagcccacggagctacctctacctccactcctgccaccgccgccgccctcgaccaccgcccctctccccatccgtcccccctcagggaccaagaagtccaagaggggccgtgggcgtccagggcgctaggaagccgggtgggggtgagggtagcccttgagccctgtccctgcggctgtgagagcagcaggaccctgggccagttccagagacctgggggtgtgtctgggggtggggtgtgagtgcgtatgaaagtgtgtgtctgctggggcagctgtgcccctgaatcatgggcacggagggccgcccgccacgccccgcgctcaactgctcccgtggaagattaaagggctgaatcatg

SEQ ID NO: 37485 - DNA, 1383 bp, Homo sapiens
ggctgtgtcatcaggactgaccaccggcgtctgccgtttgaagcgggaatcaaactggctcacgtcctcctctgactgcacacagggccaggcaccgagtaggcgtcggtagatgtttgctgaattgaattgaatccccacggcagctctgtgaggcaggtggcgagctcttcacgcatctggagcgagagggcatcttcctggaagatacggcctgcttctacctggctgagatcacgctggccctgggccatctccactcccagggcatcatctaccgggacctcaagcccgagaacatcatgctcagcagccagggccacatcaaactgaccgactttggactctgcaaggagtctatccatgagggcgccgtcactcacaccttctgcggcaccattgagtacatggcccctgagattctggtgcgcagtggccacaaccgggctgtggactggtggagcctgggggccctgatgtacgacatgctcactggatcgccgcccttcaccgcagagaaccggaagaaaaccatggataagatcatcaggggcaagctggcactgcccccctacctcaccccagatgcccgggaccttgtcaaaaagtttctgaaacggaatcccagccagcggattgggggtggcccaggggatgctgctgatgtgcagagacatccctttttccggcacatgaattgggacgaccttctggcctggcgtgtggacccccctttcaggccctgtctgcagtcagaggaggacgtgagccagtttgatacccgcttcacacggcagacgccggtggacagtcctgatgacacagccctcagcgagagtgccaaccaggccttcctgggcttcacatacgtggcgccgtctgtcctggacagcatcaaggagggcttctccttccagcccaagctgcgctcacccaggcgcctcaacagtagcccccgggtccccgtcagccccctcaagttctccccttttgaggggtttcggcccagccccagcctgccggagcccacggagctacctctacctccactcctgccaccgccgccgccctcgaccaccgcccctctccccatccgtcccccctcagggaccaagaagtccaagaggggccgtgggcgtccagggcgctaggaagccgggtgggggtgagggtagcccttgagccctgtccctgcggctgtgagagcagcaggaccctgggccagttccagagacctgggggtgtgtctgggggtggggtgtgagtgcgtatgaaagtgtgtgtctgctggggcagctgtgcccctgaatcatgggcacggagggccgcccgccacgccccgcgctcaactgctcccgtggaagattaaagggctgaatcatg

SEQ ID NO: 37486 - DNA, 1077 bp, Homo sapiens
  misc_feature (2)..(2): n is a, c, g, or t
angtgatcctcgaaatctcatttgctcatgagaggtttttttctttcagcccattctttcaaccaagaaagtgtacttggggcactgttcatgtaaggtgctttcggatcccagatacttgcagtataaggaccaactttcacgggtggtccctgaaaactgaagccccttgtttctgagattagaaaccgtccccgcccttcaccgcagagaaccggaagaaaaccatggataagatcatcaggggcaagctggcactgcccccctacctcaccccagatgcccgggaccttgtcaaaaagtttctgaaacggaatcccagccagcggattgggggtggcccaggggatgctgctgatgtgcagagacatccctttttccggcacatgaattgggacgaccttctggcctggcgtgtggacccccctttcaggccctgtctgcagtcagaggaggacgtgagccagtttgatacccgcttcacacggcagacgccggtggacagtcctgatgacacagccctcagcgagagtgccaaccaggccttcctgggcttcacatacgtggcgccgtctgtcctggacagcatcaaggagggcttctccttccagcccaagctgcgctcacccaggcgcctcaacagtagcccccgggtccccgtcagccccctcaagttctccccttttgaggggtttcggcccagccccagcctgccggagcccacggagctacctctacctccactcctgccaccgccgccgccctcgaccaccgcccctctccccatccgtcccccctcagggaccaagaagtccaagaggggccgtgggcgtccagggcgctaggaagccgggtgggggtgagggtagcccttgagccctgtccctgcggctgtgagagcagcaggaccctgggccagttccagagacctgggggtgtgtctgggggtggggtgtgagtgcgtatgaaagtgtgtgtctgctggggcagctgtgcccctgaatcatgggcacggagggccgcccgccacgccccgcgctcaactgctcccgtggaagattaaagggctgaatcatg

SEQ ID NO: 37487 - DNA, 1926 bp, Homo sapiens
gctagtcgggctgggtgttaatcggccgagtgtcagtcagtgcgcggccaggtacgggccgacgggcccgcggggccggcgccgccatggcggccgtgtttgatttggatttggagacggaggaaggcagcgagggcgagggcgagccagagctcagccccgcggacgcatgtccccttgccgagttgagggcagctggcctagagcctgtgggacactatgaagaggtggagctgactgagaccagcgtgaacgttggcccagagcgcatcgggccccactgctttgagctgctgcgtgtgctgggcaaggggggctatggcaaggtgttccaggtgcgaaaggtgcaaggcaccaacttgggcaaaatatatgccatgaaagtcctaaggaaggccaaaattgtgcgcaatgccaaggacacagcacacacacgggctgagcggaacattctagagtcagtgaagcacccctttattgtggaactggcctatgccttccagactggtggcaaactctacctcatccttgagtgcctcagtgactgagcgtcctgagggcagtggctgggtctcttcatcctgtccccagcttcacccagcacagggccaggcaccgagtaggcgtcggtagatgtttgctgaattgaattgaatccccacggcagctctgtgaggcaggtagggcgggaattatgagcccctctttccccaagaagaaataaagactcagaaagcacaaaggggcttggacccagcacgtggctgctgacgtgtttgtgtggcaggtggcgagctcttcacgcatctggagcgagagggcatcttcctggaagatacggcctgcttctacctggctgagatcacgctggccctgggccatctccactcccagggcatcatctaccgggacctcaagcccgagaacatcatgctcagcagccagggccacatcaaactgaccgactttggactctgcaaggagtctatccatgagggcgccgtcactcacaccttctgcggcaccattgagtacatggcccctgagattctggtgcgcagtggccacaaccgggctgtggactggtggagcctgggggccctgatccgcccttcaccgcagagaaccggaagaaaaccatggataagatcatcaggggcaagctggcactgcccccctacctcaccccagatgcccgggaccttgtcaaaaagagacatccctttttccggcacatgaattgggacgaccttctggcctggcgtgtggacccccctttcaggccctgtctgcagtcagaggaggacgtgagccagtttgatacccgcttcacacggcagacgccggtggacagtcctgatgacacagccctcagcgagagtgccaaccaggccttcctgggcttcacatacgtggcgccgtctgtcctggacagcatcaaggagggcttctccttccagcccaagctgcgctcacccaggcgcctcaacagtagcccccgggtccccgtcagccccctcaagttctccccttttgaggggtttcggcccagccccagcctgccggagcccacggagctacctctacctccactcctgccaccgccgccgccctcgaccaccgcccctctccccatccgtcccccctcagggaccaagaagtccaagaggggccgtgggcgtccagggcgctaggaagccgggtgggggtgagggtagcccttgagccctgtccctgcggctgtgagagcagcaggaccctgggccagttccagagacctgggggtgtgtctgggggtggggtgtgagtgcgtatgaaagtgtgtgtctgctggggcagctgtgcccctgaatcatgggcacggagggccgcccgccacgccccgcgctcaactgctcccgtggaagattaaagggctgaatcatg

SEQ ID NO: 37488 - DNA, 919 bp, Homo sapiens
gctagtcgggctgggtgttaatcggccgagtgtcagtcagtgcgcggccaggtacgggccgacgggcccgcggggccggcgccgccatggcggccgtgtttgatttggatttggagacggaggaaggcagcgagggcgagggcgagccagagctcagccccgcggcctgtgggacactatgaagaggtggagctgactgagaccagcgtgaacgttggcccagagcgcatcgggccccactgctttgagctgctgcgtgtgctgggcaaggggggctatggcaaggtgttccaggtgcgaaaggtgcaaggcaccaacttgggcaaaatatatgccatgaaagtcctaaggaaggccaaaattgtgcgcaatgccaaggacacagcacacacacgggctgagcggaacattctagagtcagtgaagcacccctttattgtggaactggcctatgccttccagactggtggcaaactctacctcatccttgagtgcctcagtgactgagcgtcctgagggcagtggctgggtctcttcatcctgtccccagcttcacccagcacagggccaggcaccgagtaggcgtcggtagatgtttgctgaattgaattgaatccccacggcagctctgtgaggcaggtggcgagctcttcacgcatctggagcgagagggcatcttcctggaagatacggcctgcttctacctggctgagatcacgctggccctgggccatctccactcccagggcatcatctaccgggacctcaagcccgagaacatcatgctcagcagccagggccacatcaaactgaccgactttggactctgcaaggagtctatccatgagggcgccgtcactcacaccttctgcggcaccattgagtacatgtaagtggcacctggctggcccaggggtcg

SEQ ID NO: 37489 - DNA, 182 bp, Homo sapiens
gccaggtacgggccgacgggcccgcggggccggcgccgccatggcggccgtgtttgatttggatttggagacggaggaaggcagcgagggcgagggcgagccagagctcagccccgcggtgagtgccctgccctggcgcgactggatcctggagccgatcctgtcacccagccgaggccgga

SEQ ID NO: 37490 - DNA, 515 bp, Homo sapiens
tggcgtattagagccgttgtgtacatgtctgtctccccagtagactgagcgtcctgagggcagtggctgggtctcttcatcctgtccccagcttcacccagcacagggccaggcaccgagtaggcgtcggtagatgtttgctgaattgaattgaatccccacggcagctctgtgaggcaggtagggcgggaattatgagcccctctttccccaagaagaaataaagactcagaaagcacaaaggggcttggacccagcacgtggctgctgacgtgtttgtgtggcaggtggcgagctcttcacgcatctggagcgagagggcatcttcctggaagatacggcctggtgggtgttaatcctccgctttcctgaggctgccaggtccctgctctactcccgccttcaccctgtcttgtttctgcagcttctacctggctgagatcacgctggccctgggccatctccactcccagggcatcatctaccgggacctcaagcccgagaacatcatgctc

SEQ ID NO: 37491 - DNA, 1763 bp, Homo sapiens
ggagagatgatgtttaggtccgggactgtcagtcagtgcgcggccaggtacgggccgacgggcccgcggggccggcgccgccatggcggccgtgtttgatttggatttggagacggaggaaggcagcgagggcgagggcgagccagagctcagccccgcggacgcatgtccccttgccgagttgagggcagctggcctagagcctgtgggacactatgaagaggtggagctgactgagaccagcgtgaacgttggcccagagcgcatcgggccccactgctttgagctgctgcgtgtgctgggcaaggggggctatggcaaggtgttccaggtgcgaaaggtgcaaggcaccaacttgggcaaaatatatgccatgaaagtcctaaggaaggccaaaattgtgcgcaatgccaaggacacagcacacacacgggctgagcggaacattctagagtcagtgaagcacccctttattgtggaactggcctatgccttccagactggtggcaaactctacctcatccttgagtgcctcagtggtggcgagctcttcacgcatctggagcgagagggcatcttcctggaagatacggcctgcttctacctggctgagatcacgctggccctgggccatctccactcccagggcatcatctaccgggacctcaagcccgagaacatcatgctcagcagccagggccacatcaaactgaccgactttggactctgcaaggagtctatccatgagggcgccgtcactcacaccttctgcggcaccattgagtacatggcccctgagattctggtgcgcagtggccacaaccgggctgtggactggtggagcctgggggccctgatgtacgacatgctcactggatcgccgcccttcaccgcagagaaccggaagaaaaccatggataagatcatcaggggcaagctggcactgcccccctacctcaccccagatgcccgggaccttgtcaaaaagtttctgaaacggaatcccagccagcggattgggggtggcccaggggatgctgctgatgtgcagagacatccctttttccggcacatgaattgggacgaccttctggcctggcgtgtggacccccctttcaggccctgtctgcagtcagaggaggacgtgagccagtttgatacccgcttcacacggcagacgccggtggacagtcctgatgacacagccctcagcgagagtgccaaccaggccttcctgggcttcacatacgtggcgccgtctgtcctggacagcatcaaggagggcttctccttccagcccaagctgcgctcacccaggcgcctcaacagtagcccccgggtccccgtcagccccctcaagttctccccttttgaggggtttcggcccagccccagcctgccggagcccacggagctacctctacctccactcctgccaccgccgccgccctcgaccaccgcccctctccccatccgtcccccctcagggaccaagaagtccaagaggggccgtgggcgtccagggcgctaggaagccgggtgggggtgagggtagcccttgagccctgtccctgcggctgtgagagcagcaggaccctgggccagttccagagacctgggggtgtgtctgggggtggggtgtgagtgcgtatgaaagtgtgtgtctgctggggcagctgtgcccctgaatcatgggcacggagggccgcccgccacgccccgcgctcaactgctcccgtggaagattaaagggctgaatcatg

SEQ ID NO: 37492 - DNA, 2033 bp, Homo sapiens
ggagagatgatgtttaggtccgggactgtcagtcagtgcgcggccaggtacgggccgacgggcccgcggggccggcgccgccatggcggccgtgtttgatttggatttggagacggaggaaggcagcgagggcgagggcgagccagagctcagccccgcggacgcatgtccccttgccgagttgagggcagctggcctagagcctgtgggacactatgaagaggtggagctgactgagaccagcgtgaacgttggcccagagcgcatcgggccccactgctttgagctgctgcgtgtgctgggcaaggggggctatggcaaggtgttccaggtgcgaaaggtgcaaggcaccaacttgggcaaaatatatgccatgaaagtcctaaggaaggccaaaattgtgcgcaatgccaaggacacagcacacacacgggctgagcggaacattctagagtcagtgaagcacccctttattgtggaactggcctatgccttccagactggtggcaaactctacctcatccttgagtgcctcagtggtggcgagctcttcacgcatctggagcgagagggcatcttcctggaagatacggcctgcttctacctggctgagatcacgctggccctgggccatctccactcccagggcatcatctaccgggacctcaagcccgagaacatcatgctcagcagccagggccacatcaaactgaccgactttggactctgcaaggagtctatccatgagggcgccgtcactcacaccttctgcggcaccattgagtacatggcccctgagattctggtgcgcagtggccacaaccgggctgtggactggtggagcctgggggccctgatgtacgacatgctcactggatcgccgcccttcaccgcagagaaccggaagaaaaccatggataagatcatcaggggcaagctggcactgcccccctacctcaccccagatgcccgggaccttgtcaaaaagtttctgaaacggaatcccagccagcggattgggggtggcccaggggatgctgctgatgtgcagagacatccctttttccggcacatgaattgggacgaccttctggcctggcgtgtggacccccctttcaggccctgtctgcagtcagaggaggacgtgagccagtttgatacccgcttcacacggcagacgccggtggacagtcctgatgacacagccctcagcgagagtgccaaccaggccttcctgggcttcacatacgtggcgccgtctgtcctggacagcatcaaggagggcttctccttccagcccaagctgcgctcacccaggcgcctcaacagtagcccccgggtccccgtcagccccctcaagttctccccttttgaggggtttcggcccagccccagcctgccggagcccacggagctacctctacctccactcctgccaccgccgccgccctcgaccaccgcccctctccccatccgtcccccctcagggaccaagaagtccaagaggggccgtgggcgtccagggcgctaggaagccgggtgggggtgagggtagcccttgagccctgtccctgcggctgtgagagcagcaggaccctgggccagttccagagacctgggggtgtgtctgggggtggggtgtgagtgcgtatgaaagtgtgtgtctgctggggcagctgtgcccctgaatcatgggcacggagggccgcccgccacgccccgcgctcaactgctcccgtggaagattaaagggctgaatcatgaaaaaaaaacaaacaaaaaactccgagggccatcaagggcccggcgtgcggcgcccacgacggtcaccgcacggcgcccatgcgcacacgcggtccgtgacccaaggttcactggttaccacagcgggcgcaacatcggcggggtcccccaaatggcgaaagccgcataaacctgcagaacagcccgcgtaaccccggcataaatgaccgcgaaacagcccccgcacagcgcccgccacgcgagcgccccacgccccccacgcccaccca

SEQ ID NO: 37493 - DNA, 1904 bp, Homo sapiens
gctagtcgggctgggtgttaatcggccgagtgtcagtcagtgcgcggccaggtacgggccgacgggcccgcggggccggcgccgccatggcggccgtgtttgatttggatttggagacggaggaaggcagcgagggcgagggcgagccagagctcagccccgcggacgcatgtccccttgccgagttgagggcagctggcctagagcctgtgggacactatgaagaggtggagctgactgagaccagcgtgaacgttggcccagagcgcatcgggccccactgctttgagctgctgcgtgtgctgggcaaggggggctatggcaaggtgttccaggtgcgaaaggtgcaaggcaccaacttgggcaaaatatatgccatgaaagtcctaaggaaggccaaaattgtgcgcaatgccaaggacacagcacacacacgggctgagcggaacattctagagtcagtgaagcacccctttattgtggaactggcctatgccttccagactggtggcaaactctacctcatccttgagtgcctcagtgactgagcgtcctgagggcagtggctgggtctcttcatcctgtccccagcttcacccagcacagggccaggcaccgagtaggcgtcggtagatgtttgctgaattgaattgaatccccacggcagctctgtgaggcaggtggcgagctcttcacgcatctggagcgagagggcatcttcctggaagatacggcctgcttctacctggctgagatcacgctggccctgggccatctccactcccagggcatcatctaccgggacctcaagcccgagaacatcatgctcagcagccagggccacatcaaactgaccgactttggactctgcaaggagtctatccatgagggcgccgtcactcacaccttctgcggcaccattgagtacatggcccctgagattctggtgcgcagtggccacaaccgggctgtggactggtggagcctgggggccctgatgtacgacatgctcactggatcgccgcccttcaccgcagagaaccggaagaaaaccatggataagatcatcaggggcaagctggcactgcccccctacctcaccccagatgcccgggaccttgtcaaaaagtttctgaaacggaatcccagccagcggattgggggtggcccaggggatgctgctgatgtgcagagacatccctttttccggcacatgaattgggacgaccttctggcctggcgtgtggacccccctttcaggccctgtctgcagtcagaggaggacgtgagccagtttgatacccgcttcacacggcagacgccggtggacagtcctgatgacacagccctcagcgagagtgccaaccaggccttcctgggcttcacatacgtggcgccgtctgtcctggacagcatcaaggagggcttctccttccagcccaagctgcgctcacccaggcgcctcaacagtagcccccgggtccccgtcagccccctcaagttctccccttttgaggggtttcggcccagccccagcctgccggagcccacggagctacctctacctccactcctgccaccgccgccgccctcgaccaccgcccctctccccatccgtcccccctcagggaccaagaagtccaagaggggccgtgggcgtccagggcgctaggaagccgggtgggggtgagggtagcccttgagccctgtccctgcggctgtgagagcagcaggaccctgggccagttccagagacctgggggtgtgtctgggggtggggtgtgagtgcgtatgaaagtgtgtgtctgctggggcagctgtgcccctgaatcatgggcacggagggccgcccgccacgccccgcgctcaactgctcccgtggaagattaaagggctgaatcatg

SEQ ID NO: 37494 - DNA, 1850 bp, Homo sapiens
gtgtctcctctgccgactgctgaggtcatagagcctggggctgctcccagcccttctattcagagtcctgcggctggctgcccacatcaagccttgcccctaggccggctgtcccctgcaggctgtgagcagtcttgacctgcctttccctcgtttgggccagatgaaccctgcgagcttctgcctccatgctctgcattcgctccgtccatctcagcatccccttaaagtcccagcaaaccgcgctttctctgttctgttctgttgggattcactctgtcttccctgtcttctctgcgagatcttttgggctaagctcttggagctgtggcctgggcctggcgtattagagccgttgtgtacatgtctgtctccccagtagactgagcgtcctgagggcagtggctgggtctcttcatcctgtccccagcttcacccagcacagggccaggcaccgagtaggcgtcggtagatgtttgctgaattgaattgaatccccacggcagctctgtgaggcaggtagggcgggaattatgagcccctctttccccaagaagaaataaagactcagaaagcacaaaggggcttggacccagcacgtggctgctgacgtgtttgtgtggcaggtggcgagctcttcacgcatctggagcgagagggcatcttcctggaagatacggcctgcttctacctggctgagatcacgctggccctgggccatctccactcccagggcatcatctaccgggacctcaagcccgagaacatcatgctcagcagccagggccacatcaaactgaccgactttggactctgcaaggagtctatccatgagggcgccgtcactcacaccttctgcggcaccattgagtacatggcccctgagattctggtgcgcagtggccacaaccgggctgtggactggtggagcctgggggccctgatgtacgacatgctcactggatcgccgcccttcaccgcagagaaccggaagaaaaccatggataagatcatcaggggcaagctggcactgcccccctacctcaccccagatgcccgggaccttgtcaaaaagtttctgaaacggaatcccagccagcggattgggggtggcccaggggatgctgctgatgtgcagagacatccctttttccggcacatgaattgggacgaccttctggcctggcgtgtggacccccctttcaggccctgtctgcagtcagaggaggacgtgagccagtttgatacccgcttcacacggcagacgccggtggacagtcctgatgacacagccctcagcgagagtgccaaccaggccttcctgggcttcacatacgtggcgccgtctgtcctggacagcatcaaggagggcttctccttccagcccaagctgcgctcacccaggcgcctcaacagtagcccccgggtccccgtcagccccctcaagttctccccttttgaggggtttcggcccagccccagcctgccggagcccacggagctacctctacctccactcctgccaccgccgccgccctcgaccaccgcccctctccccatccgtcccccctcagggaccaagaagtccaagaggggccgtgggcgtccagggcgctaggaagccgggtgggggtgagggtagcccttgagccctgtccctgcggctgtgagagcagcaggaccctgggccagttccagagacctgggggtgtgtctgggggtggggtgtgagtgcgtatgaaagtgtgtgtctgctggggcagctgtgcccctgaatcatgggcacggagggccgcccgccacgccccgcgctcaactgctcccgtggaagattaaagggctgaatcatg

SEQ ID NO: 37495 - DNA, 1066 bp, Homo sapiens
taggctgtggaagacgggtaggctgtggaagacgggtaggctgtggaagacggctaggctgtggaagacgggtaggctgtggaagacgggtaggctgtggaagacgggtaggctgtggaagacggtcgggctgtggactggtggagcctgggggccctgatgtacgacatgctcactggatcgccgcccttcaccgcagagaaccggaagaaaaccatggataagatcatcaggggcaagctggcactgcccccctacctcaccccagatgcccgggaccttgtcaaaaagtttctgaaacggaatcccagccagcggattgggggtggcccaggggatgctgctgatgtgcagagacatccctttttccggcacatgaattgggacgaccttctggcctggcgtgtggacccccctttcaggccctgtctgcagtcagaggaggacgtgagccagtttgatacccgcttcacacggcagacgccggtggacagtcctgatgacacagccctcagcgagagtgccaaccaggccttcctgggcttcacatacgtggcgccgtctgtcctggacagcatcaaggagggcttctccttccagcccaagctgcgctcacccaggcgcctcaacagtagcccccgggtccccgtcagccccctcaagttctccccttttgaggggtttcggcccagccccagcctgccggagcccacggagctacctctacctccactcctgccaccgccgccgccctcgaccaccgcccctctccccatccgtcccccctcagggaccaagaagtccaagaggggccgtgggcgtccagggcgctaggaagccgggtgggggtgagggtagcccttgagccctgtccctgcggctgtgagagcagcaggaccctgggccagttccagagacctgggggtgtgtctgggggtggggtgtgagtgcgtatgaaagtgtgtgtctgctggggcagctgtgcccctgaatcatgggcacggagggccgcccgccacgccccgcgctcaactgctcccgtggaagattaaagggctgaatcatg

SEQ ID NO: 37496 - DNA, 2023 bp, Homo sapiens
gctagtcgggctgggtgttaatcggccgagtgtcagtcagtgcgcggccaggtacgggccgacgggcccgcggggccggcgccgccatggcggccgtgtttgatttggatttggagacggaggaaggcagcgagggcgagggcgagccagagctcagccccgcggacgcatgtccccttgccgagttgagggcagctggcctagagcctgtgggacactatgaagaggtggagctgactgagaccagcgtgaacgttggcccagagcgcatcgggccccactgctttgagctgctgcgtgtgctgggcaaggggggctatggcaaggtgttccaggtgcgaaaggtgcaaggcaccaacttgggcaaaatatatgccatgaaagtcctaaggaaggccaaaattgtgcgcaatgccaaggacacagcacacacacgggctgagcggaacattctagagtcagtgaagcacccctttattgtggaactggcctatgccttccagactggtggcaaactctacctcatccttgagtgcctcagtgactgagcgtcctgagggcagtggctgggtctcttcatcctgtccccagcttcacccagcacagggccaggcaccgagtaggcgtcggtagatgtttgctgaattgaattgaatccccacggcagctctgtgaggcaggtagggcgggaattatgagcccctctttccccaagaagaaataaagactcagaaagcacaaaggggcttggacccagcacgtggctgctgacgtgtttgtgtggcaggtggcgagctcttcacgcatctggagcgagagggcatcttcctggaagatacggcctgcttctacctggctgagatcacgctggccctgggccatctccactcccagggcatcatctaccgggacctcaagcccgagaacatcatgctcagcagccagggccacatcaaactgaccgactttggactctgcaaggagtctatccatgagggcgccgtcactcacaccttctgcggcaccattgagtacatggcccctgagattctggtgcgcagtggccacaaccgggctgtggactggtggagcctgggggccctgatccgcccttcaccgcagagaaccggaagaaaaccatggataagatcatcaggggcaagctggcactgcccccctacctcaccccagatgcccgggaccttgtcaaaaagagacatccctttttccggcacatgaattgggacgaccttctggcctggcgtgtggacccccctttcaggccctgtctgcagtcagaggaggacgtgagccagtttgatacccgcttcacacggcagacgccggtggacagtcctgatgacacagccctcagcgagagtgccaaccaggccttcctggtgagtgcgggggcctgaggcctgtgggaccagggcacggatcgtgactaaggatggcaggcactgagtgtcgcatggccctgcctccgccccccagggcttcacatacgtggcgccgtctgtcctggacagcatcaaggagggcttctccttccagcccaagctgcgctcacccaggcgcctcaacagtagcccccgggtccccgtcagccccctcaagttctccccttttgaggggtttcggcccagccccagcctgccggagcccacggagctacctctacctccactcctgccaccgccgccgccctcgaccaccgcccctctccccatccgtcccccctcagggaccaagaagtccaagaggggccgtgggcgtccagggcgctaggaagccgggtgggggtgagggtagcccttgagccctgtccctgcggctgtgagagcagcaggaccctgggccagttccagagacctgggggtgtgtctgggggtggggtgtgagtgcgtatgaaagtgtgtgtctgctggggcagctgtgcccctgaatcatgggcacggagggccgcccgccacgccccgcgctcaactgctcccgtggaagattaaagggctgaatcatg

SEQ ID NO: 37497 - DNA, 914 bp, Homo sapiens
gctagtcgggctgggtgttaatcggccgagtgtcagtcagtgcgcggccaggtacgggccgacgggcccgcggggccggcgccgccatggcggccgtgtttgatttggatttggagacggaggaaggcagcgagggcgagggcgagccagagctcagccccgcggacgcatgtccccttgccgagttgagggcagctggcctagagcctgtgggacactatgaagaggtggagctgactgagaccagcgtgaacgttggcccagagcgcatcgggccccactgctttgagctgctgcgtgtgctgggcaaggggggctatggcaaggtgttccaggtgcgaaaggtgcaaggcaccaacttgggcaaaatatatgccatgaaagtcctaaggaaggccaaaattgtgcgcaatgccaaggacacagcacacacacgggctgagcggaacattctagagtcagtgaagcacccctttattgtggaactggcctatgccttccagactggtggcaaactctacctcatccttgagtgcctcagtggtatgagtgcgggcccaggcaggggtgctgggggtcgcgggggggcagcgagccagcaaaggaagctctggggggaagctcttgagagatgagtctgtgggggttggctagggggcccacatctgtcctacccatccatccatccatccgtgcatccgtcccatcattcattcattcagcaaacgtctgtccagcacctactgtgtccctcacgtgtgttgggggtggatgggcatggtgcgaatttggatagaagtccagaggatggttgagtctcttcctactcccctccctgtcttgttcttctctcccgtgtgccctgcatcctgtcaggtccccagcccaactggttcattctctgtagtgtcctc

SEQ ID NO: 37498 - DNA, 367 bp, Homo sapiens
gccttgggtgccttggccacgtctgtcggccagtgttggcttcggttgctgtgtctatcatggggacctcagttcctacaccccttgtggccaggctgcctggatgggagtttgtggagcccgcggcctgtgtgcctgggcaggtgggaaaggctgccttccctgactgagtgctgggagcctctggcagggcctaggaggctcttattctgccttggtttcccctgcagccccctcaagttctccccttttgaggggtttcggcccagccccagcctgccggagcccacggagctacctctacctccactcctgccaccgccgccgccctcgaccaccgcccctctccccatccgtcccccctcag

SEQ ID NO: 37499 - DNA, 247 bp, Homo sapiens
tgacttaaggtagtagaatcaggacattttagataaatcttaaagtaggtagtactccacctgagagaagaagggcttgtaaaccttgttgaaagggagagaagaaaaacaatatgagcaagtggggataatatggaatactttcgcaggaaaaatgaattgttccatttgattgatttatagggtgcatatatacaaagtaaacaggaaaagtagagctatattgcaggatgtcttcaactgtagg

SEQ ID NO: 37500 - DNA, 375 bp, Homo sapiens
gtcagatgaaagacagtcaacgagtatgtgctcaaaaataacacagggcaagtgagtttcctagtggaggtgtccgtttattaatcaaaatattgtgattttatttctgcattttgtggtatttgtcagctttttaaaagtgtgtgaggtgctcgcttcggcagcacatgtactaaaattagaacgatacagagaagattagcatggcccctgcgcaaggatgacacgcaaattcgtgaagcattccatattttttttggctgggcgcggtggctcacacctgtaatcccagcactttgggaggcccaggcgggcggatcacaaggttaggagatcgagaccgtcctggctaacacggtgaaatcctgtctctac

SEQ ID NO: 37501 - DNA, 590 bp, Homo sapiens
cacagagagcccagaaatgagccatgtgcccattgccggggaagagaaggtaggctgaggaggtggcctttcctaacacaaaaattaactaagtggggaaaaccagagaactaggtgttggcatcccaggaaaaaaataaagtctccacattttggcctatagggatcctgccccataatggctggttacctcctgcctcaagctgcagggaagccagggggtggcatggccatggcttctccctcagagaggcctctgtgcacgacttcagtcacccaacactgacagaacttggaacccaaaagcccatttctctccttccgtccagaccctgtctgctgttatctgtaggaagaccacagccaactgctatcatgaccaaagctaaaatccaatgaggcagagaacaatagttgtacccatctcctccttagtctccaaggccagcggtgcatgcatttgtgcattcaacaacatttgccaagcacttactgtatatcaagcacagcagtgggtgctgaggacggatgggtagaaaaaacagtcctggcccaggtggagtgacaggtaagaaacaagtaagtagcta

SEQ ID NO: 37502 - DNA, 467 bp, Homo sapiens
acaagcctgtaggtgcttatctgagttacactgtgtataaactgatgaatgacctacagggacaggaaacagaatgtggcagatactataatttgtctgctcaagggccattttcttctctttttatggtggcaagacttcagtggtagtcccattctcattaacagatggagttagttagaagaggacacataatttgactctggccagagtcacaagagacattttccaatctgctttggcaatgtttttatttatgttcataaaaagaatttcaaatgttctttatttctgttgtacattttctgctgcacatttgattatttgagatatgtcattcattttctggctagaaggcagctagtctgagtttaacatactaaggacaacacaggaaaatgatcaaagaggctggatgcggtggctcatgcctcttatcccagcactttgggaggctaaggcgggtg

SEQ ID NO: 37503 - DNA, 442 bp, Homo sapiens
ctgcactccagcctgggcaacagagtaagactctgtctcaaaaaaaaaaaaatgaaatgaaatgaaaaatgttatttatccactgtcacagtcattccatttgtcttccctatcccatgttttgcctcagctgactttaccaaaaattccctttcccttccctgctttaagtcatttcatgtaggttagtcttcatttattcttttgcctctctacagtagttattgctttgtgctgtacatttgggttaaaggagttgtatatgtgtatggtgacagcataatgcctctgaagcccaggacctagctacttcttagctcctaacgtaatttcatccatgtaactcacagaaatagaatctgaagattgaggaatagatgattctgttattccaaattatttcaatttattccacttaaacttgccattaactatcaaaatg

SEQ ID NO: 37504 - DNA, 334 bp, Homo sapiens
  misc_feature (237)..(237): n is a, c, g, or t
  misc_feature (297)..(297): n is a, c, g, or t
gctggtctcgaactcccaacctcaggtgatccacctgctgcggcctcccaaagtgttgggattacaggcatgagccaccgtgcccagcaggctcattttttaactttgcaatattttaacttgacagaccatcgtttgatgtccattttaccaccgtctacattagttgaggtcctcaatatatcttctttatgaacctaagtctctttgatgtcaaagtattaaatatcattggtnatgcctgccagctacttggaaggctgaggtgggaggatcacttgagcccaggatttgaangccagactgggcaatgtagcaagtccccatgtcttaa

SEQ ID NO: 37505 - DNA, 479 bp, Homo sapiens
gaattcagcaagagatgagaagtgtcttcaagttctctcattagaaaccctaaaccgtctcttccagcaataataaacttgatgacaacaagcctcaggaaggccgggagggaagggcttcgagccagcagcagcaatgaaccttaggtactcataatctgatctgcaacaatctctgccagctacaaagttacattctttctttcttcttagagtagtaatgatgacgacaataacacaacaaagcaaataatgtttattgctgcttacttcaagccaggtacagtttaccaaagcagaactgtgaatgagaggtgagaaacgcttatccttttaagaaatctgtagagtcagaagtttcagtcctcgccctgagctgtccttctcactcaagggatttaaatgcctagatgaccagcgctcagtgtcctggacttaccgaaccacgggaaaactccaattcccatcccacagaataa

SEQ ID NO: 37506 - DNA, 202 bp, Homo sapiens
aaggagaagctggaagaggcaaggaacagattctcccagagggcacgcagccctgctgaccccttgattttggcccaataataccgatttcattcttctgacctctcaagctgtgtgaaaacaactttctgttgtttgaagccaccaattttgtgacaatttattacacactagccccaggtgccaccaataaaaatcctac

SEQ ID NO: 37507 - DNA, 470 bp, Homo sapiens
gccaagtgtggacatgaataatgctagaaaagtttgcagaggccaagccatggaggatcttacatgaagagcaattgaacaccacagaaggtttcaaacttgttatggggttcagaaagatggtgaaataatctcaattatgatgtgaaaatgtcaacataagtcagctgtgtcaatccttggctcagaactctacaaagtctccttgtcccaaacaaagtaaaagctaaagtacttctagttccctacaaaacattctatgatctaggcccccatttatcagattttaattcccactaatcttttttacacaacaaacatttcatggtatcacaagagaaaaatattttaagagcaaacaacaatcatttggccaccaagatagtttgcttgaagcaattacactcatactgctctcaggcagcaagtactaaagcagtcccatatcatccctttttgagaagacaact

SEQ ID NO: 37508 - DNA, 256 bp, Homo sapiens
tcagctttcaataaaagcatatgtgtcatctcatagaatacttaatatgtcaaacccaggaaaatcagtaactaagtaacaaaaggaacacttattaagaaaatttgatgataaaaatgttaggctaaaatattaagaactttagcaactggactgaggaaccagaaagtatatgcacactgggaattttaagaaaagatccccatattctcctgcacaatgaggaccacattccaaaaacataattctgggttgt

SEQ ID NO: 37509 - DNA, 456 bp, Homo sapiens
ctcccaaaatgctgggattacaggcatgaggcaccgcatcaggccactgctaggctctttctatttggtgattaatgaaacagatcccctgccatcttagcataaagtctgatgtgttttgatgtgtgcatgcaaacagttccagaagacaactgactgaagactttataaaggatggcaggtgactatacttcacgccaaacaaaccaaagggaacttcctaagtttaatgagactatcactttctgaacttttggtactagatgactcttcagagacctggattttcagcttttaaaatctaaacaggctctgtgggatatttattaattaaatattcattttataatcaaatgtgttctgactttgccatatataagcctccatggacattgatcaagaagatatggagtgagcagagtgataaaactaagattcctggttatataaaaattt

SEQ ID NO: 37510 - DNA, 673 bp, Homo sapiens
tataagaaaaaaagtggagcctataagggaaataattattcttgctgacttgattcaaattctctggctaagtataataagactaaaacttattttacaagtgagttcgtcctatgatttgtctttagtgaaaatgggactaaagagagaaaaattctgtgtcagaataaactctagtacacctgtagttagtttctggtcttaactgattttttttgcaatttttattactttttacagtttggactaaattctacaatgtccctggctacaagtctcaaacatttttttcctttttttatttcttttttcattttttttttctgatttcaaataactaaaacctaagttgtgctttcttaaagccctgcaaactgaagccagacaaacttaaacttcgaaaaaaagaaaacaacttatttaaatacataaactacctttatacctgcctattgatgtaaagacttcagagtaatatgacctatattgattttccaaaattattcttgctttttttgtttttattgtttttctttcttcctttccctgcttctctttgaaggatgtgagacttcacaacctgctaaaaatgatctttcctaataatgtgggacctacccttctcggaataaactgttctagccgtaagagatcaggcaaaatctgaaaccaa

SEQ ID NO: 37511 - DNA, 172 bp, Homo sapiens
gtatagatcaacagatcaatgcaacagaaagaaaatccatacattaatattcaattgattttttgcaaagttaccaagaaaattcattgagaaatgtcaagtcttttggtgctgcaacaactggataaatttatggttaaaaatgaaccttgatccatactgcataccacac

SEQ ID NO: 37512 - DNA, 485 bp, Homo sapiens
ataaaaggccttgagatggaatgtagtgcccccttgccctcttgcgttctcccatgtgaggacacagcaacaaggcaccatcttggaaggagagagaagccctcaccagacaacagtgcacatgccttgatcttagacttcccagcctccagagctataataaatacatttctgttctttataaattacttggtctctggtattttgttacagaagcactaatggactaagacaaaaagattccattatgaaagtgaaaaggcaaccgcagagtggcagaagcttttggagatgatgaatatgtttacttcctggattgcggtgatgataccatgagtgtatacatatgtgtgtatacataatgtatacaaattgtgttcattgattatgtacagtttctttgtataccaattataccttaataaagctaaggaaaaaaaaaagaaaatccagaataaatatgcatggtatgacccatttattta

SEQ ID NO: 37513 - DNA, 503 bp, Homo sapiens
ataaaaggccttgagatggaatgtagtgcccccttgccctcttgcgttctcccatgtgaggacacagcaacaaggcaccatcttggaaggagagagaagccctcaccagacaacagtgcacatgccttgatcttagacttcccagcctccagagctataataaatacatttctgttctttataaattacttggtctctggtattttgttacagaagcactaatggactaagacaaaaagattccattatgaaagtgaaaaggcaaccgcagagtggcagaagcttttggagatgatgaatatgtttacttcctggattgcggtgatgataccatgagtgtatacatatgtgtgtatacataatgtatacaaattgtgttcattgattatgtacagtttctttgtataccaattataccttaataaagctaaggaaaaaaaaaaagtcgacgcggtcgcgaatttaatagtagtagtccaccccggaaattccggaccggtacc

SEQ ID NO: 37514 - DNA, 421 bp, Homo sapiens
atttctaagaaaccctggaacttggacaaagccaaggtaaaagatgacaacaccaatccttgcaaatcagacagcaaaattaacccgaattgaatacactgaggaaggccctgctatgaaggctctaagccctttaggccaatggacattcaattgcacttgttttaaggatacacagagtgtatctgtccctgcggatacccacggcctgcgaggtacgttcatccctcagtaaacagattttaaatataaacatggaagccagttagcatggtcttggccctgcataaggctagatgctccggttcccatctccaggaaaaggcctggctctgggatcacggaagccacgtcctctcggcgtcaaaggcccacccgccggctccagggccagttaccaggacaggaaaagagggtcctg

SEQ ID NO: 37515 - DNA, 666 bp, Homo sapiens
  misc_feature (2)..(2): n is a, c, g, or t
  misc_feature (25)..(26): n is a, c, g, or t
tncggcacagataaagatctttttnnttctttggagacagagtctcactttgtcgcccaggctggagtgcaatgatgcaatctccactcactgcaacctctgtctcccaggctcaagcaattatcgtggttcagcctctcgagtagctgggattacaggcctgaaccaccacacccagccactatgaacattctttactaataaataaacactatcttgcattacagctacaaaaattattttttgttcttgtttttgagacggggtctccagccactccaggctggagtgcagtggcaaaatcatggatcactgcagctttgaactcctgggggtcagcttcctgagtagctggggaccacccaaacccagcttaatttttttattatttttttttttggagagacggggttctcactttgttgccccaggcaggtcttgaactccctgggctcaagcaatacacctgcctcggcctttccaaagtgctggtattgtaggcatgagccactgttcctggccttacaaaaattattttgtaggttgtattttagctagcctatcacaattcttccaagtttttaaatggtttctgttgcttataaaatattatttattgatagccaacaaattctaatttgggtattgctaggctatcagtgcaaa

SEQ ID NO: 37516 - DNA, 358 bp, Homo sapiens
aacactgcagctttgtcctcttttaaatgatctacccgtgcttttaaactgcaaatgtctacttctgcaaaaggctttggctggttatttcaagtctgatttcttttgatccgaacattttcaagctcaaacaatagagtatgtttctacccagatactgaaaacagttatcaggtaggcaattctgtctcagcagattcagctctttattaatctgttagcctgtcaggattacttttttcatgtctgatgtccttggaaaaactcattagatcccttagtactttcttaaattacagggatgggtgtagctgtactaatctgaacttctggatgtatgaaacattgcaactgtata

SEQ ID NO: 37517 - DNA, 1621 bp, Homo sapiens
ggaggggtctgtgcacacagcatcgagggcggagagctcttcgagaggattgtggatgaggactaccatctgaccgaggtggacaccatggtgtttgtcaggcagatctgtgacgggatcctcttcatgcacaagatgagggttttgcacctggacctcaagccagagaacatcctgtgtgtcaacaccaccgggcatttggtgaagatcattgactttggcctggcacggaggtataaccccaacgagaagctgaaggtgaactttgggaccccagagttcctgtcacctgaggtggtgaattatgaccaaatctccgataagacagacatgtggagtatgggggtgatcacctacatgctgctgagcggcctctcccccttcctgggagatgatgacacagagaccctaaacaacgttctatctggcaactggtactttgatgaagagacctttgaggccgtatcagacgaggccaaagactttgtctccaacctcatcgtcaaggaccagagggcccggatgaacgctgcccagtgtctcgcccatccctggctcaacaacctggcggagaaagccaaacgctgtaaccgacgccttaagtcccagatcttgcttaagaaatacctcatgaagaggcgctggaagaaaaacttcattgctgtcagcgctgccaaccgcttcaagaagatcagcagctcgggggcactgatggctctgggggtctgagccctgggcgcagctgaagcctggacgcagccacacagtggccggggctgaagccacacagcccagaaggccagaaaaggcagccagatccccagggcagcctcgttaggacaaggctgtgccaggctgggaggctcggggctccccacgcccccatgcagtgaccgcttccccgatgtgagccgcctcggagtgtggcctggatccatcctgctagcacctccccagacagggctccagcctgtcggccacaccccagactccaggcccccgttgaagccgctcccggttccctccccagctcctcgtctttgaactgccgccgccgtggtgacccctgctttgccccactgggagagtccttagcctgggcctcctcctagctggagtgccatggctggggggtctcagcatgtagggcttctgtggttgtggatgggaggctcctggtggggcagaaaggctgcaacgctgattcctaaggcccagctgccagggaagacagagcaggctttgtgagagaggacctccatgcccccgccacctccccactccagcagataaggccgagcccacaccatctggcccaggctggcccccacccaccttccttgcgaccaccaacacacaggaactctgtgtgagagagagggcgcccagcccaggcctggtggagggggaggggagaagccaagggacacaggagaccacccccgagcttgcctcagggccaagccggcccaacccaaccactcggggcccccatcttgggggtcacccatggcctcagatgatggggtcagcaggcccaggagaattaggaaggccatggggcagcctccagtctgctctcagcttgtgccttgtaaataaatgtacaggttggatgtgg

SEQ ID NO: 37518 - DNA, 2747 bp, Homo sapiens
atggcgacagaaaatggagcagttgagctgggaattcagaacccatcaacagacaaggcacctaaaggtcccacaggtgaaagacccctggctgcagggaaagaccctggccccccagacccaaagaaagctccggatccacccaccctgaagaaagatgccaaagcccctgcctcagagaaaggggatggtaccctggcccaaccctcaactagcagccaaggccccaaaggagagggtgacaggggcggggggcccgcggagggcagtgctgggcccccggcagccctgccccagcagactgcgacacctgagaccagcgtcaagaagcccaaggctgagcagggagcctcaggcagccaggatcctggaaagcccagggtgggcaagaaggcagcagagggccaagcagcagccaggaggggctcacctgcctttctgcatagccccagctgtcctgccatcatctccagttctgagaagctgctggccaagaagcccccaagcgaggcatcagagctcacctttgaaggggtgcccatgacccacagccccacggatcccaggccagccaaggcagaagaaggaaagaacatcctggcagagagccagaaggaagtgggagagaaaaccccaggccaggctggccaggctaagatgcaaggggacacctcgagggggattgagttccaggctgttccctcagagaaatccgaggtggggcaggccctctgtctcacagccagggaggaggactgcttccagattttggatgattgcccgccacctccggcccccttccctcaccgcatggtggagctgaggaccgggaatgtcagcagtgaattcagtatgaactccaaggaggcgctcggaggtggcaagtttggggcagtctgtacctgcatggagaaagccacaggcctcaagctggcagccaaggtcatcaagaaacagactcccaaagacaaggaaatggtgttgctggagattgaggtcatgaaccagctgaaccaccgcaatctgatccagctgtatgcagccatcgagactccgcatgagatcgtcctgttcatggagtacatcgagggcggagagctcttcgagaggattgtggatgaggactaccatctgaccgaggtggacaccatggtgtttgtcaggcagatctgtgacgggatcctcttcatgcacaagatgagggttttgcacctggacctcaagccagagaacatcctgtgtgtcaacaccaccgggcatttggtgaagatcattgactttggcctggcacggaggtataaccccaacgagaagctgaaggtgaactttgggaccccagagttcctgtcacctgaggtggtgaattatgaccaaatctccgataagacagacatgtggagtatgggggtgatcacctacatgctgctgagcggcctctcccccttcctgggagatgatgacacagagaccctaaacaacgttctatctggcaactggtactttgatgaagagacctttgaggccgtatcagacgaggccaaagactttgtctccaacctcatcgtcaaggaccagagggcccggatgaacgctgcccagtgtctcgcccatccctggctcaacaacctggcggagaaagccaaacgctgtaaccgacgccttaagtcccagatcttgcttaagaaatacctcatgaagaggcgctggaagaaaaacttcattgctgtcagcgctgccaaccgcttcaagaagatcagcagctcgggggcactgatggctctgggggtctgagccctgggcgcagctgaagcctggacgcagccacacagtggccggggctgaagccacacagcccagaaggccagaaaaggcagccagatccccagggcagcctcgttaggacaaggctgtgccaggctgggaggctcggggctccccacgcccccatgcagtgaccgcttccccgatgtgagccgcctcggagtgtggcctggatccatcctgctagcacctccccagacagggctccagcctgtcggccacaccccagactccaggcccccgttgaagccgctcccggttccctccccagctcctcgtctttgaactgccgccgccgtggtgacccctgctttgccccactgggagagtccttagcctgggcctcctcctagctggagtgccatggctggggggtctcagcatgtagggcttctgtggttgtggatgggaggctcctggtggggcagaaaggctgcaacgctgattcctaaggcccagctgccagggaagacagagcaggctttgtgagagaggacctccatgcccccgccacctccccactccagcagataaggccgagcccacaccatctggcccaggctggcccccacccaccttccttgcgaccaccaacacacaggaactctgtgtgagagagagggcgcccagcccaggcctggtggagggggaggggagaagccaagggacacaggagaccacccccgagcttgcctcagggccaagccggcccaacccaaccactcggggcccccatcttgggggtcacccatggcctcagatgatggggtcagcaggcccaggagaattaggaaggccatggggcagcctccagtctgctctcagcttgtgccttgtaaataaatgtacaggttggatgtggcctccttccctctgtgtgtgcctgcactggtgtgaggtcgctgatgaccacagttcactgagca

SEQ ID NO: 37519 - DNA, 2683 bp, Homo sapiens
atggcgacagaaaatggagcagttgagctgggaattcagaacccatcaacagacaaggcacctaaaggtcccacaggtgaaagacccctggctgcagggaaagaccctggccccccagacccaaagaaagctccggatccacccaccctgaagaaagatgccaaagcccctgcctcagagaaaggggatggtaccctggcccaaccctcaactagcagccaaggccccaaaggagagggtgacaggggcggggggcccgcggagggcagtgctgggcccccggcagccctgccccagcagactgcgacacctgagaccagcgtcaagaagcccaaggctgagcagggagcctcaggcagccaggatcctggaaagcccagggtgggcaagaaggcagcagagggccaagcagcagccaggaggggctcacctgcctttctgcatagccccagctgtcctgccatcatctccagttctgagaagctgctggccaagaagcccccaagcgaggcatcagagctcacctttgaaggggtgcccatgacccacagccccacggatcccaggccagccaaggcagaagaaggaaagaacatcctggcagagagccagaaggaagtgggagagaaaaccccaggccaggctggccaggctaagatgcaaggggacacctcgagggggattgagttccaggctgttccctcagagaaatccgaggtggggcaggccctctgtctcacagccagggaggaggactgcttccagattttggatgattgcccgccacctccggcccccttccctcaccgcatggtggagctgaggaccgggaatgtcagcagtgaattcagtatgaactccaaggaggcgctcggaggtggcaagtttggggcagtctgtacctgcatggagaaagccacaggcctcaagctggcagccaaggtcatcaagaaacagactcccaaagacaaggaaatggtgttgctggagattgaggtcatgaaccagctgaaccaccgcaatctgatccagctgtatgcagccatcgagactccgcatgagatcgtcctgttcatggagtacatcgagggcggagagctcttcgagaggattgtggatgaggactaccatctgaccgaggtggacaccatggtgtttgtcaggcagatctgtgacgggatcctcttcatgcacaagatgagggttttgcacctggacctcaagccagagaacatcctgtgtgtcaacaccaccgggcatttggtgaagatcattgactttggcctggcacggaggtataaccccaacgagaagctgaaggtgaactttgggaccccagagttcctgtcacctgaggtggtgaattatgaccaaatctccgataagacagacatgtggagtatgggggtgatcacctacatgctgctgagcggcctctcccccttcctgggagatgatgacacagagaccctaaacaacgttctatctggcaactggtactttgatgaagagacctttgaggccgtatcagacgaggccaaagactttgtctccaacctcatcgtcaaggaccagagggcccggatgaacgctgcccagtgtctcgcccatccctggctcaacaacctggcggagaaagccaaacgctgtaaccgacgccttaagtcccagatcttgcttaagaaatacctcatgaagaggcgctggaagaaaaacttcattgctgtcagcgctgccaaccgcttcaagaagatcagcagctcgggggcactgatggctctgggggtctgagccctgggcgcagctgaagcctggacgcagccacacagtggccggggctgaagccacacagcccagaaggccagaaaaggcagccagatccccagggcagcctcgttaggacaaggctgtgccaggctgggaggctcggggctccccacgcccccatgcagtgaccgcttccccgatgtgagccgcctcggagtgtggcctggatccatcctgctagcacctccccagacagggctccagcctgtcggccacaccccagactccaggcccccgttgaagccgctcccggttccctccccagctcctcgtctttgaactgccgccgccgtggtgacccctgctttgccccactgggagagtccttagcctgggcctcctcctagctggagtgccatggctggggggtctcagcatgtagggcttctgtggttgtggatgggaggctcctggtggggcagaaaggctgcaacgctgattcctaaggcccagctgccagggaagacagagcaggctttgtgagagaggacctccatgcccccgccacctccccactccagcagataaggccgagcccacaccatctggcccaggctggcccccacccaccttccttgcgaccaccaacacacaggaactctgtgtgagagagagggcgcccagcccaggcctggtggagggggaggggagaagccaagggacacaggagaccacccccgagcttgcctcagggccaagccggcccaacccaaccactcggggcccccatcttgggggtcacccatggcctcagatgatggggtcagcaggcccaggagaattaggaaggccatggggcagcctccagtctgctctcagcttgtgccttgtaaataaatgtacaggttggatgtgg

SEQ ID NO: 37520 - DNA, 326 bp, Homo sapiens
tgccattggtgtggaatcaattgaagattaacgtttgaggcctgaaccctcagtttctcttcagatctgtactttggtacagtattactcaggggtttgaaatgatagaatgtagacgatatttgtatttaaaaaaagaagtagctttgtctttctctgtgcagtgttagtttaagatttataatcttctatgtattgaaacttttggcaaaatttccacaggagttagaagtttactatttaaactgaacaaacaaatcagtaaatgcagagcaggcattgtgtgcatttatgcatcttctcctagcctaattcctttgctttac

SEQ ID NO: 37521 - DNA, 476 bp, Homo sapiens
agtatcttgtgacccagccacattacatgagtcagtagaatgtgctaagtttttgctttctctgcttgctgggctaatgctctagcagctacccttccatactgtcccttgatagacagtcatcctctcttctgcagattcccatgatttgtatcttttttatagtatttatgtcttttaaaaaaaaaatttctagcttaaatgtctgtccacctgtctggactgtgaactactccaaggtgtaagattttgttttattcatctttggtctagaacttggtagacgaaggtagtcaataaaactttgttgaccaaatgaagtaagaagtgatttttaaaaaatgtctaaaacaagctctctgccctgaaggagtatacagtttgatatgttatatgtccagtgtaacacaaagtagaatgacatagaggtataggcaaaattccaattggatcgacaaaagcttcttagcttaaaa

SEQ ID NO: 37522 - DNA, 1812 bp, Homo sapiens
ggcggcgcgcggaggggcgggccctggccgggtggtcccgggcggatcccgggaaggcggaaggcttcggcagagctgcgccgccgaggctgagcggtcccttctcgctgcggccgcccaggtgcccgcgcccgtggcgctatggaggcggcgctgctggggctgtgtaactggagcacgctgggcgtgtgcgccgcgctgaagctgccgcagatctccgctgtgctagcggcgcgcagcgcgcggggcctcagccttccgagtttacttctggagctggcaggattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgaatctatgtactttcatcagcgcggccagtaagtttgcacagctccagtgtctgtggaagacgagagactcaggaactgtgagtgcgctgacttggagcctctcttcctatacctgtgcaacaagaataatcacaaccttaatgaccaccaatgattttacaattcttctacgttttgtgatcatgctggctttaaatatatgggtaacagtgacagtacttcgctaccggaagaccgctataaaggctgaatgatggatacattattccttcacacagtggattttgagtaactgaaccaaaggaaaaagaagctctttgctaaattaaggtcttttataaatttagtaaatcagtttataatctttaaagccaaaggtttttttagacttgaaagaaagagccacttaaattcttgtttaaaaataccaatttgcctcctccttcctcacttcgttaggttatggtagtgctcagacatctgcagtgttggaggccagtcactgttggaagtcatccaagaagcccattttgaggccattttgagccttactcttaagttctctatgaagaactacattgatttgttggctttcagaatcttttaggaaataaatcctctccaggacaaaaatgaacatgaatggagtggcattttgttccaagtcagaggtgggcacctataataaatgactagggttcactttctgggactgatgtttaattgtaacacagatacaacagggtggccttgttgtgtataatacggtattatacctgcatgtgctctagcaaggataccaaggcaagcatacatgtagctggcttgagtttgtaccaaaacagtccttcaactttgcactgtgccttaagtaattactaacaaaaggtactaggattagctgcaatctctactttcgatgaggaaatcccagtaagctttctgattcaagtacaatgctgccattttttaaagggccacaactatagaattaccactgttggaatttggtacaaaatatgttttgtctattgaaaacatacacggtaaatggtgttgttaggtaggttctgtccagttcttagggacttttttcacattatagcatttttaccctaaacatgatgttgagattattatatactgtattttcttctaaattaaccctaatgtttaaaaactcactttccccctttaattgaaggcattgttttgttagatgcagtaatgatgtttaccagagattattgtttcctatgcaaaataaattttcatattttgaattctgctgagtcttaaaactgtcaatcattaat

SEQ ID NO: 37523 - DNA, 4646 bp, Homo sapiens
  misc_feature (686)..(686): n is a, c, g, or t
  misc_feature (1311)..(1312): n is a, c, g, or t
  misc_feature (1364)..(1364): n is a, c, g, or t
  misc_feature (1676)..(1676): n is a, c, g, or t
  misc_feature (1981)..(1981): n is a, c, g, or t
  misc_feature (2003)..(2003): n is a, c, g, or t
  misc_feature (2420)..(2420): n is a, c, g, or t
  misc_feature (2657)..(2657): n is a, c, g, or t
  misc_feature (2789)..(2789): n is a, c, g, or t
  misc_feature (3571)..(3571): n is a, c, g, or t
  misc_feature (3835)..(3835): n is a, c, g, or t
  misc_feature (4447)..(4447): n is a, c, g, or t
  misc_feature (4646)..(4646): n is a, c, g, or t
ggggaatctttcctggttatttaatgagattccttgggagagggtcttaagacaattgcatttcttgtagaaagaagtttccttagtcatctgtaaggaagttggagagtctctgcagttgggaaggggtgacggaaaggtcgttaaatccttgattctgaggcagcttctaaggctttcctattcaaagtattcatcatgccagagcgccaaacttttggggtatcatttttgagccccaacaataggaaaacacatacctcaacctagtggtctcgccccttccccctggccaggccaggccttcccctttgccccccgccatcacccagtggggtctgaagcctggtcctccacacaagccttcctggtgggcggggtggggggtgcggcatacaggatgggaagaagccaaggggtgcgggggagaaagaggagacctcaggtgtgggagggtgaggggtcccactcaggctttggaccccgcgccggccctatggagcccggccctgggcacagtcatccaatagggggctttgaggggaaatttttgggaaaggcttgcagtgggagggactgtgacctcttccaggcttgtgagtgactctaccctgcggggtggggaggggggggtcccaggctggatggcagggttgagaggcacccaggggaggtgggcagcatgngtttcaggttggtgccaccaccaggctgggagcagagaggctggagcgatgaggttgtggcaaaggacacaggctggaagtggctgtggtgactgttcaggtgggagaggggacaagggcatgaaagccaggagtgggatttggcctcggccccttgctaggtccctgagctggggaagctgaagctggacccatgaaggaaaagaagccaggctgtctgtagagtctatagattccctcctgccgccagcccctaggcctgcatttccaccacttttgcagcattgcttgaaaaatgcaaaccctcagagatacgcaggtgagggctcctattagatctgccagctgtcacctctcccagctcaccttagtgaaagctagacctctggcagtggaaggatcttcctgggcatgggagctcaagggttgggtggggcagcagcttgctgccatccctgctggcctgtctaagggtcttgcagttgatcacgtgcaggtaaagggggctctgtcggggctggtgcaccagctctgcagcctccaagccagggccagggccaggcacacagacttctgtaaaatgggcttggctgtgtcaggacccatcctcctggccctcctgtcnncctgcctgcctccctcatgcccttcccagccttgcctgggaggcccacctgnggctggccatgcttgccagctgggccccgggcccctgaccagatcaggcagcagccggagttagagcagaaggaaccccagggctgtcgcagtcagccacctggagggcacgggccctctttgggtctccatttgagcaaactaagagcctggttttgagagcactgagtcaattggagcatgaagtgtgtcttaataatgccagaaaagcctttttagtgtggcttggtgtgaagggcaggagcctctgcccagggacctgcctctgccacccaggggcattccttgtagctggagccttccccctcgcangttcccaaccttgctgcttctcctgcctccagggctctgctgggctctgcctccctgctctctgcagccaggagcctcctggagcacaagattcatccaacctgccctgcctgcagccttccatggactgcggccctcccacggtggacccttaggctgtagagccttggcctctgggtaggatgcctttggagcccaccccttgctccaggtcacttgtcccccagcctgggtgggggtacgttttgtttaaccctctagtaggtgttgagggagaaaactccaatggctgcatggagcagatnggaatggaaacaaatggggctntgtcagatgcccggctggcatgattttattatgataagcactatagcgattacttattaaaagaaactttaaagggacaggcatggtggctcatgcctgtaatcccagccctttgggaggccgaggcgggcagataacctgaggtcaggagttcaagaccagccttgccaacatggtgaaaccccatctctactaaaaacacaaaaattaaccagtgtaggctgggtgcagtggctcacacctgtaatcccagcactttgggaggcccaggccggcggatcacgaggtcaggagatcaagaccatcctggctaacacggtgaaaccctgtctctactaaagatacaaaaaattagctgggcgtggtggctggcgcctgtagtcccagctacttgggagtctgaggcaggagaatggngtgaacccgggaggcggagcttgcagtgagccgagatcgtgccactgcactccagcctgggtgacagagcaagactccgcctcaaaaaaaagaaattagccaggtgtagtggcacacatgtagtctcagctactcgggaggctgagcaggagaaccgctggaacccgggaggtggaggttgcagtgactgagatcgcgccactgcactccagcctgggcgacagagcaagactccanctcaaaaaaaagaaacattaaaaactaaaggaaagacactgtccccaccccacctccccaggctgcagggatggggggagtttgaatcccagggaaagcagggagtagacggcaaaacctgcaggggcagcnacggctgcatccagatcagcctcgggaaatccaggctcttcatcttgtatgttcttggtgtctatgggcctccatttccccaagtggtctgtaagttgtggaggccagcatggatgacccctgaaggtgagaacgggctctgacatccccaggttctcaggcctggcctgtggactgtggctgcgtcccaggggtcagcacacacttacttcgatggtgaagacccccatagcttttgttcttcagcactcagtggctggctgtggccccacagaggggctggggtgcagcctccccctctgccagcccccctgggctcaatctcccaggggaacagagggggctgctcaggaggctggcaggaggagagtccctgcggcagggcagggcagaggcaccgcttgtccctgaagctgggaggtggctcagctgcacagcacccggagggcctgcaggcagctgggggtggggaccctgctgggcacggtgggggcccgcactcggggaccaggcctgtgggaggccctcgtgctcagggcaacactgtgacctcctctgactccgcccccagctaagttgtgcactgtcagaaacaggccagggaggcacagcctgtttgtgaatcggacttttccaggattccttcccagcttaggagattggagaccctggggggcccctcctgtgtgttgaagtcccatggttccggctcccctttcttcctgacctgagtggtctgaacacacaggtgagagggagggagccaaaaagctgggtgatgngacaaacaggtagccccaggagaccacagggattccggtcctgaagggagatggctgggtgtgagggggaggcaggaagctctgccttttcttctgagaatgtgggaccctgtggccttcgcagcatcctcacagccggagtcttcttagcgaaattgagggtggttcttcacgctttcccccactgccctctcaaccgggcagctcttctggaaggcaactggaccatccaggtgctgttctaactctaaaaacacggccacngacccccgcatccagggatggttgcggctcctcggatccttgcgcctctgcagcttctcagagtggagggcagatgtgtgcagcagctgaggggcagctgccggggtcagtgggagcccaacatggcaggcaggccagaagcgtgggcccagaaggcccagtctcatattcttgctcagggatttgccttctgtaaaaatcctttgtaagcgaccatctcaaggcactctatagagatcgtgggtattgcactgtggcccggtgcccagtaagttctggatgctccaaaaattgtacagatgattcaactgaattccatctattttgttctaaaccttcctctttgacactggcgtgtccacacccccactgcaaggattcggcaaactgacctcagtgttctggtgcctgccaggccccgacagctgcgttttggggcagccgtgtggacatgtgcccttctctctccagattcctggtgtttctgcggtaccagtgttactatgggtatccgccgctgacctacctggagtaccccatcctcatcgcgcaaggtaacagccccttccctgtccagcggactgccacgggtctccccttcccccctcactnggagcctctctctttcagatgtcatcctcctgctctgtatctttcattttaacgggaacgtgaagcaggccactccttacatcgctgtgtatcctttctgaatctgagccagaagtgggaacggggatgttatttgcgaatggtatgcattgtgaagcaggctcctttaccagatgtgtattttttggttaaactaaan

SEQ ID NO: 37524 - DNA, 827 bp, Homo sapiens
ggcggcgcgcggaggggcgggccctggccgggtggtcccgggcggatcccgggaaggcggaaggcttcggcagagctgcgccgccgaggctgagcggtcccttctcgctgcggccgcccaggtgcccgcgcccgtggcgctatggaggcggcgctgctggggctgtgtaactggagcacgctgggcgtgtgcgccgcgctgaagctgccgcagatctccgctgtgctagcggcgcgcagcgcgcggggcctcagccttccgagtttacttctggagctggcaggattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgaatctatgtactttcatcagcgcggccagtaagtttgcacagctccagtgtctgtggaagacgagagactcaggaactgtgagtgcgctgacttggagcctctcttcctatacctgtgcaagtaagaaccggactcacatggtggggaggcctttggtagcaccaagtgtctacgtagtagggtgttaagttggtgttgaagtaacatggtccctggcgctttactactttacaaatggctactcagctagaacctcctaagtgtatccatgtttacaaagatgatttaatgcaaactgctctccattttctgtaaaatccaagttgccaag

SEQ ID NO: 37525 - DNA, 548 bp, Homo sapiens
  misc_feature (548)..(548): n is a, c, g, or t
ggcggcgcgcggaggggcgggccctggccgggtggtcccgggcggatcccgggaaggcggaaggcttcggcagagctgcgccgccgaggctgagcggtcccttctcgctgcggccgcccaggtgcccgcgcccgtggcgctatggaggcggcgctgctggggctgtgtaactggagcacgctgggcgtgtgcgccgcgctgaagctgccgcagatctccgctgtgctagcggcgcgcagcgcgcggggcctcagccttccgagtttacttctggagctggcaggattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtgtatcctttctgaatctgagccagaagtgggaacggggatgttatttgcgaatggtatgcattgtgaagcaggctcctttaccagatgtgtattttttggttaaactaaan

SEQ ID NO: 37526 - DNA, 582 bp, Homo sapiens
  misc_feature (569)..(569): n is a, c, g, or t
  misc_feature (576)..(576): n is a, c, g, or t
tcatgcatgtaatcccagctgggatgccaaggcgagtggatcacttgaggtcaggagttccggcatggctagtttttatgtaattatgaaatacagcactatttggttttctgtactaccaaactctgtcaagaatagttaatatatgttgttaaaaaaagaataaaaataatttaaaaataatggttaatatatattgggatattaaaagggaaagacattattagctaagccccaaaatgtccgagaggcaagttacttattgctgcaagttttcttttacagcaagaataatcacaaccttaatgaccaccaatgattttacaagtaagcaaaatatcttctcacttcctttttgagttttgtgctatttgtgtctccttcatttgtaaactgtcttagggtttaatggatggacttggctctgttggattatagatttagaagatggcaacaatgtattcctagtcttattggtcaccatttttattgttaagcctctccttcttatagtacagggaaaagactatgcacaagacaatagattcctatctccatgagcgatcagngaaaggngtccta

SEQ ID NO: 37527 - DNA, 754 bp, Homo sapiens
ggcggcgcgcggaggggcgggccctggccgggtggtcccgggcggatcccgggaaggcggaaggcttcggcagagctgcgccgccgaggctgagcggtcccttctcgctgcggccgcccaggtgcccgcgcccgtggcgctatggaggcggcgctgctggggctgtgtaactggagcacgctgggcgtgtgcgccgcgctgaagctgccgcagatctccgctgtgctagcggcgcgcagcgcgcggggcctcagccttccgagtttacttctggagctggcaggattcctggtgtttctgcggtaccagtgttactatgggtatccgccgctgacctacctggagtaccccatcctcatcgcgcaagaagcgattctcctgcctcagcttcctgagtagctgggattacaggcacacgccaccatgcctggctaatttttgtatttttagtagagacgagttttcaccatgttggccaggctggttttgaactcctgacctcaagtgatccacccgccttggcctcccaaagtgctaggattacaggcatgagccaccgcgcccagccaattttttgtagagaggggtctcactatgttgccaaggctggtctcaaactactgggctcaagtgttcatctcacctcagcctcccaaagtattgggattacaggtgtgagccactgcacctggccctgtatgttttctttggagaaatgtctgttcacatggtttgcccattttttaattgggtc

SEQ ID NO: 37528 - DNA, 1886 bp, Homo sapiens
ggcggcgcgcggaggggcgggccctggccgggtggtcccgggcggatcccgggaaggcggaaggcttcggcagagctgcgccgccgaggctgagcggtcccttctcgctgcggccgcccaggtgcccgcgcccgtggcgctatggaggcggcgctgctggggctgtgtaactggagcacgctgggcgtgtgcgccgcgctgaagctgccgcagatctccgctgtgctagcggcgcgcagcgcgcggggcctcagccttccgagtttacttctggagctggcaggattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgaatctatgtactttcatcagcgcggccagtaagtttgcacagctccagtgtctgtggaagacgagagactcaggaactgtgagtgcgctgacttggagcctctcttcctatacctgtgcaaggtctcgctctctctcacaggctggagtgcagtgatacgatcttcactcactgcgggtttccaagtagctgggacaagaataatcacaaccttaatgaccaccaatgattttacaattcttctacgttttgtgatcatgctggctttaaatatatgggtaacagtgacagtacttcgctaccggaagaccgctataaaggctgaatgatggatacattattccttcacacagtggattttgagtaactgaaccaaaggaaaaagaagctctttgctaaattaaggtcttttataaatttagtaaatcagtttataatctttaaagccaaaggtttttttagacttgaaagaaagagccacttaaattcttgtttaaaaataccaatttgcctcctccttcctcacttcgttaggttatggtagtgctcagacatctgcagtgttggaggccagtcactgttggaagtcatccaagaagcccattttgaggccattttgagccttactcttaagttctctatgaagaactacattgatttgttggctttcagaatcttttaggaaataaatcctctccaggacaaaaatgaacatgaatggagtggcattttgttccaagtcagaggtgggcacctataataaatgactagggttcactttctgggactgatgtttaattgtaacacagatacaacagggtggccttgttgtgtataatacggtattatacctgcatgtgctctagcaaggataccaaggcaagcatacatgtagctggcttgagtttgtaccaaaacagtccttcaactttgcactgtgccttaagtaattactaacaaaaggtactaggattagctgcaatctctactttcgatgaggaaatcccagtaagctttctgattcaagtacaatgctgccattttttaaagggccacaactatagaattaccactgttggaatttggtacaaaatatgttttgtctattgaaaacatacacggtaaatggtgttgttaggtaggttctgtccagttcttagggacttttttcacattatagcatttttaccctaaacatgatgttgagattattatatactgtattttcttctaaattaaccctaatgtttaaaaactcactttccccctttaattgaaggcattgttttgttagatgcagtaatgatgtttaccagagattattgtttcctatgcaaaataaattttcatattttgaattctgctgagtcttaaaactgtcaatcattaat

SEQ ID NO: 37529 - DNA, 1770 bp, Homo sapiens
ggcggcgcgcggaggggcgggccctggccgggtggtcccgggcggatcccgggaaggcggaaggcttcggcagagctgcgccgccgaggctgagcggtcccttctcgctgcggccgcccaggtgcccgcgcccgtggcgctatggaggcggcgctgctggggctgtgtaactggagcacgctgggcgtgtgcgccgcgctgaagctgccgcagatctccgctgtgctagcggcgcgcagcgcgcggggcctcagccttccgagtttacttctggagctggcaggattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgaatctatgtactttcatcagcgcggccagtaagtttgcacagctccagtgtctgtggaagacgagagactcaggaactgtgagtgcgctgacttggagcctctcttcctatacctgtgcaattcttctacgttttgtgatcatgctggctttaaatatatgggtaacagtgacagtacttcgctaccggaagaccgctataaaggctgaatgatggatacattattccttcacacagtggattttgagtaactgaaccaaaggaaaaagaagctctttgctaaattaaggtcttttataaatttagtaaatcagtttataatctttaaagccaaaggtttttttagacttgaaagaaagagccacttaaattcttgtttaaaaataccaatttgcctcctccttcctcacttcgttaggttatggtagtgctcagacatctgcagtgttggaggccagtcactgttggaagtcatccaagaagcccattttgaggccattttgagccttactcttaagttctctatgaagaactacattgatttgttggctttcagaatcttttaggaaataaatcctctccaggacaaaaatgaacatgaatggagtggcattttgttccaagtcagaggtgggcacctataataaatgactagggttcactttctgggactgatgtttaattgtaacacagatacaacagggtggccttgttgtgtataatacggtattatacctgcatgtgctctagcaaggataccaaggcaagcatacatgtagctggcttgagtttgtaccaaaacagtccttcaactttgcactgtgccttaagtaattactaacaaaaggtactaggattagctgcaatctctactttcgatgaggaaatcccagtaagctttctgattcaagtacaatgctgccattttttaaagggccacaactatagaattaccactgttggaatttggtacaaaatatgttttgtctattgaaaacatacacggtaaatggtgttgttaggtaggttctgtccagttcttagggacttttttcacattatagcatttttaccctaaacatgatgttgagattattatatactgtattttcttctaaattaaccctaatgtttaaaaactcactttccccctttaattgaaggcattgttttgttagatgcagtaatgatgtttaccagagattattgtttcctatgcaaaataaattttcatattttgaattctgctgagtcttaaaactgtcaatcattaat

SEQ ID NO: 37530 - DNA, 1691 bp, Homo sapiens
ggcggcgcgcggaggggcgggccctggccgggtggtcccgggcggatcccgggaaggcggaaggcttcggcagagctgcgccgccgaggctgagcggtcccttctcgctgcggccgcccaggtgcccgcgcccgtggcgctatggaggcggcgctgctggggctgtgtaactggagcacgctgggcgtgtgcgccgcgctgaagctgccgcagatctccgctgtgctagcggcgcgcagcgcgcggggcctcagccttccgagtttacttctggagctggcaggattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgcaagaataatcacaaccttaatgaccaccaatgattttacaattcttctacgttttgtgatcatgctggctttaaatatatgggtaacagtgacagtacttcgctaccggaagaccgctataaaggctgaatgatggatacattattccttcacacagtggattttgagtaactgaaccaaaggaaaaagaagctctttgctaaattaaggtcttttataaatttagtaaatcagtttataatctttaaagccaaaggtttttttagacttgaaagaaagagccacttaaattcttgtttaaaaataccaatttgcctcctccttcctcacttcgttaggttatggtagtgctcagacatctgcagtgttggaggccagtcactgttggaagtcatccaagaagcccattttgaggccattttgagccttactcttaagttctctatgaagaactacattgatttgttggctttcagaatcttttaggaaataaatcctctccaggacaaaaatgaacatgaatggagtggcattttgttccaagtcagaggtgggcacctataataaatgactagggttcactttctgggactgatgtttaattgtaacacagatacaacagggtggccttgttgtgtataatacggtattatacctgcatgtgctctagcaaggataccaaggcaagcatacatgtagctggcttgagtttgtaccaaaacagtccttcaactttgcactgtgccttaagtaattactaacaaaaggtactaggattagctgcaatctctactttcgatgaggaaatcccagtaagctttctgattcaagtacaatgctgccattttttaaagggccacaactatagaattaccactgttggaatttggtacaaaatatgttttgtctattgaaaacatacacggtaaatggtgttgttaggtaggttctgtccagttcttagggacttttttcacattatagcatttttaccctaaacatgatgttgagattattatatactgtattttcttctaaattaaccctaatgtttaaaaactcactttccccctttaattgaaggcattgttttgttagatgcagtaatgatgtttaccagagattattgtttcctatgcaaaataaattttcatattttgaattctgctgagtcttaaaactgtcaatcattaat

SEQ ID NO: 37531 - DNA, 1754 bp, Homo sapiens
ggcggcgcgcggaggggcgggccctggccgggtggtcccgggcggatcccgggaaggcggaaggcttcggcagagctgcgccgccgaggctgagcggtcccttctcgctgcggccgcccaggtgcccgcgcccgtggcgctatggaggcggcgctgctggggctgtgtaactggagcacgctgggcgtgtgcgccgcgctgaagctgccgcagatctccgctgtgctagcggcgcgcagcgcgcggggcctcagccttccgagtttacttctggagctggcaggattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtaatctatgtactttcatcagcgcggccagtaagtttgcacagctccagtgtctgtggaagacgagagactcaggaactgtgagtgcgctgacttggagcctctcttcctatacctgtgcaacaagaataatcacaaccttaatgaccaccaatgattttacaattcttctacgttttgtgatcatgctggctttaaatatatgggtaacagtgacagtacttcgctaccggaagaccgctataaaggctgaatgatggatacattattccttcacacagtggattttgagtaactgaaccaaaggaaaaagaagctctttgctaaattaaggtcttttataaatttagtaaatcagtttataatctttaaagccaaaggtttttttagacttgaaagaaagagccacttaaattcttgtttaaaaataccaatttgcctcctccttcctcacttcgttaggttatggtagtgctcagacatctgcagtgttggaggccagtcactgttggaagtcatccaagaagcccattttgaggccattttgagccttactcttaagttctctatgaagaactacattgatttgttggctttcagaatcttttaggaaataaatcctctccaggacaaaaatgaacatgaatggagtggcattttgttccaagtcagaggtgggcacctataataaatgactagggttcactttctgggactgatgtttaattgtaacacagatacaacagggtggccttgttgtgtataatacggtattatacctgcatgtgctctagcaaggataccaaggcaagcatacatgtagctggcttgagtttgtaccaaaacagtccttcaactttgcactgtgccttaagtaattactaacaaaaggtactaggattagctgcaatctctactttcgatgaggaaatcccagtaagctttctgattcaagtacaatgctgccattttttaaagggccacaactatagaattaccactgttggaatttggtacaaaatatgttttgtctattgaaaacatacacggtaaatggtgttgttaggtaggttctgtccagttcttagggacttttttcacattatagcatttttaccctaaacatgatgttgagattattatatactgtattttcttctaaattaaccctaatgtttaaaaactcactttccccctttaattgaaggcattgttttgttagatgcagtaatgatgtttaccagagattattgtttcctatgcaaaataaattttcatattttgaattctgctgagtcttaaaactgtcaatcattaat

SEQ ID NO: 37532 - DNA, 1645 bp, Homo sapiens
ggcggcgcgcggaggggcgggccctggccgggtggtcccgggcggatcccgggaaggcggaaggcttcggcagagctgcgccgccgaggctgagcggtcccttctcgctgcggccgcccaggtgcccgcgcccgtggcgctatggaggcggcgctgctggggctgtgtaactggagcacgctgggcgtgtgcgccgcgctgaagctgccgcagatctccgctgtgctagcggcgcgcagcgcgcggggcctcagccttccgagtttacttctggagctggcaggattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtgtatcctttctgaatctgagccagaagtgggaacggggatgttatttgcgaatgttcttctacgttttgtgatcatgctggctttaaatatatgggtaacagtgacagtacttcgctaccggaagaccgctataaaggctgaatgatggatacattattccttcacacagtggattttgagtaactgaaccaaaggaaaaagaagctctttgctaaattaaggtcttttataaatttagtaaatcagtttataatctttaaagccaaaggtttttttagacttgaaagaaagagccacttaaattcttgtttaaaaataccaatttgcctcctccttcctcacttcgttaggttatggtagtgctcagacatctgcagtgttggaggccagtcactgttggaagtcatccaagaagcccattttgaggccattttgagccttactcttaagttctctatgaagaactacattgatttgttggctttcagaatcttttaggaaataaatcctctccaggacaaaaatgaacatgaatggagtggcattttgttccaagtcagaggtgggcacctataataaatgactagggttcactttctgggactgatgtttaattgtaacacagatacaacagggtggccttgttgtgtataatacggtattatacctgcatgtgctctagcaaggataccaaggcaagcatacatgtagctggcttgagtttgtaccaaaacagtccttcaactttgcactgtgccttaagtaattactaacaaaaggtactaggattagctgcaatctctactttcgatgaggaaatcccagtaagctttctgattcaagtacaatgctgccattttttaaagggccacaactatagaattaccactgttggaatttggtacaaaatatgttttgtctattgaaaacatacacggtaaatggtgttgttaggtaggttctgtccagttcttagggacttttttcacattatagcatttttaccctaaacatgatgttgagattattatatactgtattttcttctaaattaaccctaatgtttaaaaactcactttccccctttaattgaaggcattgttttgttagatgcagtaatgatgtttaccagagattattgtttcctatgcaaaataaattttcatattttgaattctgctgagtcttaaaactgtcaatcattaat

SEQ ID NO: 37533 - DNA, 1495 bp, Homo sapiens
agatggagtgaagtggtgtgatctcagttcactgcaacttccaccccctgggttcaagcagttttcctgtctctactaaaaatacaaaattagctgggtgtggtggcggatgcctgtaatcccaaggtgctggaattacaggtgtgagccaccgcacctggcctcttttgcttttttaacaaatcgactcgtgactttctcacattttatctgcaaacagaatctatgtactttcatcagcgcggccagtaagtttgcacagctccagtgtctgtggaagacgagagactcaggaactgtgagtgcgctgacttggagcctctcttcctatacctgtgcaattcttctacgttttgtgatcatgctggctttaaatatatgggtaacagtgacagtacttcgctaccggaagaccgctataaaggctgaatgatggatacattattccttcacacagtggattttgagtaactgaaccaaaggaaaaagaagctctttgctaaattaaggtcttttataaatttagtaaatcagtttataatctttaaagccaaaggtttttttagacttgaaagaaagagccacttaaattcttgtttaaaaataccaatttgcctcctccttcctcacttcgttaggttatggtagtgctcagacatctgcagtgttggaggccagtcactgttggaagtcatccaagaagcccattttgaggccattttgagccttactcttaagttctctatgaagaactacattgatttgttggctttcagaatcttttaggaaataaatcctctccaggacaaaaatgaacatgaatggagtggcattttgttccaagtcagaggtgggcacctataataaatgactagggttcactttctgggactgatgtttaattgtaacacagatacaacagggtggccttgttgtgtataatacggtattatacctgcatgtgctctagcaaggataccaaggcaagcatacatgtagctggcttgagtttgtaccaaaacagtccttcaactttgcactgtgccttaagtaattactaacaaaaggtactaggattagctgcaatctctactttcgatgaggaaatcccagtaagctttctgattcaagtacaatgctgccattttttaaagggccacaactatagaattaccactgttggaatttggtacaaaatatgttttgtctattgaaaacatacacggtaaatggtgttgttaggtaggttctgtccagttcttagggacttttttcacattatagcatttttaccctaaacatgatgttgagattattatatactgtattttcttctaaattaaccctaatgtttaaaaactcactttccccctttaattgaaggcattgttttgttagatgcagtaatgatgtttaccagagattattgtttcctatgcaaaataaattttcatattttgaattctgctgagtcttaaaactgtcaatcattaat

SEQ ID NO: 37534 - DNA, 5667 bp, Homo sapiens
  misc_feature (686)..(686): n is a, c, g, or t
  misc_feature (1311)..(1312): n is a, c, g, or t
  misc_feature (1364)..(1364): n is a, c, g, or t
  misc_feature (1676)..(1676): n is a, c, g, or t
  misc_feature (1981)..(1981): n is a, c, g, or t
  misc_feature (2003)..(2003): n is a, c, g, or t
  misc_feature (2420)..(2420): n is a, c, g, or t
  misc_feature (2657)..(2657): n is a, c, g, or t
  misc_feature (2789)..(2789): n is a, c, g, or t
  misc_feature (3571)..(3571): n is a, c, g, or t
  misc_feature (3835)..(3835): n is a, c, g, or t
ggggaatctttcctggttatttaatgagattccttgggagagggtcttaagacaattgcatttcttgtagaaagaagtttccttagtcatctgtaaggaagttggagagtctctgcagttgggaaggggtgacggaaaggtcgttaaatccttgattctgaggcagcttctaaggctttcctattcaaagtattcatcatgccagagcgccaaacttttggggtatcatttttgagccccaacaataggaaaacacatacctcaacctagtggtctcgccccttccccctggccaggccaggccttcccctttgccccccgccatcacccagtggggtctgaagcctggtcctccacacaagccttcctggtgggcggggtggggggtgcggcatacaggatgggaagaagccaaggggtgcgggggagaaagaggagacctcaggtgtgggagggtgaggggtcccactcaggctttggaccccgcgccggccctatggagcccggccctgggcacagtcatccaatagggggctttgaggggaaatttttgggaaaggcttgcagtgggagggactgtgacctcttccaggcttgtgagtgactctaccctgcggggtggggaggggggggtcccaggctggatggcagggttgagaggcacccaggggaggtgggcagcatgngtttcaggttggtgccaccaccaggctgggagcagagaggctggagcgatgaggttgtggcaaaggacacaggctggaagtggctgtggtgactgttcaggtgggagaggggacaagggcatgaaagccaggagtgggatttggcctcggccccttgctaggtccctgagctggggaagctgaagctggacccatgaaggaaaagaagccaggctgtctgtagagtctatagattccctcctgccgccagcccctaggcctgcatttccaccacttttgcagcattgcttgaaaaatgcaaaccctcagagatacgcaggtgagggctcctattagatctgccagctgtcacctctcccagctcaccttagtgaaagctagacctctggcagtggaaggatcttcctgggcatgggagctcaagggttgggtggggcagcagcttgctgccatccctgctggcctgtctaagggtcttgcagttgatcacgtgcaggtaaagggggctctgtcggggctggtgcaccagctctgcagcctccaagccagggccagggccaggcacacagacttctgtaaaatgggcttggctgtgtcaggacccatcctcctggccctcctgtcnncctgcctgcctccctcatgcccttcccagccttgcctgggaggcccacctgnggctggccatgcttgccagctgggccccgggcccctgaccagatcaggcagcagccggagttagagcagaaggaaccccagggctgtcgcagtcagccacctggagggcacgggccctctttgggtctccatttgagcaaactaagagcctggttttgagagcactgagtcaattggagcatgaagtgtgtcttaataatgccagaaaagcctttttagtgtggcttggtgtgaagggcaggagcctctgcccagggacctgcctctgccacccaggggcattccttgtagctggagccttccccctcgcangttcccaaccttgctgcttctcctgcctccagggctctgctgggctctgcctccctgctctctgcagccaggagcctcctggagcacaagattcatccaacctgccctgcctgcagccttccatggactgcggccctcccacggtggacccttaggctgtagagccttggcctctgggtaggatgcctttggagcccaccccttgctccaggtcacttgtcccccagcctgggtgggggtacgttttgtttaaccctctagtaggtgttgagggagaaaactccaatggctgcatggagcagatnggaatggaaacaaatggggctntgtcagatgcccggctggcatgattttattatgataagcactatagcgattacttattaaaagaaactttaaagggacaggcatggtggctcatgcctgtaatcccagccctttgggaggccgaggcgggcagataacctgaggtcaggagttcaagaccagccttgccaacatggtgaaaccccatctctactaaaaacacaaaaattaaccagtgtaggctgggtgcagtggctcacacctgtaatcccagcactttgggaggcccaggccggcggatcacgaggtcaggagatcaagaccatcctggctaacacggtgaaaccctgtctctactaaagatacaaaaaattagctgggcgtggtggctggcgcctgtagtcccagctacttgggagtctgaggcaggagaatggngtgaacccgggaggcggagcttgcagtgagccgagatcgtgccactgcactccagcctgggtgacagagcaagactccgcctcaaaaaaaagaaattagccaggtgtagtggcacacatgtagtctcagctactcgggaggctgagcaggagaaccgctggaacccgggaggtggaggttgcagtgactgagatcgcgccactgcactccagcctgggcgacagagcaagactccanctcaaaaaaaagaaacattaaaaactaaaggaaagacactgtccccaccccacctccccaggctgcagggatggggggagtttgaatcccagggaaagcagggagtagacggcaaaacctgcaggggcagcnacggctgcatccagatcagcctcgggaaatccaggctcttcatcttgtatgttcttggtgtctatgggcctccatttccccaagtggtctgtaagttgtggaggccagcatggatgacccctgaaggtgagaacgggctctgacatccccaggttctcaggcctggcctgtggactgtggctgcgtcccaggggtcagcacacacttacttcgatggtgaagacccccatagcttttgttcttcagcactcagtggctggctgtggccccacagaggggctggggtgcagcctccccctctgccagcccccctgggctcaatctcccaggggaacagagggggctgctcaggaggctggcaggaggagagtccctgcggcagggcagggcagaggcaccgcttgtccctgaagctgggaggtggctcagctgcacagcacccggagggcctgcaggcagctgggggtggggaccctgctgggcacggtgggggcccgcactcggggaccaggcctgtgggaggccctcgtgctcagggcaacactgtgacctcctctgactccgcccccagctaagttgtgcactgtcagaaacaggccagggaggcacagcctgtttgtgaatcggacttttccaggattccttcccagcttaggagattggagaccctggggggcccctcctgtgtgttgaagtcccatggttccggctcccctttcttcctgacctgagtggtctgaacacacaggtgagagggagggagccaaaaagctgggtgatgngacaaacaggtagccccaggagaccacagggattccggtcctgaagggagatggctgggtgtgagggggaggcaggaagctctgccttttcttctgagaatgtgggaccctgtggccttcgcagcatcctcacagccggagtcttcttagcgaaattgagggtggttcttcacgctttcccccactgccctctcaaccgggcagctcttctggaaggcaactggaccatccaggtgctgttctaactctaaaaacacggccacngacccccgcatccagggatggttgcggctcctcggatccttgcgcctctgcagcttctcagagtggagggcagatgtgtgcagcagctgaggggcagctgccggggtcagtgggagcccaacatggcaggcaggccagaagcgtgggcccagaaggcccagtctcatattcttgctcagggatttgccttctgtaaaaatcctttgtaagcgaccatctcaaggcactctatagagatcgtgggtattgcactgtggcccggtgcccagtaagttctggatgctccaaaaattgtacagatgattcaactgaattccatctattttgttctaaaccttcctctttgacactggcgtgtccacacccccactgcaaggattcggcaaactgacctcagtgttctggtgcctgccaggccccgacagctgcgttttggggcagccgtgtggacatgtgcccttctctctccagattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtgtatcctttctgaatctgagccagaagtgggaacggggatgttatttgcgaatgttcttctacgttttgtgatcatgctggctttaaatatatgggtaacagtgacagtacttcgctaccggaagaccgctataaaggctgaatgatggatacattattccttcacacagtggattttgagtaactgaaccaaaggaaaaagaagctctttgctaaattaaggtcttttataaatttagtaaatcagtttataatctttaaagccaaaggtttttttagacttgaaagaaagagccacttaaattcttgtttaaaaataccaatttgcctcctccttcctcacttcgttaggttatggtagtgctcagacatctgcagtgttggaggccagtcactgttggaagtcatccaagaagcccattttgaggccattttgagccttactcttaagttctctatgaagaactacattgatttgttggctttcagaatcttttaggaaataaatcctctccaggacaaaaatgaacatgaatggagtggcattttgttccaagtcagaggtgggcacctataataaatgactagggttcactttctgggactgatgtttaattgtaacacagatacaacagggtggccttgttgtgtataatacggtattatacctgcatgtgctctagcaaggataccaaggcaagcatacatgtagctggcttgagtttgtaccaaaacagtccttcaactttgcactgtgccttaagtaattactaacaaaaggtactaggattagctgcaatctctactttcgatgaggaaatcccagtaagctttctgattcaagtacaatgctgccattttttaaagggccacaactatagaattaccactgttggaatttggtacaaaatatgttttgtctattgaaaacatacacggtaaatggtgttgttaggtaggttctgtccagttcttagggacttttttcacattatagcatttttaccctaaacatgatgttgagattattatatactgtattttcttctaaattaaccctaatgtttaaaaactcactttccccctttaattgaaggcattgttttgttagatgcagtaatgatgtttaccagagattattgtttcctatgcaaaataaattttcatattttgaattctgctgagtcttaaaactgtcaatcattaat

SEQ ID NO: 37535 - DNA, 1796 bp, Homo sapiens
ggcggcgcgcggaggggcgggccctggccgggtggtcccgggcggatcccgggaaggcggaaggcttcggcagagctgcgccgccgaggctgagcggtcccttctcgctgcggccgcccaggtgcccgcgcccgtggcgctatggaggcggcgctgctggggctgtgtaactggagcacgctgggcgtgtgcgccgcgctgaagctgccgcagatctccgctgtgctagcggcgcgcagcgcgcggggcctcagccttccgagtttacttctggagctggcaggattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgaatctatgtactttcatcagcgcggccagtaagtttgcacagctccagtgtctgtggaagacgagagactcaggaactgtgagtgcgctgacttggagcctctcttcctatacctgtgcaacaagaataatcacaaccttaatgaccaccaatgattttacaattcttctacgttttgtgatcatgctggctttaaatatatgggtaacagtgacagtacttcgctaccggaagaccgctataaaggctgaatgatggatacattattccttcacacagtggattttgagtaactgaaccaaaggaaaaagaagctctttgctaaattaaggtcttttataaatttagtaaatcagtttataatctttaaagccaaaggtttttttagacttgaaagaaagagccacttaaattcttgtttaaaaataccaatttgcctcctccttcctcacttcgttaggttatggtagtgctcagacatctgcagtgttggaggccagtcactgttggaagtcatccaagaagcccattttgaggccattttgagccttactcttaagttctctatgaagaactacattgatttgttggctttcagaatcttttaggaaataaatcctctccaggacaaaaatgaacatgaatggagtggcattttgttccaagtcagaggtgggcacctataataaatgactagggttcactttctgggactgatgtttaattgtaacacagatacaacagggtggccttgttgtgtataatacggtattatacctgcatgtgctctagcaaggataccaaggcaagcatacatgtagctggcttgagtttgtaccaaaacagtccttcaactttgcactgtgccttaagtaattactaacaaaaggtactaggattagctgcaatctctactttcgatgaggaaatcccagtaagctttctgattcaagtacaatgctgccattttttaaagggccacaactatagaattaccactgttggaatttggtacaaaatatgttttgtctattgaaaacatacacggtaaatggtgttgttaggtaggttctgtccagttcttagggacttttttcacattatagcatttttaccctaaacatgatgttgagattattatatactgtattttcttctaaattaaccctaatgtttaaaagaaaatacagtatataataatctcaacatcctctccaggacaaaaatgaacatgaatggagtggcattttgttccaagtcagaggtgggcacctataataaatgactagggttaatttaga

SEQ ID NO: 37536 - DNA, 1010 bp, Homo sapiens
ggcggcgcgcggaggggcgggccctggccgggtggtcccgggcggatcccgggaaggcggaaggcttcggcagagctgcgccgccgaggctgagcggtcccttctcgctgcggccgcccaggtgcccgcgcccgtggcgctatggaggcggcgctgctggggctgtgtaactggagcacgctgggcgtgtgcgccgcgctgaagctgccgcagatctccgctgtgctagcggcgcgcagcgcgcggggcctcagccttccgagtttacttctggagctggcaggattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgaatctatgtactttcatcagcgcggccagtaagtttgcacagctccagtgtctgtggaagacgagagactcaggaactgtgagtgcgctgacttggagcctctcttcctatacctgtgcaacaagaataatcacaaccttaatgaccaccaatgattttacaattcttctacgttttgtgatcatgctggctttaaatatatgggtaacagtgacagtacttcgctaccggaagaccgctataaaggctgaatgatggatacattattccttcacacagtggattttgagtaactgaaccaaaggaaaaagaagctctttgctaaattaaggtcttttataaatttagtaaatcagtttataatctttaaagccaaaggtttttttagacttgaaagaaagagccacttaaattcttgtttaaacctgccaaatatgatgacatcaagaaggtggtgaagcaggcgtcggagggcccctcaagggcatcctgggctacactgagcaccaggtggt

SEQ ID NO: 37537 - DNA, 1115 bp, Homo sapiens
  misc_feature (1098)..(1098): n is a, c, g, or t
ggcggcgcgcggaggggcgggccctggccgggtggtcccgggcggatcccgggaaggcggaaggcttcggcagagctgcgccgccgaggctgagcggtcccttctcgctgcggccgcccaggtgcccgcgcccgtggcgctatggaggcggcgctgctggggctgtgtaactggagcacgctgggcgtgtgcgccgcgctgaagctgccgcagatctccgctgtgctagcggcgcgcagcgcgcggggcctcagccttccgagtttacttctggagctggcaggattcctggtgtttctgcggtaccagtgttactatgggtatccgccgctgacctacctggagtaccccatcctcatcgcgcaagatgtcatcctcctgctctgtatctttcattttaacgggaacgtgaagcaggccactccttacatcgctgtattggtgtcttcttggttcatccttgccctgcagaagtggatcatagacctggccatgaatctatgtactttcatcagcgcggccagtaagtttgcacagctccagtgtctgtggaagacgagagactcaggaactgtgagtgcgctgacttggagcctctcttcctatacctgtgcaaggtctcgctctctctcacaggctggagtgcagtgatacgatcttcactcactgcgggtttccaagtagctgggacaagaataatcacaaccttaatgaccaccaatgattttacaattcttctacgttttgtgatcatgctggctttaaatatatgggtaacagtgacagtacttcgctaccggaagaccgctataaaggctgaatgatggatacattattccttcacacagtggattttgagtaactgaaccaaaggaaaaagaagctctttgctaaattaaggtcttttataaatttagtaaatcagtttataatctttaaagccaaaggtttttttagacttgaaagaaagagccacttaaattcttgtttaaaaataccaatttgcctcctccttcctcacttcgttaggttatggtagtgctcagacatctgcagtgttggaggccagtcactgttggaagaagtaaacaagaatgncattccaaaaaaaaaaa

SEQ ID NO: 37538 - DNA, 450 bp, Homo sapiens
aaattattatttatgaagttgggccaaggggccaaaaattgtcatgatagggagatcatttccccagaaataactggaaccaaaattgttcatttcggaggttgggggtgaagctttatttaggcttatactttgagcaggaggtggttttggtctgtattgtaaagacagtttttaatacacttttttttttatttcagttcttctacgttttgtgatcatgctggctttaaatatatgggtaacagtgacagtacttcgctaccggaagaccgctataaaggctgaatgatggatacattattccttcacacagtggattttgagtaactgaaccaaaggaaaaagaagctctttgctaaattaaggtcttttataaatttagtaaatcagtttataatctttaaagccaaaggtttttttagacttgaaagaaagagccacttaaat

SEQ ID NO: 37539 - DNA, 479 bp, Homo sapiens
aaacggggtttcaccatgttggtcaggctggtctcgaactcttgaccttgtgatccacccacctcaccctcccaaagtgctgggattacaggcgggagccaccgcgcccagcccctgatagggtatattttacaatataggcttggaccaatcagttctgaagacccaaagaaatcccccacccaattactaataattcctcagttatcccctatagttggagaatgagatagtcctaagtaattatttccttcaccaacaacttgagatggaatataataatgtatcctttaaaagtatctgaattatagaattctaggtccaaaagaaacttcatgagacatctaggataagatagccctaagttagagcataaggagagcaagtctttctttaaaatattcagaaaaggagcttccccagccttcctccctcctttcaattgttttacctggctcatggcaacaacctataaggac

SEQ ID NO: 37540 - DNA, 198 bp, Homo sapiens
cacttcctcagcctcccctgacatgtctacatgttccacccccacccccggagtgtgggctttgcagggcgctggcggacctgaaatactctgcacacctgggaagctgcaggcagacctctgagctccagctcgttcttcagtaaaaggggctgaatggtgctgactttggaggattccaggtttcagaaataatgg

SEQ ID NO: 37541 - DNA, 421 bp, Homo sapiens
  misc_feature (3)..(3): n is a, c, g, or t
  misc_feature (10)..(10): n is a, c, g, or t
  misc_feature (23)..(23): n is a, c, g, or t
gtngccgtanctccagcactttnggcggccaaggcgtgagccaccacacctggcctctatttcgaatattaaactttaatttaccatatcccaaatatttttccttttgttgctattatgggctgaattgtgtccctccaaaatgcatatgttgaagttctagcccccagtacctcagaatgttacctttgaggtgattaagttaaaatgaggttattaaggggggccctaatccaatatgactgatttctttataagaagaggaaatttggatataggcacgcagaaggaagaccatgtgaagacagagaagatggttgtaagagacagaaaaacccaaagtgtgtttctcctactctcatacacaccgctcaccagagagtgcttcacctctggccacaaaaatgggtggagatttctc

SEQ ID NO: 37542 - DNA, 340 bp, Homo sapiens
gctggctgccaccaattattattttggagagagagttaacaactgcctaaccatcacctgatggtcgcctgacattccaggtgtgggagggcggctctcttgccctgctcgtgtctacctacttactgtaacatacatagaaatcttttgatgtatatacagtaaaatattaagtgattatctgtaaggcaaaattgcaggtaacttctttctcctgttgcttttctgcatgttccattttttatattgaatatttattatcattgtaattagaaacaaaacatattggctgggtgcagtggctgacatctgtaatcctagtgctttgggaggcctaggt

SEQ ID NO: 37543 - DNA, 991 bp, Homo sapiens
tagctttatccctgagacttattatttgacgtgatgacatctttaactcaagaggtcaacaattgggataaaatgccatgctgtgggtgatggacgccataaaagtaacctgataatcggtcgggtgcggtggctcacacttgtaatcccagcattttgggaggccgaggcaggcagatcacctgaggtcgggagtttgagaccagcctgaccaacatagagaaaccctgtctctactaaaaatacaaaattagctgggtgtggtggcacatgcctgtaatcccagctactcgggaagctgaagcaggagaattgcttgaacccgggatgcagaggttgcggtaagctgagatcgcaccattgcactctagcctgggcaacaagagcaaaactccatctcagggaaaaaaaaaaaattaacctgataattgagttttagttataaaagtgccaaaatgctaaaagaatttacagtttctgaccactgaaatattttgctctagcctgggtacaagaagaagcgagtttgagactaggaatgaatgagaggaaacttttgattcttactacataggttccttttagaattttgaatgtttagagctagaaattgaatattcattattctagcccagacattttacagaggagaaagtcaaagtttcagagatgaaagttgtacccagggccacacagttaggttgctgcaaatattaagagaacttacttcacttaatttggtgcatttttattcttctatttatagacgagtaaaatgtgctgagaccagtgcattttaagctccaagactgtcacttcttcatttgtcttaggcttttagattcaattaaataagtaatgcacctaaagattcatcagctgggaatactgtctcaccactgaatgacttaagagagataatattgccttgctgaagacatattataaaaatctgagaatgagcatgtgtgaagctctctgatactcttac

SEQ ID NO: 37544 - DNA, 332 bp, Homo sapiens
atttctcctccaaagtgtttaagcttcagatccctcaaaatctggatctgcctctgtagagcacataacatttcatttgttctaatatctgacaatttctgcaaactctgacagtgaaatactctcaaacatttccactgtaaaacagctaataaacaagcatgtttacaattggtttatgttctctaagttcttcctttgaaaaacaaagtggtgtgtctctactttaatctgttaattttatttccctgaatagagttaaacagttgttgtttttgaagtcctatacttttcttgttaaatgtattcctattttatagttttagctactc

SEQ ID NO: 37545 - DNA, 522 bp, Homo sapiens
gatccacagaacgttgtacatttaagaagtgattccttcaagctaatttaaaatttcattgaacacatggtgaccaggaaaactttttttcaagcactgttggaaagcaccacaaagccctttagaattaatctggatttgtttctcaagttctgctgaagtttaaaaaaaaactttattatacaaataactcaaaattttcctgtgtaaaactaaacctgtagttttaaaacataatcctgtttgcattagagctcactgtctttttgtgatggaaactgtgttcgtatggaatgactaaaaatcttttatttggtttgtttcaaattacaattgctgatggacaatttgtattgcagcgagaacaacagaatgaaagaaatgtatctctgtgcggctatacatatacatacataaaattgatttttaaatttaaaacatatggaaaacaaaacattgaacagtttgaattttgccaagttggacattaaagtaaaaatgaagtgaaatcatgcattgaaa

SEQ ID NO: 37546 - DNA, 1266 bp, Homo sapiens
tctgggctcagtgcatgccccagtaaagctagtgaaacccttgaagatggccaggtattttgcaaagtatgtatggataacaggttgtgtgtgtgtatgtgtgaatgtgtgtgtgcgtgtatgtgtgtgtgcgtgtgcgcgctaatgcgcatgtgcgcccgcgccaaggtggctcccttatcctagcatttcctttcattccctactcacataatggatcctctaacagttcagtataggtacactttccactattttattgacatgttctagtcttaatattggataattagacactttccactgggcccatttgaaaagtaattgataattacctttaagacattttaagtgttaatgatatttgtcactactaagtgcttagttttatttataaaactttcaaagttttctgtttaagactgtaaactgttttcctatactacgtgttagatgaaagtgtattttatcacaaattaaccttagaatgcaactctttgaatgtgtgcttgctggaagaattccagatggacacaaatccctctagggcaggtcaccatgcagaacacttaggagaagcacgaactgagccagaggagggttgttgttttccacaaactaagcagtgaagtgggaatttgggaattctgacacacgtcaccatctctgatttccttttgcgtgaccttttcatgcaagagcaaaacacttagctcttcatgaatgtctgctccacaccaatgaaatggaagagtaaaggagcccctcaactatcagggaaagaacaggaggcctcagttgaggaatacaacttttgtcctgcctttgctatagctgaaccactgttgaaaggttgaagaacacagtttgcccagcaaagatccatccactcatgtacaaagcaaagcactaaaggagctattagtttgatggaaaaaactacccctaaagagcttctttctaaaagaccttcctcgaaggtgatttaatggcatgtcatcatttaaaagtcttaggctgaactgtcatttacactgcacaattgaggaatgaaattttctgagtattagaacgttcttcttaacctagcaatataatattcaacaagactatcaccttatgtgaaaatactaaaatgcagttagcaataaaatgcatggtaaataaccattttaaaaatgttattataaaaggttgtaagatactgtggtgttttacagatgtagcctttataattgaattatatacactatccttttttatggg

SEQ ID NO: 37547 - DNA, 388 bp, Homo sapiens
cgcggccgcgtcgacgatctttcctcaaatatttgggacaattgtctactctgtgctcaagcattgtgttaggtcttagagattcagtgaaaagacgagttacggccgggcatggtggctcactcacgcctgtaattccagcactttgggaggctgaggcgggtggatcactaggtcaggagatcgagaccatcctggccaacgtggtgaaaccccgtctctactgaaaacacaaaaaattggctgggcgtggtggcgcatgcctgtggtctcggctactcaggaggctgaggcaggagaagtgcttgaacccgggaggtggaggttgcggtgagcaagatcgattgcgccactgcattccagcctgggtgacagagactccatctca

SEQ ID NO: 37548 - DNA, 393 bp, Homo sapiens
ttttttttttttaagacaaagccttactctgttgcccaggctgagagccctggcacaatcatagctcactgcaagtttgaatttctgggctgaagcaatgctcccacctcagtctccgagtagctgggattaaggttttgtgccactgtgcccagccccttatttttaataataattcccatgattgataagcatgcagtgaaatatacaaattcacatcttgcttgtgggagtggaacttggtttagcctttctgggaatcaatttggaagtcttaagagcattaaaaatgttcatactctttgacccagaaatattccttctgggaatttttcccacaaaattagaaaaattttccctataaaaatagaaaatcagacaaatatgtatgta

SEQ ID NO: 37549 - DNA, 584 bp, Homo sapiens
gattctataaattgctgttgtgttccttagctgcttgtactgcatatataattgttctttgagagttatataaatgtctggatgtgaataagcaaggccgcaaaataatgttttatatcctttaaaataagtgtttgcccactttttctgtaaagggccagctaaatatttttggttttataagccatctgtaggatctcaactactgtgctctggcattctagtacaaaaacagctataagtaatatgtaaatgcgcaagcatggctgtgtccaaaaaactatttacaaaaataggtagtatgccatagtttgccagtcattactttagaacaccagttagataatactaaaacaaattatttcctttgtatggttaagtattttctgtgggttatattcctataactcacatgataaagttaagaactgtgaacagttcttcacataagcacaacataaaatagttagttaaggctgggcgtgttggcttgtgcctgtaatcgcagcactttgggaggctgaggcaggtggatcgcctgagatcaggagtttgagaccagcccgaccaacatggtgaaaccc

SEQ ID NO: 37550 - DNA, 781 bp, Homo sapiens
gtagaaagagaatatgagagatccaagagcaggctctggaagggctagcacaaggaaagttgtacacacacacacacacaaacacacacagcctgtataaggaacgttacacacacacacacacacacacacacacacgcacacacagagtcagtcaagaaaaggaatggtcagagtaaaaagaaaaagaaggtgaagatagtgtccagtaaaaaaagccaaagaagagagtttaatggaggaggaggtatagttaagtatttcaggaagggtttatttatatatccaagtaaaattaaaaggtgcttttagacatataaagcagtacttaaatccaagttcatgttgggcagagtggaggtatatcagccattacagtgtaacaaatgcccatttcaaaattgatagatagtactgcctcgtttttctcaactctaaaataacagtaatagtagtatttcattgggtaattataaggttgaaacaggataacccatgtgaagcacttagctgagggtcacacactagtaaatatttgttaaatgttagcttcatttataacaataaatgttagcttcatttataacaataaatgttatctgactgactgactctggctgttttataatgggggaaaaaacgtttgtttccaggttttttgtttgtttttttgtttctgttttttgaggaggtgggagacctaatgtgggtgttggcaaactatggctggtgggccaaacctagcccattacctgtttttgtatagcaaactggttggaga

SEQ ID NO: 37551 - DNA, 369 bp, Homo sapiens
taactcttatatctctttgctctgaccattcctttttttgactgactctgtgtgcgtgtgtgtgtgtgtgtgtgtgtgtgtgtgtgtgaagcacttagctgagggtcacacactagtaaatatttgttaaatgttagcttcatttataacaataaatgttagcttcatttataacaataaatgttatctgactgactgactctggctgttttataatgggggaaaaaacgtttgtttccaggttttttgtttgtttttttgtttctgttttttgaggaggtgggagacctaatgtgggtgttggcaaactatggctggtgggccaaacctagcccattacctgtttttgtatagcaaactggttggaga

SEQ ID NO: 37552 - DNA, 474 bp, Homo sapiens
ttttctcaagtggtaaaactgttttggcacacgtgacacaccccttgggcacctacccaagagaagctctcaataatgaagagccatctcgattagtcttaatttagtacctgacccagctgccctcatctcctttgtacttaaatagctcctttcatccaacaagttcaaagctgtctaacaaaataaacccacttattcttgcaccatgacggcacaggcaagcattgtccttcccatttaagggagagagagagaaggtgagtcattcagtggttaagggattctgctggtgacataaagtgagtcagtggggccccagggtgattgacctgtgtttcttaagttcacatccagtgctctctcatttctaattaaaagattagctttgatgagacagtacatgtgtgtgtgtgcacgcacatctgtgtcagctggtgtaactggtgctgttgtaggggatctctctagagt

SEQ ID NO: 37553 - DNA, 894 bp, Homo sapiens
agctttgcgcgcctacctggcggtcgtgggtcgaggaggggtcaagaattgttgtctagcagccctctccccgctgccctgtcctggccgaggcaaaggccgcgtgcgctccgcgtctgccaggctttagggctgcgcggacactgggtgggtggtgggccgaggcgaccggaaggtcctggccgcctttccggtctcctcagcaccctggagcgccgccctcgggtttcggtctcctggatctgcgggtcggtctcggcgggcggattactcctcgcccacaacctcgaggccccggggtcaaccgcgccctccgggccggcaacccagggtttagtcagattcctcctgacccaccgcttctgggaaagaggcgcctcccgtcaggaggatgctgagttcctcatgactggaccagtgagtgtccactccctggtccctggcgagagaggcgggacccccacgccctcctggcgctctttgcagagatgttcctcaggcccaatccgggatttgggatgtctgtgcgtgctgtggagcagagagtttgcaacatggtctcactttgtcacccaggctggaatgcattggcatgaacacgtctcactgcagcctcaacctcccaggctgaagtgaccctccaactctgctttcacagtagctgtgatatggtttggctgtgtccccacccacatctcatcttaaaacccagtgggaggagggatgttctcccttggaaccaggccaccattctatgaggaagccaagcagccacatgaaaaggccgtatgtagacattctaactgacaatactagctaaggttccagctactcaccagcatcaactatcagacaaattcctatcattactagaagaaactatatgccaagtgc

SEQ ID NO: 37554 - DNA, 1111 bp, Homo sapiens
agctttgcgcgcctacctggcggtcgtgggtcgaggaggggtcaagaattgttgtctagcagccctctccccgctgccctgtcctggccgaggcaaaggccgcgtgcgctccgcgtctgccaggctttagggctgcgcggacactgggtgggtggtgggccgaggcgaccggaaggtcctggccgcctttccggtctcctcagcaccctggagcgccgccctcgggtttcggtctcctggatctgcgggtcggtctcggcgggcggattactcctcgcccacaacctcgaggccccggggtcaaccgcgccctccgggccggcaacccagggtttagtcagattcctcctgacccaccgcttctgggaaagaggcgcctcccgtcaggaggatgctgagttcctcatgactggaccagtgagtgtccactccctggtccctggcgagagaggcgggacccccacgccctcctggcgctctttgcagagatgttcctcaggcccaatccgggatttgggatgtctgtgcgtgctgtggagcagagagtttgcaacatggtctcactttgtcacccaggctggaatgcattggcatgaacacgtctcactgcagcctcaacctcccaggctgaagtgaccctccaactctgctttcacagtagctgtgatatggtttggctgtgtccccacccacatctcatcttaaaacccagtgggaggtaattgaatcatgggggcaagtctttcctgtgctgttcttgtgatagtgaataagtctcatgagatctgatggtttttaaaagagttctggctgggcatggtggtgggcacctgtaatccaaactactagggaggctgaggcagagtgaattgcttgaacctgggagaaggaggttgcagtgagccgagattgcaccgctgcactccagcctgggcaaaattgaagactctgtctccaaaaaaaaaaaaaaggagttcctctgcataagctctctctctttgcctgctgccatccatgtaagatgtgacttgctcttccttgccctatgattgtgagtctttccccagccacgtggaactgtaagtccaaataaacctctttcttttgtaaa

SEQ ID NO: 37555 - DNA, 465 bp, Homo sapiens
cagtttctgcaaatgattgattgaattttcactttgaaaaaatatactttaaggtaatttttatataatttaagaaaacctacacccaattgtgttatgcatcattatgatcctgcctccagtaactgtgctgacagatggcttctcctctcatctttgtttaattgaggagtattctgagattgcaaagtgagctgttaaaagctgtttcctgctgcaactacttacagatgtttatcaggattttcaatactctgctaccaaaataatatatagaaattgattgggtgctaaaataagattattcctgtctccccttacatccaattttgaatgtttgcattaataatcgtattatccttcttgttttcattgattaactttttaaacaattttatatatttgaccatatgttagatttatatcaataaattacaaattgtgtctatttcatacaaaaaagtt

SEQ ID NO: 37556 - DNA, 160 bp, Homo sapiens
cagttgttttttgaaaagtgaatgagaaacatctcccatagtgagcttgatagcttcccagtatgtagacttttctcatggagtctgatattagagagtgtaattttccaatactggataatgaaatgtgtcaacatttggaatatttgtatacagtggt

SEQ ID NO: 37557 - DNA, 458 bp, Homo sapiens
aaaaaaaaactgtgctagaaccaacttattcatcatcatcttcatcttcctcctcttccttctttttcttgcttttttcagccttgacaactcacttttttgctgcatcaggctttcctttagctcactatgcagcaatatccttttcatatttttccttcagcttcacagccttttcataaggctgcttatcatctgcggcagtgcccttccacatctcttccaatttctttacaactcaccaatggtaggccgggatgttctgctttgatttttgggcgacactcagaatagaacaagaaaaaggccagaggaggcctcttgggtacattgggatcctcgaacttcttttttgtctcccatttaggaaggacataggttttcatttctctttcataatgggtcttgtccatctttgacatgtcttcaaatctcactttctctttagcagacatggt

SEQ ID NO: 37558 - DNA, 390 bp, Homo sapiens
  misc_feature (287)..(287): n is a, c, g, or t
taacttccaggggaaaaatctgtgattgacctggctgagaccttcgccccatacgcttctgggcatcccgagagatccaagactctggggtccatccggggagtggctgtggagcagctaagaggggaagtgggcattagacatgtcctctctggaaagaaaaaggtgaacacccaggagaagagctagcagggagaaggaggagcgggccaatcacgaaggagaaagtccttagatgggagccttctcattccttcagaaaccacactggtttaaattcagtgggntctttaacttttgggcttgcatattcgggcattcaccacagggaagttttcaaaaatttcccagttgccttgagttccccaccacagggtttttttggttggc

SEQ ID NO: 37559 - DNA, 359 bp, Homo sapiens
ccctaaaatgcttcctatatcagattttgtcactttaaatctgatactacttaatgctgtgcttcctaggctcggacagagcacacttctcaatagcattcctctctcggtttacttgctcctcacatcacatcccaggtccgttgactctggactccagggctccaccaaaacctcagtgtttgaatgcttgcactctccagcaaaatccctgatccgattctaccgttcagctatgcccctagccctgatgcctttcttcctacaccatacactcacaccgtggacttcagggccacttccaaactgggtcacattagcaaccctggatctcgaagactctcagcctgtcacttggg

SEQ ID NO: 37560 - DNA, 177 bp, Homo sapiens
acacatcagagattaagacaattactgaaatatttttcaatggtataactgccaatgaaatttagttatactgttgacaacaaaaaacacaagtcagttctttaaaaatgacccatttggagaggacattagagtattaccatgtaacactcattgagtcatttacaatatgaaaga

SEQ ID NO: 37561 - DNA, 650 bp, Homo sapiens
gtctcgaactcctggcctcaagcgatctgcccgcctcagcctcccaaagtgctgggattatagccatgagccactgcacccagcctaaagcacgattcttttttaggccctctcttaattagcccagtcatccctcaaccttagcgaatgggccagtgcagagagaggttgccttcacagattccccctgcctggtacaaagctcagtggacacaaagatgatttgatactgccttgtgccctctctgctgatcttaattaggttgctgcatggttttcaccaggccctaagcatgtgagaggaaagagagtcgtataaaaatgccctgtatttggaactggaaaactagtgagttccagtcctgtgaattttggcaaatcacccagaaccattaggacccttggtttctcatctgtaaaatggggataaagataccttgctctgccagcatcataagattgacatgaaaatcctgtgcagcatgtgctgtgtaagctgaagcttgacctttagtcatgaggagtctcgttttcatgtggcatgacccctgtgggcaccccttccccagggatctgccttattgcctacttatcttggggttatgttgaacccctctgtcctgcccacagttagaagtgaatttgctgtc

SEQ ID NO: 37562 - DNA, 363 bp, Homo sapiens
agtcttttatctcagggcagatcaggtcagcagctaggaatgaagacccttcactgacccgtccccaggcccacctcatccctgctgttgcaacatccctgctgtttcttaatcacagagtcccctaaaagacccagaatcaagaaccacccccccccccgcgtaaatgtcctattgccagaagagcaataggacaggggcatgggagccctctggaacccaagaccgcctagccccaaggtctgccctgggcccatggtgtgctggatgggctggggcaaactcttcagttctcaggaatcttgccagccagctgttaatcacggacattattaaaaattaaactaaacacacttacaatta

SEQ ID NO: 37563 - DNA, 476 bp, Homo sapiens
atggaatcaactgcccatcaatcaatgagtgaataaacatactgtggtatatatactatgaaatacgacgcagccataaaaaggaataaattaacagcatttgcagtgacctggatgtgtttggagactatttaattctaagtgaagtaactctggaatggaaaaacaaacattacaaggcataagaatgatacaatggacttttgggacttgaggggaaaagtgggagaggggcgagggataaaagaccgagtatggtgcagtgtatactccttgggtaatgggtgcaccaaaatcacacaaatcgccactaaagaacttatataaccaaatacctcctgtaccccaataacttatggaaaaataaaagtaataataataaataaagagaattgcaaaggtagtaagtaccaaattttcaagcaaagctataaattttatctaagttcataaacaaatttcttcaaaaaaaaaga

SEQ ID NO: 37564 - DNA, 402 bp, Homo sapiens
ggtgttgtgatccgcctgtctcagcctcccaaagggctgggattacaagtgtgacctaccgtgcccagtctcgctcactataagctctgcctcctgggttcatgccattctcctgcctcagcctcccgagtagctgggactacaggcatgagccactgcgcccggcctgtaaagtattttgttgactgaaaaccagaaaatgaaacctccaaaagcagaaattttgcaggtaataattaggagaatgcaggttgtggcatcagattgtgtaagtttgaattattgttccattattagttgaacattcttgggcagttcttaaactcaggcctgtaatcacaatattgtcacgaggtaattcatgtagacacggtgtctcacacggtgtcttggacattgtaa

SEQ ID NO: 37565 - DNA, 300 bp, Homo sapiens
ttatagaaaggacttccccaatccaaaattattaaagtgatcatctgttttcctttcagtatttcccttgaagtaaaccaatctcccagctgtttgtaagattgtttggcaatttatttagaagaaatctatgtcagaggatccaaatttaatatgcttttgctttgatttcagtaccaaaaagttagataattttgctatgacattatcttctcccttacaagttttgatatctgaatttataatgttcaaacttaagcccacttttcaacagattcagttacctttgaaactgtgtat

SEQ ID NO: 37566 - DNA, 423 bp, Homo sapiens
cgtgaaaaagaccaacataaattaggatgaagtggggtagaaagagcaaaaacagccttggggtaccccaagcacttgctttgtagggggcttacaagtgtgagccccagctttcctgcagccaactcacaaaaacacattggtcactgactccttcaatgtccatatggcacaagcaagctcatggcccagaatgtgcctggccaccacagcatctaccatcgagacagtgaccggacacgtagggcttgatcccgacatgattctcagcatggatggtggtggcccagcatggacagtgcagcaataacagtcctgctcctgggccagtgtggtgaagtccatgcccccagctcttacctgagctggcttgctccaggggagaggggaccaaagactaggcccttggttgcttttagagga

SEQ ID NO: 37567 - DNA, 344 bp, Homo sapiens
tgcctggggctttcctgctcctggtcctcagtgtcagtttcgctgtcactttctccaggaaggctgatgtccttagactaggctatgtgttctattgcattgctcctttaaagtaacattttaaatctttaaaaataacattcatctttaacatagttgctttttaaaaatcatctctcatggctgctcaattataacctcaaactgccatgccagagagcatatctgccttgtttactgatatggtttggctgtgtccccacccaaatctcatctttaattgtagttcccataatccccgtgtgtcatgggaggcacctggtgggaggtaattgaatcatggg

SEQ ID NO: 37568 - DNA, 367 bp, Homo sapiens
tttcctataaaacaaatctttcatttattccaacctgaactaatccaaaaaatgaagaattatgcattggctaaattacttcttcaaaggaatgcctaattttttcttccttagcaagtgacaggattgcatttaagtgatatcaatggtatcatgtccaactcagtcccaaaatgtttttgtatatccctacatacttacgctgtactcctttacatttatggtataatgccatcatttgggagtatgaatgggagaaggtatttgaggaaaaatgagttaggctcgttctctaatctatgggagctctttaatactacctctggcaagggccaagtaaatgactttaaattccactaaatttcat

SEQ ID NO: 37569 - DNA, 208 bp, Homo sapiens
attttgtagggaggcaacaaagttcagctctgaccttgcatttagccacagtctttggagagctgacattacctttactggtgctcctggttaccgtctgattaaatcatcctcctatcacagttattcaagcaaggcacgccaactggacttgttaatatttgaaagttttctttcatgtttcttaagtgttcaagatattacaagg

SEQ ID NO: 37570 - DNA, 389 bp, Homo sapiens
taagacagggtcttgctctgtcacgtaggttggagtgcagaggcacgatcacagctcacagcagccctgaccttctgggctcaagcaatccttctgtctcagcctcctaagcagctgggaccacctcccagggtgtttgccagctcattaaaaatttgtgtgtgtgtggagatggggtcttgctatgttccttaggcttgtctggtctggaactcctgggctcatacactcctctcgccccagcctcccaaaatactgggattacaagtgtgaaccactgcacctggcctacttttttaaaaatcaacttcctgtatgaagtcatttccaacaactttagcctattttaattcctccattctctgaaactccatcccaggttaatgttc

SEQ ID NO: 37571 - DNA, 134 bp, Homo sapiens
aaggccctccctgggcacgtgagccttcagggggctggtgggggagcgtgttgttgagttcctgccatggcaagaagtacccctcagagttcctctttggtcccatccagttgctagctttgccttggacagat

SEQ ID NO: 37572 - DNA, 467 bp, Homo sapiens
gggaaagatctcccacattgataaaagctggtggcttagctatgaagcaaagtcagatctctggaatcttgccaatgcccaaaactcaggccctggtgatatgagagttctgattctacgttccttcaaatatttgaagctagaggcaaactgaatcaaactaaaactgcagtgaagccccagtctagaattcatatacatcagattgagccaccattcaagtggcctgaaaaaaaaacaaagggcatgctctgttttggaagtaaacattttcttcaatttcttttttttttcaacataaaacgtccatcatccaatcaaatatacaagacgtgcaaaagcaagaaaataagattcatggtaagggagaggaagggctcaatagaagcagaactagaaaagacccagatgttgaattatcagtttggatccttaaaataactgattaaaaatgaaagaaaaaacag

SEQ ID NO: 37573 - DNA, 458 bp, Homo sapiens
gaatgaggaaaactaggtcacttgcttgtaccttaagtagcaaaagattctgatgcagtttttgcagcatgctttgatgagacaggactcaaaagatggaaaactacaagacataagagagcattttcaaaagatgttcagcagacacaaataattactgtacccatcgacacatgaatacgcagattgatgcagagagtctagtgcatagtacagtattctccttatttatcacccttacctttcacaccttgagcttgaagagtggaaatcagaaattatttcagtccaggatgctttccattacacctcctctatgtcaaaagttccagaatagagcaaatattcatgggcatatcaaggttttctttctggaatgtcccaatgaacttgtttgttttctggaaatgaccctctattatgtggtcctaaatgtttcctgctgtttttctacttgt

SEQ ID NO: 37574 - DNA, 596 bp, Homo sapiens
aacaaatctactgtcatcttaggaaaattgccagtgagaacctgacacttgaatagcctcaggccctaaagaccttgcaaggcagccactgtggatggcacatctgggttggaacccaccactgacatcagtcaatacagttgctaataacaagtttcaattttttgagtacttcctttaggtcagggcctgtgctacatgcttttcattgtgccatcttatttatcttcaaataatctactgagatagagattgctaaccccattttatagatgaagaaactgaggcaaagggaagctacataactcgctgcaggtcacaaagccagacagtgacaaagcaggggtgccaatgaattctgagtgactccagagctcaagctcctaagcattaggcaaaactgcctctcagttacaaaagagaagctggagtcaacaaacgtaaagacttctacaaggttctggtgagaacctcactgccattcactcaaggaaaaaaatatcacggccctggcatcaaactgtgtccctgtgctaggacactgggacctgtgaactacagaccatatttccattcttttatttatttattttttt

SEQ ID NO: 37575 - DNA, 648 bp, Homo sapiens
tatgtaatataatttaattctacattaagttccttctgggaaatatggattatttctataatagtttcctaattttctaggaagtggacagttcttgtgtaattataatttttatttgggggggttgaaatgtgttttgttatgtttagcagcatatttttgaattttggataggaaaggtaaacatcagaagaaatagaggttagcagataaaataactaaaattaaaattaaccttttcgtttcaactaatgatttgattattaaacttattaatgcacattaaaaactgacaggttttaaggccctacatgacttaacattttgcctaagatgaacaactgccctttaatcaattttcgggacaagggatagggtgttgataacacagcttaggtttttagcagactactcatttgttagtaataactttgggtgtaaacatgaatgtttttctttctaagttcccaaaggtaaacatttccttttttggttagttccatcatgggtcagctaaatagcttactgtggaaaagaaaaatacaagattcacattctcgttataacttaaggtacctttctagttattataaattagcatactgaggataatagattgtaagaagtggcctgttttagtactgaatt

SEQ ID NO: 37576 - DNA, 340 bp, Homo sapiens
ttactggggtaggggcatggacatggctggccatatgccctgaaagaggagcagggttctattgccttgatggcccccacagcgggtttgtatgtgccatgtcaccaggcctgagcatggagtttcaggtagagtcatgtcagaagtgacaatggcaggctgggcgtggtagctcactcctgtaatcccagcactttgggaggccaaggcaggcagatcacctgaggtcaggagttcgagaccagcctgaccaacatggtgaaaccccatctctactaaaaatacaaaattagctgtgtgtggtggtgtgcgcctgtagtcccacctacttgggcggcta

SEQ ID NO: 37577 - DNA, 492 bp, Homo sapiens
taaaaacagaaaaccttctagattacattatttacacaatccctaccaagctgggaaaccacaaagaagaattctgcggggcgatgataaactggagcattgctcttatcatagacttatcctggggtgtgtacctaccattgctcccaactgatcctgtggcttagtaggggctcattgccttctcattcagaaagtccgacatagagactgtcaggagaaaatcaacactgactgagctctggctccaccttgtgtctaaacctggtaaatggccagataaattggtgtattcagagtacctcatgaatcaatgcataaagcctggctggatggtatgtacctatagtcctagctactttggaggctgagggaggaggctcacttgagcccaagaatttggggctatagtgtactatgatcatgcctgtgagtaaccactgtacttcagcctaggcaacatagtgagactccatctcctttaaaaaaaaa

SEQ ID NO: 37578 - DNA, 471 bp, Homo sapiens
tcctgaccttgtgatccgcccacctcaacctcccaaagtgctaggattacaggcgtgagccaccacgcccagcaaaaaaaaaaaaaaaaaacaaaaaactaatggaatcattctcgacatccctttcttgcaacttaaacctacctttggccctatcttcaaaatatttcagaatccaaccacttctcaccattttcacaactaccaccttgacccaagccaccatcttttcccacctggattattgcaacagcctcctaattgggttaccttcatctattttacctaccccaaagtcagttctttacatagcaccaagagtgattcttttaaaacttaagttaaatgacctcattcctattcggataaccctctagcagcttcccatctcattaagagtaaaaataaaaatctttcagtggccttataaggcttcacatgagtggacctcatctcatttacttgcccttt

SEQ ID NO: 37579 - DNA, 415 bp, Homo sapiens
gttgtttgtctcctagtggcagttaatagtatatggttcttcattcctttttcattcaaacagctttcattgagtgcctacaaatgtgtgataagaagagctcagcttagtgtttagagactttctcacgttatgcaggcttcttacaaggtttggtggaccttgaaatccatttgcattttttggaggggtggggatggacagctctggcagaatttttatgccataaaaatggctgaagtaaatgttatctgtaatttttctcaagaaatgattgcttgatcaaacatacaataaatagatttttttacaaagcttaaaagaatctattcccagcccacccctctgtcttagctcgggaaataaacaaaaattaaaattacctgtaaacctcaggtgtgggtttgaagtatta

SEQ ID NO: 37580 - DNA, 449 bp, Homo sapiens
ctctactaaaattagatgggagtgaattgaagagggtaatggcagtccagtgtatatgtgggaactcaactcatagtactacctcaagaagtgggagctctattctcacattgccggtagtggaaactggaagcaagatgaagactcattatgggagctggtacagtgcagacccattctccctgtacccaccctggcctcccatctgtaagtcatgcatctgcaacaactatctccagacaggagcagcgtctcagaggtagagcaatgcctcaagtggctgacaataccagggagaaataaggagcgcttaagcctggaaaactagctgtggaggcgtcttttcttgtatcatactctacacatcttccagtcttactgaaaaacacatggagtgtaagttccaacatggtgaaaccccttctctactaaaattacaaaaaaaaaaa

SEQ ID NO: 37581 - DNA, 775 bp, Homo sapiens
ctctactaaaattagatgggagtgaattgaagagggtaatggcagtccagtgtatatgtgggaactcaactcatagtactacctcaagaagtgggagctctattctcacattgccggtagtggaaactggaagcaagatgaagactcattatgggagctggtacagtgcagacccattctccctgtacccaccctggcctcccatctgtaagtcatgcatctgcaacaactatctccagacaggagcagcgtctcagaggtagagcaatgcctcaagtggctgacaataccagggagaaataaggagcgcttaagcctggaaaactagctgtggaggcgtcttttcttgtatcatactctacacatcttccagtcttactgaaaaacacatggagtgtaagttccaacaatcaaatctgtacctccttcaactacaccctaactccaaggccagttactttctcaagtcaagaaagtttcattctaataggaatctcagtggaaaaaactgcacttatggtaaagaattttcacatacttgagtactctttgaaacagagtttaaagaaaacatcttcacttgaggaaacagctaacagaattggaacagacctttagaaatagcataatactgtcagctgggtgcagtgggtcacgcctgtaatcccagcactttgggaagccgaggcagatggatcacctgaggttaggagttcatgaccagcctggccaacatggtgaaaccccttctctactaaaattacaaaaaaaaaaa

SEQ ID NO: 37582 - DNA, 552 bp, Homo sapiens
ttgcctccgggaccagcgcttccaaattctctggggcgtcccggcgcgcacacgctcctgaggcctcggcgttctgaggaaaggggctggcgtggcgacccgggtcctcgaggccgagatctggctgtggcccgcgaagccccgcttgcccgcgccagcgtcttgtcaccccgagccgagggcctgcgcgcggccgacagatatgggatgctggaggacatctgggggccacaaatgctccttctcctggagacgcaactcaagttctcatggagttttcattgtctcgtgcaatgccatcgaccttgaatttcagcataggacccatatgaagtgccactgttaatgctgggagcactccaggaagcagagaaaagttatgacatttcaagaaaaatctgaattgcttgatatgttccacagattgaggtctgtacctatggttgcccactatttcaatagtcagtgtaaggactattgtaaaaaaaaaataaaataaaataaaggaaattggtgaagctgttgggggtgggggagaagtgcgcctgggtg

SEQ ID NO: 37583 - DNA, 332 bp, Homo sapiens
gtactcccgggcgctggcagcccacggggagggttcgcggcgcaggtgaacgcggaggtagaatcagacagggcagtgagtgcgcccggggctggatctggctcagccgctggtggattcggaacccgggaggcccccaggcccggtgggcttcagttcccacgctctgtaaaatggggcttggactggaattctagtgtccattgagattctgttgcagagcagccccctggctctgtgtgacctacgagttccttcctctgtaaaatacggaggctgagaccgatgatcctaacgtctcttcctacggtgcagtatgttacacactgctg

SEQ ID NO: 37584 - DNA, 521 bp, Homo sapiens
ttgcctccgggaccagcgcttccaaattctctggggcgtcccggcgcgcacacgctcctgaggcctcggcgttctgaggaaaggggctggcgtggcgacccgggtcctcgaggccgagatctggctgtggcccgcgaagccccgcttgcccgcgccagcgtcttgtcaccccgagccgagggcctgcgcgcggccgacagatatgggatgctggaggacatctgggggccacaaatgctccttctcctggagacgcaactcaagttctcatggagttttcattgtctcgtgcaatgccatcgaccttgaatttcagcataggacccatatgaagtgccactgttaatgctgggagcactccaggaagcagagaaaagttatgacatttcaagaaaaatctgaattgcttgatatgttccacagattgaggtctgtacctatggttgcccactatttcaatagtcagtgtaaggactattgtaaaaaaaaaataaaataaaataaaggaaattggtgaagct

SEQ ID NO: 37585 - DNA, 400 bp, Homo sapiens
cagagatgtcacttcaccagttttgtactcctaactccatctcagcctaaaattggcacaattggtaccagtggcccacgaacgtaggtggtaagacagcatttgcaggctgagtgactcactgtctggctggctcggaggcccccatccctggtggataggtggcacagacagtccctggcacaagaaggctgtccagtgatgaagacttcagatgaaatggcatgctggtgcaggggaacgcaatgactggtgggtgatttgggtgtctcaaatatgggaagggtggataaaagagacaaggacagtgggcttccatggttattgctgagttggattgacgtcctgcaagtggataatgaaaagctgaggtcaattaacaaacaaaactaagtgtgag

SEQ ID NO: 37586 - DNA, 353 bp, Homo sapiens
gacaagttatttctacaaggatactacgtgattccagtggtacaagtcgtggtgttggctttgctaggatggagtccagcctgggcaacattcatgagactgtatctctataaacaaacaaacaaacaaacaaataaaacagaaatagtggcacaacttactttgctacgtatttgggagaacgcatattagttaatcaaaatcatttgctgaaggttgtctacatgctgtataaacaagctagatagactctacctacatcaaatatgcaaaactagtgaaataattacagaagagtaaccatttgcttccaggctggcttcttcttccctggagagcaaattggagtttat

SEQ ID NO: 37587 - DNA, 967 bp, Homo sapiens
tttgagacgctctcgtcacccggcctggagtgcagtggtgtgatcacggctcaacctgctgggctcaagcagtcctcctgtctcagcttcctgagtagccgggtctatgctactgggtctacgcatggtgtgtgccaccatcccggctaattttttatgttttgtagagatggggtctcactatgttgcccaagctggtcttgaactcctgggctcaagcagtcctccaaccttggcctcccaaagtgctgagattacaggcaagagccaccatgcctggccttagatggtttttggagctggagttagataaggtttccccatctaaggcaattctctgctatacagattgggggctctactggcagttgtggtcctagggaggtagaatgcaaggcctgggatgagccatgctattccatggttctctaccagggtctgcactgttggtgacataaccacgcaacagaatcctgcatcaccatggaaaacctagttctggacggaggccttggaaggcttggagggcaacaaccacagaacactagtgctatgggctgaatacttttgtgttccctgctctgccaaagtcatatgctcaaatcccactccctggtttcactgtattagaaggtagagcccttgggaggggattaggtcatgagggtggactccttgtgaatggaataatgtgcttagaagagaccccatagagatccctggtcccttccatcatgtgaggacatagaagctggcagttgggccctcaccagacaccaaatctgctgatgtcttgcttctgaacttccagcctcgagaactgtgaagaatgaatttctgttgtttaaaaggtaatgggagttagttacagcagcctgaatggactgagccactagacagggaggagagcaccagctacagaaaaccttctgtcgcgatgagcctcgagaccccaattcctctctct

SEQ ID NO: 37588 - DNA, 429 bp, Homo sapiens
tcccacttcccatcatggatggcttcaactcagctcccgcagtattctggtcacctctcacccagagcacgtactgctctgaggttcctgccagctcgtctgtctgttctttaaagcatcctgaggagtggacaggccctgtttctgtgttgctgcagcggccagcatagacgagatatgcactatttcttgaaagaactgtaacgtccgatcgaggtggaagcactcacttgtgctttgatgcatctcccctccaaacacaacagtgaaaagcctcgagaactgtgaagaatgaatttctgttgtttaaaaggtaatgggagttagttacagcagcctgaatggactgagccactagacagggaggagagcaccagctacagaaaaccttctgtcgcgatgagcctcgagaccccaattcctctctct

SEQ ID NO: 37589 - DNA, 413 bp, Homo sapiens
actaggctggctttgtagccagacaatctgggttcaaattccagatttgactctactactatcgagttgtggaatcagaggcaagttgcttacccctcagaggctcagtttccacatctgtaagatgggaacaggacaagtacctggttgtgtagactaaaacatgaaaatgcatgcaaaatacattgtgcctcctctggcacaaagtaagcactcaataaatgactgttgttgctatttgaaattgtaccatttgtgctatgagcagatcagactagtcttttgagttgggaagttgtattgatgttaagaactttcatggggattgaaaatcggggatttagtctcttcaaatggcctcttttaatgtatatggaggaagggacagagggaagagtgagatttagacaagt

SEQ ID NO: 37590 - DNA, 2729 bp, Homo sapiens
gggaggatgcattggcggctgggatgaatttgagctgacggaaggaggcgttcggagaggaaagggaggaaaaggaaaggcgaccacagttcccatgatgcctggaggggagactacatttcccattattcccctggaagggacgtgaggatgaaagactgcaagtcccgcgatgctctcggctggcaggtggcggagattgcaccggaagacgcttcctgggtttgaggagttcagtgactgctattgaaccaccaaaagtccattatgaaactgtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaaggagctaaaggagtgctcgggtcatgtatttgtggattctgtgccggaattctgtttaccagagacggagctaatagatctgtctacagtagatgtgattctcatctctaactatcactgtatgatggcgctgccatacatcaccgagcacaccggcttcacaggcacagtgtatgccacggaacccaccgtccagatcggcaggcttctcatggaagagctggtgaatttcattgaaagagtgccaaaggctcagtctgcctccttgtggaagaataaggacattcagaggctgttaccttctcctctcaaggatgcagtggaagtctcaacctggagaagatgctatacaatgcaagaggtgaactctgcccttagtaaaatccagctggtgggatattctcagaaaattgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggctttgtcacaacaaacagagtaaggtgtatcttccagaaccaccttttcctcatgcagagctcattcagaccaataagctgaagcactaccccagcatccacggagacttcagcaacgactttagacagccctgtgtggtgttcaccgggcacccttccctccgcttcggggacgtggtccacttcatggagctctggggaaaatctagtctcaataccgtcatattcacggaaccagacttctcctacctggaagccctggctccttaccagccgctggccatgaaatgcatctactgccccatcgacacccggctgaacttcatccaggtgtcaaagctgcttaaagaagtgcagcccctgcacgtggtgtgtcctgagcagtacactcagccgcccccagcccagtcccacaggatggacctcatgatcgactgccagccccccgccatgtcctatcggcgggctgaggttctcgccctgcccttcaaacgtcggtacgagaagatcgagatcatgccagagctcgcagattcactggtgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaacttcaggctcattttcttctcaactctggctctctcaaggagctggagggtggcagaagtgggacaggagaagttttccaagaggttcatgggaggcggaggtgactggctggctgtcttgcatcagtcccaggcctcggccaggggagccagcctttggtttcgtttacttgcctacagtgctgtacgcaataagatgatgatcccaaaatatggtaaagtgaacccatctgtctgcattttctactctgagcccatttgttaataaacacttatttttatataa

SEQ ID NO: 37591 - DNA, 783 bp, Homo sapiens
  misc_feature (20)..(20): n is a, c, g, or t
  misc_feature (23)..(23): n is a, c, g, or t
tcggctggtagagccggggntanaaatgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggctttgtcacaacaaacagagtaaggtgtatcttccagaaccaccttttcctcatgcagagctcattcagaccaataagctgaagcactaccccagcatccacggagacttcagcaacgactttagacagccctgtgtggtgttcaccgggcacccttccctccgcttcggggacgtggtccacttcatggagctctggggaaaatctagtctcaataccgtcatattcacggaaccgacttctcctacctgggagcctggttcttacaggcgctggcctgaaatggtctatgcccttgaaccggtgaatctccagggtaggcgttag

SEQ ID NO: 37592 - DNA, 1182 bp, Homo sapiens
gggaggatgcattggcggctgggatgaatttgagctgacggaaggaggcgttcggagaggaaagggaggaaaaggaaaggcgaccacagttcccatgatgcctggaggggagactacatttcccattattcccctggaagggacgtgaggatgaaagactgcaagtcccgcgatgctctcggctggcaggtggcggagattgcaccggaagacgcttcctgggtttgaggagttcagtgactgctattgaaccaccaaaagtccattatgaaactgtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaaggtaatatctaagactacaaactaaagcctatctacagccagtggaaagctatcttctcataccagagccaccctgtagtagtgtgactgatggctttttttttttttcctctctgaaaatccccaagatctatgctagggtcttcagaacatggtaactgctgtttttaagcatgtttttagagaatgtcattgttctgattcagatccattttgctcatgtgtagaaatctaagtacttctgctgcaaataccttttatcaccacagaaagacaactattatttctagaattgcaatgagtgtttcaaagacaaggctttttaaagaattcaatccagttcattttgtgattgcaaagagtaaaacctttttttgaataacttttaaaatcctcaagcaggtgagttttaaactgcttctatcaagggtcagatcaggtagggctttgtaaaaagcttgggtcttttttgggtaatgagaggccacagaaggttacagaaggacagtggcattgtcagatcggatcactctggccactgtgtggggaacggtccaggagcagagtgtttgacttccccagcagtgccttcttgtgcaggggacagtactcttaggtaaatttgagtagtgggtctccgacactatgatctgtgatcccgtttcaacctgtcctgatagcctagaatggacaatctttatagatgattaaaaaaaaa

SEQ ID NO: 37593 - DNA, 2803 bp, Homo sapiens
gggaggatgcattggcggctgggatgaatttgagctgacggaaggaggcgttcggagaggaaagggaggaaaaggaaaggcgaccacagttcccatgatgcctggaggggagactacatttcccattattcccctggaagggacgtgaggatgaaagactgcaagtcccgcgatgctctcggctggcaggtggcggagattgcaccggaagacgcttcctgggtttgaggagttcagtgactgctattgaaccaccaaaagtccattatgaaactgtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaaggagctaaaggagtgctcgggtcatgtatttgtggattctgtgccggaattctgtttaccagagacggagctaatagatctgtctacagtagatgtgattctcatctctaactatcactgtatgatggcgctgccatacatcaccgagcacaccggcttcacaggcacagtgtatgccacggaacccaccgtccagatcggcaggcttctcatggaagagctggtgaatttcattgaaagagtgccaaaggctcagtctgcctccttgtggaagaataaggacattcagaggctgttaccttctcctctcaaggatgcagtggaagtctcaacctggagaagatgctatacaatgcaagaggtgaactctgcccttagtaaaatccagctggtgggatattctcagaaaattgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggctttgtcacaacaaacagagtaaggtgtatcttccagaaccaccttttcctcatgcagagctcattcagaccaataagctgaagcactaccccagcatccacggagacttcagcaacgactttagacagccctgtgtggtgttcaccgggcacccttccctccgcttcggggacgtggtccacttcatggagctctggggaaaatctagtctcaataccgtcatattcacggaaccagacttctcctacctggaagccctggctccttaccagccgctggccatgaaatgcatctactgccccatcgacacccggctgaacttcatccaggtgtcaaagctgcttaaagaagtgcagcccctgcacgtggtgtgtcctgagcagtacactcagccgcccccagcccagtcccacaggatggacctcatgatcgactgccagccccccgccatgtcctatcggcgggctgaggttctcgccctgcccttcaaacgtcggtacgagaagatcgagatcatgccagagctcgcagattcactggtgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaacttcaggctcattttcttctcaactctggctctctcaaggagctggagggtggcagaagtgggacaggagaagttttccaagaggttcatgggaggcggaggtgactggctggctgtcttgcatcagtcccaggcctcggccaggggagccagcctttggtttcgtttacttgcctacagtgctgtacgcaataagatgatgatcccaaaatatggtaaagtgaacccatctgtctgcattttctactctgagcccatttgttaataaacacttatttttatataaaaaacacgcccacccccccaaccaccacaaaaaggggggcgccaaaaaaacccccgggggccccataccccccc

SEQ ID NO: 37594 - DNA, 2608 bp, Homo sapiens
gggaggatgcattggcggctgggatgaatttgagctgacggaaggaggcgttcggagaggaaagggaggaaaaggaaaggcgaccacagttcccatgatgcctggaggggagactacatttcccattattcccctggaagggacgtgaggatgaaagactgcaagtcccgcgatgctctcggctggcaggtggcggagattgcaccggaagacgcttcctgggtttgaggagttcagtgactgctattgaaccaccaaaagtccattatgaaactgtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaaggagctaaaggagtgctcgggtcatgtatttgtggattctgtgccggaattctgtttaccagagacggagctaatagatctgtctacagtagatgtgattctcatctctaactatcactgtatgatggcgctgccatacatcaccgagcacaccggcttcacaggcacagtgtatgccacggaacccaccgtccagatcggcaggcttctcatggaagagctggtgaatttcattgaaagagtgccaaaggctcagtctgcctccttgtggaagaataaggacattcagaggagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggctttgtcacaacaaacagagtaaggtgtatcttccagaaccaccttttcctcatgcagagctcattcagaccaataagctgaagcactaccccagcatccacggagacttcagcaacgactttagacagccctgtgtggtgttcaccgggcacccttccctccgcttcggggacgtggtccacttcatggagctctggggaaaatctagtctcaataccgtcatattcacggaaccagacttctcctacctggaagccctggctccttaccagccgctggccatgaaatgcatctactgccccatcgacacccggctgaacttcatccaggtgtcaaagctgcttaaagaagtgcagcccctgcacgtggtgtgtcctgagcagtacactcagccgcccccagcccagtcccacaggatggacctcatgatcgactgccagccccccgccatgtcctatcggcgggctgaggttctcgccctgcccttcaaacgtcggtacgagaagatcgagatcatgccagagctcgcagattcactggtgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaacttcaggctcattttcttctcaactctggctctctcaaggagctggagggtggcagaagtgggacaggagaagttttccaagaggttcatgggaggcggaggtgactggctggctgtcttgcatcagtcccaggcctcggccaggggagccagcctttggtttcgtttacttgcctacagtgctgtacgcaataagatgatgatcccaaaatatggtaaagtgaacccatctgtctgcattttctactctgagcccatttgttaataaacacttatttttatataa

SEQ ID NO: 37595 - DNA, 2207 bp, Homo sapiens
tacctgccaccacacctggctaatttttgtatttttagtagagacagggtttttccatgttggtcaggctggtctcgaactcctgacctcaagttacctggccgccttggggcctcccaaagtgctgggattataggcgtgagccaccgcgcctggcccagattccttttttatgtgctttctcaacactgtgttcttttccttcttaagacatttgggaatgtggtcacactttttgtgagttttaactcttgcattagagccccaagaaagcaggtcatgacttttttgcccactcttatatcctaaacacttagcatgttgctttgcgaaatagtagttgctcagaacattgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggctttgtcacaacaaacagagtaaggtgtatcttccagaaccaccttttcctcatgcagagctcattcagaccaataagctgaagcactaccccagcatccacggagacttcagcaacgactttagacagccctgtgtggtgttcaccgggcacccttccctccgcttcggggacgtggtccacttcatggagctctggggaaaatctagtctcaataccgtcatattcacggaaccagacttctcctacctggaagccctggctccttaccagccgctggccatgaaatgcatctactgccccatcgacacccggctgaacttcatccaggtgtcaaagctgcttaaagaagtgcagcccctgcacgtggtgtgtcctgagcagtacactcagccgcccccagcccagtcccacaggatggacctcatgatcgactgccagccccccgccatgtcctatcggcgggctgaggttctcgccctgcccttcaaacgtcggtacgagaagatcgagatcatgccagagctcgcagattcactggtgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaacttcaggctcattttcttctcaactctggctctctcaaggagctggagggtggcagaagtgggacaggagaagttttccaagaggttcatgggaggcggaggtgactggctggctgtcttgcatcagtcccaggcctcggccaggggagccagcctttggtttcgtttacttgcctacagtgctgtacgcaataagatgatgatcccaaaatatggtaaagtgaacccatctgtctgcattttctactctgagcccatttgttaataaacacttatttttatataa

SEQ ID NO: 37596 - DNA, 2066 bp, Homo sapiens
catttggatcaaatggacaaattactagaaaggaatgctgtagaacatgaagaaatgttcacctggtagttgacattgtgatccatttgcaggctgttaccttctcctctcaaggatgcagtggaagtctcaacctggagaagatgctatacaatgcaagaggtgaactctgcccttagtaaaatccagctggtgggatattctcagaaaattgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggctttgtcacaacaaacagagtaaggtgtatcttccagaaccaccttttcctcatgcagagctcattcagaccaataagctgaagcactaccccagcatccacggagacttcagcaacgactttagacagccctgtgtggtgttcaccgggcacccttccctccgcttcggggacgtggtccacttcatggagctctggggaaaatctagtctcaataccgtcatattcacggaaccagacttctcctacctggaagccctggctccttaccagccgctggccatgaaatgcatctactgccccatcgacacccggctgaacttcatccaggtgtcaaagctgcttaaagaagtgcagcccctgcacgtggtgtgtcctgagcagtacactcagccgcccccagcccagtcccacaggatggacctcatgatcgactgccagccccccgccatgtcctatcggcgggctgaggttctcgccctgcccttcaaacgtcggtacgagaagatcgagatcatgccagagctcgcagattcactggtgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaacttcaggctcattttcttctcaactctggctctctcaaggagctggagggtggcagaagtgggacaggagaagttttccaagaggttcatgggaggcggaggtgactggctggctgtcttgcatcagtcccaggcctcggccaggggagccagcctttggtttcgtttacttgcctacagtgctgtacgcaataagatgatgatcccaaaatatggtaaagtgaacccatctgtctgcattttctactctgagcccatttgttaataaacacttatttttatataa

SEQ ID NO: 37597 - DNA, 1703 bp, Homo sapiens
ttctaggttcccgggtctgtaccaggcctctccactgtgaagtcagtttttcccattgtattaaatcagtaccttgtgggggactctttgaaactatatacatattctgttctccctcaaaatggtatctgatatttttagcatttgttgatgattttcatctgaataagtgatgaactgtaatggttgccaaacggtggttttggtttttatttcatcgtttgtttcttggcatttcgttgtaaaaagagctttcttttctcccccacatatgtatttctccctcatttacctcatctgcctctgctgaagcttggagcccacccacagggtccatcccagcctgcccctccttccacggggcccctttgacctccgtcccccacgtgtgcttcctggctccctcctgaccccctgactgtctgtgggccctcagcgccccagttgctgtctggcttggcagctcctgtgtagtctgcattgtaagatttctttcttgtactttccctagaaccagacttctcctacctggaagccctggctccttaccagccgctggccatgaaatgcatctactgccccatcgacacccggctgaacttcatccaggtgtcaaagctgcttaaagaagtgcagcccctgcacgtggtgtgtcctgagcagtacactcagccgcccccagcccagtcccacaggatggacctcatgatcgactgccagccccccgccatgtcctatcggcgggctgaggttctcgccctgcccttcaaacgtcggtacgagaagatcgagatcatgccagagctcgcagattcactggtgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaacttcaggctcattttcttctcaactctggctctctcaaggagctggagggtggcagaagtgggacaggagaagttttccaagaggttcatgggaggcggaggtgactggctggctgtcttgcatcagtcccaggcctcggccaggggagccagcctttggtttcgtttacttgcctacagtgctgtacgcaataagatgatgatcccaaaatatggtaaagtgaacccatctgtctgcattttctactctgagcccatttgttaataaacacttatttttatataa

SEQ ID NO: 37598 - DNA, 2555 bp, Homo sapiens
gggaggatgcattggcggctgggatgaatttgagctgacggaaggaggcgttcggagaggaaagggaggaaaaggaaaggcgaccacagttcccatgatgcctggaggggagactacatttcccattattcccctggaagggacgtgaggatgaaagactgcaagtcccgcgatgctctcggctggcaggtggcggagattgcaccggaagacgcttcctgggtttgaggagttcagtgactgctattgaaccaccaaaagtccattatgaaactgtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaaggagctaaaggagtgctcgggtcatgtatttgtggattctgtgccggaattctgtttaccagagacggagctaatagatctgtctacagtagatgtgattctcatctctaactatcactgtatgatggcgctgccatacatcaccgagcacaccggcttcacaggcacagtgtatgccacggaacccaccgtccagatcggcaggcttctcatggaagagctggtgaatttcattgaaagagtgccaaaggctcagtctgcctccttgtggaagaataaggacattcagaggctgttaccttctcctctcaaggatgcagtggaagtctcaacctggagaagatgctatacaatgcaagaggtgaactctgcccttagtaaaatccagctggtgggatattctcagaaaattgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggctttgtcacaacaaacagagtaaggtgtatcttccagaaccaccttttcctcatgcagagctcattcagaccaataagctgaagcactaccccagcatccacggagacttcagcaacgactttagacagccctgtgtggtgttcaccgggcacccttccctccgcttcggggacgtggtccacttcatggagctctggggaaaatctagtctcaataccgtcatattcacggaaccagacttctcctacctggaagccctggctccttaccagccgctggccatgaaatgcatctactgccccatcgacacccggctgaacttcatccaggtgtcaaagctgcttaaagaagtgcagcccctgcacgtggtgtgtcctgagcagtacactcagccgcccccagcccagtcccacaggatggacctcatgatcgactgccagccccccgccatgtcctatcggcgggctgaggttctcgccctgcccttcaaacgtcggtacgagaagatcgagatcatgccagagctcgcagattcactggtgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaaggtgagctggtttcgctggtgccgtgaaaactccacacgtggcagcctttccctggctcactatggccccctggctgcagggagtggatgttgctgcttgtcacttagtccccactgtcctgtggcatctgtttggtctaaggtcctgctgggagacccaggagaaagaaagcagagtgaggagtgccccatccttcctcccagcacgaggtcaccagaaggcctctccagactgaagaaaaagctgcttccacacacacatgtgacgagtggggcagggtagtgaggccaggacaaagagggacccggccctgccagagtcttgcacttccacagatgactccttgctgtcagaggggagccaagtctccagtcgactgtcaggatttgcaggaggcagtcgggggaggggacactggcccttcccctctgtctcagcagccctgatggctgcttctcccagagatgagatttcttgactatgattaa

SEQ ID NO: 37599 - DNA, 1404 bp, Homo sapiens
gggaggatgcattggcggctgggatgaatttgagctgacggaaggaggcgttcggagaggaaagggaggaaaaggaaaggcgaccacagttcccatgatgcctggaggggagactacatttcccattattcccctggaagggacgtgaggatgaaagactgcaagtcccgcgatgctctcggctggcaggtggcggagattgcaccggaagacgcttcctgggtttgaggagttcagtgactgctattgaaccaccaaaagtccattatgaaactgtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaaggagctaaaggagtgctcgggtcatgtatttgtggattctgtgccggaattctgtttaccagagacggagctaatagatctgtctacagtagatgtgattctcatctctaactatcactgtatgatggcgctgccatacatcaccgagcacaccggcttcacaggcacagtgtatgccacggaacccaccgtccagatcggcaggcttctcatggaagagctggtgaatttcattgaaagagtgccaaaggctcagtctgcctccttgtggaagaataaggacattcagaggctgttaccttctcctctcaaggatgcagtggaagtctcaacctggagaagatgctatacaatgcaagaggtgaactctgcccttagtaaaatccagctggtgggatattctcagaaaattgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggtatgtccgtggtttttttttttgtgtgtgaattttatttgattcaggacattcaagcagtaagaataaaaataatcctgttttttctcaaaaaaaaaag

SEQ ID NO: 37600 - DNA, 966 bp, Homo sapiens
cggcatggtgcaagcagctgagcgtcccagactcctgaacacagtgcttggacgtgccctcaaagaactcacaaaagcttagccaggttgtggaaattctgttgttttgcatgagcttttgcatgtttagggtctcttttcaagtataagaaactatcactatcataggcctatgactagtctgaagaattgtgttgagacgtgtcagtttctagaaagttcagtcgagtctgtgaagtgtcatttacagatctcacagatgtgcagtctgcccagcccacctctttcttttcttctggagcagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaacttcaggctcattttcttctcaactctggctctctcaaggagctggagggtggcagaagtgggacaggagaagttttccaagaggttcatgggaggcggaggtgactggctggctgtcttgcatcagtcccaggcctcggccaggggagccagcctttggtttcgtttacttgcctacagtgctgtacgcaataagatgatgatcccaaaatatggtaaagtgaacccatctgtctgcattttctactctgagcccatttgttaataaacacttatttttatataa

SEQ ID NO: 37601 - DNA, 996 bp, Homo sapiens
gggaggatgcattggcggctgggatgaatttgagctgacggaaggaggcgttcggagaggaaagggaggaaaaggaaaggcgaccacagttcccatgatgcctggaggggagactacatttcccattattcccctggaagggacgtgaggatgaaagactgcaagtcccgcgatgctctcggctggcaggtggcggagattgcaccggaagacgcttcctgggtttgaggagttcagtgactgctattgaaccaccaaaagtccattatgaaactgtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaaggagctaaaggagtgctcgggtcatgtatttgtggattctgtgccggaattctgtttaccagagacggagctaatagatctgtctacagtagatgtgattctcatctctaactatcactgtatgatggcgctgccatacatcaccgagcacaccggcttcacaggcacagtgtatgccacggaacccaccgtccagatcggcaggcttctcatggaagagctggtgaatttcattgaaagagtgccaaaggctcagtctgcctccttgtggaagaataaggacattcagaggctgttaccttctcctctcaaggatgcagtggaagtctcaacctggagaagatgctatacaatgcaagaggtgaactctgcccttagtaaaatccagctggtgggatattctcagaaaattcttgggagctccacttggtcatccaggctcattctaggaaaggggctatggtcttggacctccttggttacacacacacccaggccatgcccagcttttttaaacaaggtggttttgtta

SEQ ID NO: 37602 - DNA, 2666 bp, Homo sapiens
gggaggatgcattggcggctgggatgaatttgagctgacggaaggaggcgttcggagaggaaagggaggaaaaggaaaggcgaccacagttcccatgatgcctggaggggagactacatttcccattattcccctggaagggacgtgaggatgaaagactgcaagtcccgcgatgctctcggctggcaggtggcggagattgcaccggaagacgcttcctgggtttgaggagttcagtgactgctattgaaccaccaaaagtccattatgaaactgtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaagacggagctaatagatctgtctacagtagatgtgattctcatctctaactatcactgtatgatggcgctgccatacatcaccgagcacaccggcttcacaggcacagtgtatgccacggaacccaccgtccagatcggcaggcttctcatggaagagctggtgaatttcattgaaagagtgccaaaggctcagtctgcctccttgtggaagaataaggacattcagaggctgttaccttctcctctcaaggatgcagtggaagtctcaacctggagaagatgctatacaatgcaagaggtgaactctgcccttagtaaaatccagctggtgggatattctcagaaaattgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggctttgtcacaacaaacagagtaaggtgtatcttccagaaccaccttttcctcatgcagagctcattcagaccaataagctgaagcactaccccagcatccacggagacttcagcaacgactttagacagccctgtgtggtgttcaccgggcacccttccctccgcttcggggacgtggtccacttcatggagctctggggaaaatctagtctcaataccgtcatattcacggaaccagacttctcctacctggaagccctggctccttaccagccgctggccatgaaatgcatctactgccccatcgacacccggctgaacttcatccaggtgtcaaagctgcttaaagaagtgcagcccctgcacgtggtgtgtcctgagcagtacactcagccgcccccagcccagtcccacaggatggacctcatgatcgactgccagccccccgccatgtcctatcggcgggctgaggttctcgccctgcccttcaaacgtcggtacgagaagatcgagatcatgccagagctcgcagattcactggtgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaacttcaggctcattttcttctcaactctggctctctcaaggagctggagggtggcagaagtgggacaggagaagttttccaagaggttcatgggaggcggaggtgactggctggctgtcttgcatcagtcccaggcctcggccaggggagccagcctttggtttcgtttacttgcctacagtgctgtacgcaataagatgatgatcccaaaatatggtaaagtgaacccatctgtctgcattttctactctgagcccatttgttaataaacacttatttttatataa

SEQ ID NO: 37603 - DNA, 1880 bp, Homo sapiens
  misc_feature (20)..(20): n is a, c, g, or t
  misc_feature (23)..(23): n is a, c, g, or t
tcggctggtagagccggggntanaaatgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggctttgtcacaacaaacagagtaaggtgtatcttccagaaccaccttttcctcatgcagagctcattcagaccaataagctgaagcactaccccagcatccacggagacttcagcaacgactttagacagccctgtgtggtgttcaccgggcacccttccctccgcttcggggacgtggtccacttcatggagctctggggaaaatctagtctcaataccgtcatattcacggaaccagacttctcctacctggaagccctggctccttaccagccgctggccatgaaatgcatctactgccccatcgacacccggctgaacttcatccaggtgtcaaagctgcttaaagaagtgcagcccctgcacgtggtgtgtcctgagcagtacactcagccgcccccagcccagtcccacaggatggacctcatgatcgactgccagccccccgccatgtcctatcggcgggctgaggttctcgccctgcccttcaaacgtcggtacgagaagatcgagatcatgccagagctcgcagattcactggtgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaacttcaggctcattttcttctcaactctggctctctcaaggagctggagggtggcagaagtgggacaggagaagttttccaagaggttcatgggaggcggaggtgactggctggctgtcttgcatcagtcccaggcctcggccaggggagccagcctttggtttcgtttacttgcctacagtgctgtacgcaataagatgatgatcccaaaatatggtaaagtgaacccatctgtctgcattttctactctgagcccatttgttaataaacacttatttttatataa

SEQ ID NO: 37604 - DNA, 2861 bp, Homo sapiens
gggaggatgcattggcggctgggatgaatttgagctgacggaaggaggcgttcggagaggaaagggaggaaaaggaaaggcgaccacagttcccatgatgcctggaggggagactacatttcccattattcccctggaagggacgtgaggatgaaagactgcaagtcccgcgatgctctcggctggcaggtggcggagattgcaccggaagacgcttcctgggtttgaggagttcagtgactgctattgaaccaccaaaagtccattatgaaactgtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaaggagctaaaggagtgctcgggtcatgtatttgtggattctgtgccggaattctgtttaccagagacggagctaatagatctgtctacagtagatgtgattctcatctctaactatcactgtatgatggcgctgccatacatcaccgagcacaccggcttcacaggcacagtgtatgccacggaacccaccgtccagatcggcaggcttctcatggaagagctggtgaatttcattgaaagagtgccaaaggctcagtctgcctccttgtggaagaataaggacattcagaggctgttaccttctcctctcaaggatgcagtggaagtctcaacctggagaagatgctatacaatgcaagaggtgaactctgcccttagtaaaatccagctggtgggatattctcagaaaattgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggctttgtcacaacaaacagagtaaggtgtatcttccagaaccaccttttcctcatgcagagctcattcagaccaataagctgaagcactaccccagcatccacggagacttcagcaacgactttagacagccctgtgtggtgttcaccgggcacccttccctccgcttcggggacgtggtccacttcatggagctctggggaaaatctagtctcaataccgtcatattcacggaaccagacttctcctacctggaagccctggctccttaccagccgctggccatgaaatgcatctactgccccatcgacacccggctgaacttcatccaggtgtcaaagctgcttaaagaagtgcagcccctgcacgtggtgtgtcctgagcagtacactcagccgcccccagcccagtcccacaggatggacctcatgatcgactgccagccccccgccatgtcctatcggcgggctgaggttctcgccctgcccttcaaacgtcggtacgagaagatcgagatcatgccagagctcgcagattcactggtgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcccacgagcgggaagaagagaaagcgggtgagcgatgacgtaccagactgcaaagtcctgaagcctttgttgagcggttccatccctgtggagcagttcgtgcagaccctggagaagcatggcttcagtgatattaaggtggaggacacagccaagggccatatcgtcctgctccaggaggctgagacgctcatccagattgaagaagactcgacccatatcatctgcaggagaagttttccaagaggttcatgggaggcggaggtgactggctggctgtcttgcatcagtcccaggcctcggccaggggagccagcctttggtttcgtttacttgcctacagtgctgtacgcaataagatgatgatcccaaaatatggtaaagtgaacccatctgtctgcattttctactctgagcccatttgttaataaacacttatttttatataa

SEQ ID NO: 37605 - DNA, 1240 bp, Homo sapiens
cagacacatggaagttaccgtgaaacttatgtaaacagtaagaaagataaattaagctgaggcagtttaggggtttccgagatgtttcttctgccccagtgccttcacgttccctctcctgtctacggttcattgggcttgagaggatgaaagttcaccttggcctggaagtgcccctgcacgtggtgtgtcctgagcagtacactcagccgcccccagcccagtcccacaggatggacctcatgatcgactgccagccccccgccatgtcctatcggcgggctgaggttctcgccctgcccttcaaacgtcggtacgagaagatcgagatcatgccagagctcgcagattcactggtgcccatggagatcaagcctggcatctccttggcaactgtctcggccgtgctgcacaccaaagataacaagcacttgcttcagccccctcctcggcccgcccagcccacgagcgggaagaagagaaagcgggtgagcgatgacgtaccagactgcaaagtcctgaagcctttgttgagcggttccatccctgtggagcagttcgtgcagaccctggagaagcatggcttcagtgatattaaggtggaggacacagccaagggccatatcgtcctgctccaggaggctgagacgctcatccagattgaagaagactcgacccatatcatctgcgacaatgacgagatgctcagagtgcgactgcgggaccttgtcctcaaattcttacagaagttctgagtgggccatctgagctacttccctgaaatcctgcagtccctcactggctgccctcacaagccacctgaggagtggcatgagaggccattaactgtgtctttgtggtgtcctctggcttaaggagtgaagaggtggctcttgagggaaatggtctggacttattcccagcactgtttcaggcaagaactttccctttcaacttcaggctcattttcttctcaactctggctctctcaaggagctggagggtggcagaagtgggacaggagaagttttccaagaggttcatgggaggcggaggtgactggctggctgtcttgcatcagtcccaggcctcggccaggggagccagcctttggtttcgtttacttgcctacagtgctgtacgcaataagatgatgatcccaaaatatggtaaagtgaacccatctgtctgcattttctactctgagcccatttgttaataaacacttatttttatataa

SEQ ID NO: 37606 - DNA, 2083 bp, Homo sapiens
gggaggatgcattggcggctgggatgaatttgagctgacggaaggaggcgttcggagaggaaagggaggaaaaggaaaggcgaccacagttcccatgatgcctggaggggagactacatttcccattattcccctggaagggacgtgaggatgaaagactgcaagtcccgcgatgctctcggctggcaggtggcggagattgcaccggaagacgcttcctgggtttgaggagttcagtgactgctattgaaccaccaaaagtccattatgaaactgtattgcctgtcagggcacccaaccttaccatgcaatgtgctcaaattcaaatcaaccaccattatgttggactgcggactggacatgacttctaccctcaatttccttcctttgccacttgttcaaagtcccaggctgtccaatcttcctggctggtccctgaaggatggaaatgctttcttggacaaggagctaaaggagtgctcgggtcatgtatttgtggattctgtgccggaattctgtttaccagagacggagctaatagatctgtctacagtagatgtgattctcatctctaactatcactgtatgatggcgctgccatacatcaccgagcacaccggcttcacaggcacagtgtatgccacggaacccaccgtccagatcggcaggcttctcatggaagagctggtgaatttcattgaaagagtgccaaaggctcagtctgcctccttgtggaagaataaggacattcagaggctgttaccttctcctctcaaggatgcagtggaagtctcaacctggagaagatgctatacaatgcaagaggtgaactctgcccttagtaaaatccagctggtgggatattctcagaaaattgagctttttggtgcggtccaggtgactcctctgagctctggctatgcccttgggagctccaactggatcatccagtctcattacgagaaagtgtcttatgtctctggatcctccttgcttaccacacacccccagcccatggaccaagcttctctcaaaaacagcgatgttcttgttctgacagggcttacccagatccccactgcaaacccagatggaatggtgggagagttctgcagcaacctagctctgacagtccggaatggaggaaacgtgttggttccctgctacccttctggagtgatctatgacctcctggagtgcctatatcagtacatcgactcagccgggctttccagcgtccccctctacttcatctcccctgtggccaacagttcactggagttttcccagatctttgctgagtggctttgtcacaacaaacagagtaaggtgtatcttccagaaccaccttttcctcatgcagagctcattcagaccaataagctgaagcactaccccagcatccacggagacttcagcaacgactttagacagccctgtgtggtgttcaccgggcacccttccctccgcttcggggacgtggtccacttcatggagctctggggaaaatctagtctcaataccgtcatattcacgggtaagtgaaaaaaataaagaaacaaattggttctctccactgaggccatgagtgaatgcacctacaaggtagagacccagggaaggattttgcagtgagacataaatacaaacattattctactgtaggtaccaaagaatgaagaaaccgcagagaaagagtgaagcagtgtgtgccattggacagctgggcatccagcgaggccttcatgcctgtgttttcagatttctccaagacagaatcctgctgagtgcttttgctaggatatcgtaagccatttcaagaagtgcagtgattcagtaacggtcttgttttacctgttaggaattgtttacagaggtagatctttttcttctgattgtggtttactctaactgtggattttcttctggagacaaatccctcaggggaaaaaattcctttgataaggtcaagtagagtgtttacatagataatgactgtatcattttatcagtgtagcgtgcccagccctttgaatgctaggtttttttttttttttttttagctcatcagtcatcattagtg

SEQ ID NO: 37607 - DNA, 221 bp, Homo sapiens
ggagtgagctggaaaggttattctgcagcacttacatttcttgaaatcagtttgtagcagtgcccacttctttgagatgaattttttcagaacatgatttacatagtccagcctgccctttcccttggcttgacatgtacatcttctgttcctccccctccgatctcaccagccactaatttagctgatttctcaccaaactgatttgtgcagtgctcctc

SEQ ID NO: 37608 - DNA, 465 bp, Homo sapiens
taaccatttaaactactactccatactttataatatggaaaactttacactttttattttagatgtgctttatttttgcagatgctaacaacaaaactgtgttctttaaaaaatctctaagcgctggaaaatatcaatagatcagattttgaattgaaatggataagctaaatacattcagttttactcatgggacagtgcttaagtgtgtgaagatccaaatttgctttgaagagttgtagtaaacaagaaataagtaatgtgtgggtataatttcttctcaaatctacgcctgcattttattagttgtgatacaataatatttcaaaaatagaatagtgattcttacttttaaacttatatactttctacctcttctatgaatttctacctcactttattataatattaaatattacaacatgcaaaaatgcatcagtggaaggctactttcaaccagtgttt

SEQ ID NO: 37609 - DNA, 465 bp, Homo sapiens
gaggacctagatattgagttttaaaaggagaaaatataagtacaaaagaagaatgaagattgttacaacaggggcaagtagaagttagaagaaaatgtgataaagtaaatctacattttagaatagtactggaagttattatcaggtgttacagacaagtttgagacttccgtaagtgacctaaagaaattatggacactgcaagactaaataatcattcatttaggaaggagcttaaatgcactttctcaaggccgggcgaggtggctcacgcctgtaatcccagcactttgggaggccaaggtgggcagatcacgaggtcaggtgatcgagaccatcgtgggtaacacggtgaaaccccgtctctactaaaaaatacaaaaaaaaattagccgggcacggtggcgggcgccttagtcccatctactcgggaggctgaggcaggagaatggcgtgaacccggga

SEQ ID NO: 37610 - DNA, 368 bp, Homo sapiens
atgctgctgaacgtgctgccacaccacacaggcctcaacctccgcaccttccggatgctgcgtgtggacctccgcaccctccagaatgctgtgctgcaagctgcacggggagctgctcaaccgctacctgtacctgagcaccatggagcagcaagctggccaagaagatcagcaccatatccgacatcatcctggatgacttgctggagacagatggcgtcactgcccacttctagctccatggatgtcgctgccaccaccacaccgcactacctcccaccaccttttttgaacaaaacacaaggaatatatactttctggaagaccatctgatactatgtatcaagaatctcaaaaatattcatata

SEQ ID NO: 37611 - DNA, 332 bp, Homo sapiens
tgtgtcttcagggtacaaggccccgcggggactgagcactcaagtcttcctggcctggtctggtttcagggcttccagcggctgaaggctgcccacgcggccctagaggaggagtacctgaaggcttgtcgggagcaacaccctgcccagccgcttgccggctccaaggggacgcctggaagatttgatcctcgcaggtacctgctggggtggaaggcctggaaggacagatgggatgggcccctggggtccctcagtctccaggagggaggcactttgtccttataattgtacacggggccttgtagagaaatcttatcctaattagtata

SEQ ID NO: 37612 - DNA, 714 bp, Homo sapiens
gaggctggtctcagcttggaaggccatggaaacaccagccccatggctcttgggcatggtcaggccaggggctgggtggcttctggcgaacaagccagtggggacaaactttctgaacattccgaggtcaacccatccgttgaactcagcccggcaaggtcctggagcagtgggacagtgagcctcgaccaccctagtgacagccttgattctacctgggaaggagagaccgatggcccccagcccactgccctggcagaaaccttgccagagggccccagccaccacctcctaagcccagatggcagaactggaggcagtgttgctcgggcaacccccatggaattccaggactcctcagctcccccagcccagagtccgcagcatgccacagatagatggaggagagaaacgaccagattcttctgccctcagcccaaggaacacatcatggtccccttcagtacctcacgcatggtccccagcttctcctaggatcccagtggcatttatcagtggccagctacctgccaggcccgggctggggcacggtctgcggccatgaggccaggccgcctcccgcacccctaccccgtggcagcagcatacctctgcatttctggaatgtgtgtgcatcaatgatgtttgtatatttgaggcatttaaaaatctattttcgttacgagggcaaatgaagaatgaatattgatctta

SEQ ID NO: 37613 - DNA, 4772 bp, Homo sapiens
gaggctggtctcagcttggaaggccatggaaacaccagccccatggctcttgggcatggtcaggccaggggctgggtggcttctggcgaacaagccagtggggacaaactttctgaacattccgaggtcaacccatccgttgaactcagcccggcaaggtcctggagcagtgggacagtgagcctcgaccaccctagtgacagccttgattctacctgggaaggagagaccgatggcccccagcccactgccctggcagaaaccttgccagagggccccagccaccacctcctaagcccagatggcagaactggaggcagtgttgctcgggcaacccccatggaattccaggactcctcagctcccccagcccagagtccgcagcatgccacagatagatggaggagagaaacgaccagattcttctgccctcagcccaaggaacacatctggaagcagacaaagacgtcacctaagccactcccttcccgattcattggctccatcagccccctgaatccccagcccaggccaacgcggcagggcaggccgctgcccagacagggagccactctggctggccgctcctcttctaatgcccccaagtatggccgggggcagttgaactacccactccctgatttctccaaggtagggccccgggtgagattccccaaagatgagagctaccgtccccccaagtccagaagccacaacaggaagcctcaggcccctgccaggcccctcatcttcaagtctccagctgagattgtgcaggaggtgctgttgagcagtggagaagcagccctggcaaaggacacgcctcctgcccaccctatcaccagggtaccccaagaatttcagacgcctgagcaagccactgagctggtccatcagctccaggaagactaccacaggctcctcaccaagtacgctgaggccgagaacaccattgaccagctacgcctcggggccaaggtgaacctgttctctgacccaccccagcccaaccacagcatccacacgggaatggtgccccaggggaccaaggtcttgtccttcaccatcccacagccccgctctgcagagtggtggccgggcccggccgaggacccccaggcctctgcggcctcagggtggccatcagctcgaggagacttgagcccctcctcgcttaccagcatgcccaccctggggtggcttccggagaaccgggacatctctgaggaccagtcctcagcagagcagacccaggcactggcttctcaggccagccagttcctggccaaggtggagtcctttgaaagactgatacaggcaggacgtctcatgccccaggaccaagtcaagggcttccagcggctgaaggctgcccacgcggccctagaggaggagtacctgaaggcttgtcgggagcaacaccctgcccagccgcttgccggctccaaggggacgcctggaagatttgatcctcgcagggagctggaggcagagatataccgtctgggaagctgcctggaagagctgaaggaacacatagaccagacccagcaagagcctgagccgcccgggtcagactcagctctggacagcaccccagccctgccctgcctccatcagccaacgcacctgcctgctccttctggacaagcccccatgccagccatcaagacctcctgccctgagcctgctaccaccactgccgccgccagcactggcccctgcccattgcacgtaaatgtggaggtgagctctggcaacagtgaggtggaggacaggccacaggaccccctggcccgactcaggcacaaggagctgcagatggagcaagtttaccatggcctcatggagcggtacctcagtgtgaagtctctcccagaagccatgagaatggaggaggaggaagaaggagaggaggaggaggaggaagaggggggaggtgactccctggaagttgatggggtggctgcaactccagggaaagcagaggccaccagggtcctcccaaggcagtgcccggtgcaggctgagaaaagtcatggggctcccctggaggaggccacggagaagatggtatctatgaagccaccaggtttccaggcatccctggctagagacgggcacatgtcaggcctgggcaaggctgaggcagcccctccaggccctggcgtgccaccccaccctccaggcaccaagtccgcagcatcccaccaaagtagtatgaccagcctggagggaagcggcatctctgagcgccttccacagaagcctttgcaccgaggcggtgggccccacctggaggagacctggatggcgtccccagagacagacagtggctttgtgggctcagaaacaagcagagtttcacccctcacccagactccagagcaccggctctcccacatcagcacagcaggaacattagcccagccctttgctgcatctgtgcccagggatggagcttcctaccccaaggccaggggttctctgattcccagaagagccacagagcccagcacaccccggagccaagcacagaggtacctctccagcccaagtgggcctctccggcagagggcacccaacttcagcctggagcggacactggcagccgagatggcggttcctggctcagagtttgaggggcacaaacggatttctgaacagccccttcccaacaagacaatcagcccacccccagcccccgcccctgccgctgcgcctctaccctgtggaccaacagagaccatccccagcttcctgctcaccagggcagggcgagaccaggccatctgtgagctgcaagaagaggtgtcccggcttcgtctgcggctggaagacagcctgcaccagccactccagggcagcccgacacgcccagcatctgcctttgaccgccccgcccggacccgcggccggccagcagactccccagccacctggggctcccattatggcagtaaatccacagagagattgcctggtgagcctagaggtgaagagcagattgtccctccaggaaggcagcgagccaggtcttcctcagtgcctcgggaggtgctccgactgtccctgagttcagaatctgagctgccctccctaccactgttctctgagaagagcaagaccaccaaggacagtccacaggcagctcgggatggaaagagaggggtgggcagtgctggatggccagacagggtcaccttccggggccaatacacaggccacgaataccatgttctgtcccctaaggcggtcccaaaaggcaatggcacagtctcctgtccccactgccggcccattaggacccaggatgcgggtggtgctgtcacaggggacccactgggaccgcctcccgctgatacccttcagtgtcccctgtgtggtcaagttgggtctcccccagaggcagatggtccaggctcagccacctctggggcagagaaggccaccacgaggagaaaagcaccttcaactcccagccccaagcagaggagcaagcaggcggggtcgtcgccacgcccaccccccggactgtggtatctggcaacagcgcccccagcaccagcccctccagcctttgcctacatctcctcggttcccatcatgccttatccacctgccgctgtgtactatgcgcctgcaggacctacctcagcccaaccagctgccaagtggccgcccacagcctctcccccaccagcccggagacaccggcactccatccagctcgacctgggcgacctagaggagctcaacaaggccctgagccgggccgtgcaggctgccgagagcgtccgctctaccaccaggcagatgagaagctcgctgtcagccgacctgcgccaggctcacagcctgcggggctcctgcctcttctgacttcactgggggcccagaggcagatgggtgggtgggtgggcaggtggcctgccaggccaggagtgggctggagctgctgaggcccagaaggcccgcatagttcctcaccaggagggtctccctccagcacaggtcccgcctgctcagtccctgtgctttccaagtggagggggtgtcagctcggtcaccaagagaagtgacttcccaggagcaccagtcccctcacagaggtgctgtgagcgaggcctccttcggtccaggcagaacctcaggcagtctctcctggtcctgcatgtgtgcaactccagctaataataggtattttatatacagatggacagatatttttttaaactggggagttttcctgatcttgggtcctctttagggggccagacaagaaaggcctacggtttctggagcaaacctgtcccccacctgtgaccagtcactctggggcaagcatcactgggaagggcatagccggagacctttctcctagtgactggtagtcagtggggcattttaggatgtcagggccccagggtgacatgtgtccagcttttctatggcagcagaggcctttccctcagacaagctacaaagtgcccaggatgccatccaccatggtccccttcagtacctcacgcatggtccccagcttctcctaggatcccagtggcatttatcagtggccagctacctgccaggcccgggctggggcacggtctgcggccatgaggccaggccgcctcccgcacccctaccccgtggcagcagcatacctctgcatttctggaatgtgtgtgcatcaatgatgtttgtatatttgaggcatttaaaaatctattttcgttacgagggcaaatgaagaatgaatattgatctta

SEQ ID NO: 37614 - DNA, 4816 bp, Homo sapiens
gaggctggtctcagcttggaaggccatggaaacaccagccccatggctcttgggcatggtcaggccaggggctgggtggcttctggcgaacaagccagtggggacaaactttctgaacattccgaggtcaacccatccgttgaactcagcccggcaaggtcctggagcagtgggacagtgagcctcgaccaccctagtgacagccttgattctacctgggaaggagagaccgatggcccccagcccactgccctggcagaaaccttgccagagggccccagccaccacctcctaagcccagatggcagaactggaggcagtgttgctcgggcaacccccatggaattccaggactcctcagctcccccagcccagagtccgcagcatgccacagatagatggaggagagaaacgaccagattcttctgccctcagcccaaggaacacatctggaagcagacaaagacgtcacctaagccactcccttcccgattcattggctccatcagccccctgaatccccagcccaggccaacgcggcagggcaggccgctgcccagacagggagccactctggctggccgctcctcttctaatgcccccaagtatggccgggggcagttgaactacccactccctgatttctccaaggtagggccccgggtgagattccccaaagatgagagctaccgtccccccaagtccagaagccacaacaggaagcctcaggcccctgccaggcccctcatcttcaagtctccagctgagattgtgcaggaggtgctgttgagcagtggagaagcagccctggcaaaggacacgcctcctgcccaccctatcaccagggtaccccaagaatttcagacgcctgagcaagccactgagctggtccatcagctccaggaagactaccacaggctcctcaccaagtacgctgaggccgagaacaccattgaccagctacgcctcggggccaaggtgaacctgttctctgacccaccccagcccaaccacagcatccacacgggaatggtgccccaggggaccaaggtcttgtccttcaccatcccacagccccgctctgcagagtggtggccgggcccggccgaggacccccaggcctctgcggcctcagggtggccatcagctcgaggagacttgagcccctcctcgcttaccagcatgcccaccctggggtggcttccggagaaccgggacatctctgaggaccagtcctcagcagagcagacccaggcactggcttctcaggccagccagttcctggccaaggtggagtcctttgaaagactgatacaggcaggacgtctcatgccccaggaccaagtcaagggcttccagcggctgaaggctgcccacgcggccctagaggaggagtacctgaaggcttgtcgggagcaacaccctgcccagccgcttgccggctccaaggggacgcctggaagatttgatcctcgcagggagctggaggcagagatataccgtctgggaagctgcctggaagagctgaaggaacacatagaccagacccagcaagagcctgagccgcccgggtcagactcagctctggacagcaccccagccctgccctgcctccatcagccaacgcacctgcctgctccttctggacaagcccccatgccagccatcaagacctcctgccctgagcctgctaccaccactgccgccgccagcactggcccctgcccattgcacgtaaatgtggaggtgagctctggcaacagtgaggtggaggacaggccacaggaccccctggcccgactcaggcacaaggagctgcagatggagcaagtttaccatggcctcatggagcggtacctcagtgtgaagtctctcccagaagccatgagaatggaggaggaggaagaaggagaggaggaggaggaggaagaggggggaggtgactccctggaagttgatggggtggctgcaactccagggaaagcagaggccaccagggtcctcccaaggcagtgcccggtgcaggctgagaaaagtcatggggctcccctggaggaggccacggagaagatggtatctatgaagccaccaggtttccaggcatccctggctagagacgggcacatgtcaggcctgggcaaggctgaggcagcccctccaggccctggcgtgccaccccaccctccaggcaccaagtccgcagcatcccaccaaagtagtatgaccagcctggagggaagcggcatctctgagcgccttccacagaagcctttgcaccgaggcggtgggccccacctggaggagacctggatggcgtccccagagacagacagtggctttgtgggctcagaaacaagcagagtttcacccctcacccagactccagagcaccggctctcccacatcagcacagcaggaacattagcccagccctttgctgcatctgtgcccagggatggagcttcctaccccaaggccaggggttctctgattcccagaagagccacagagcccagcacaccccggagccaagcacagaggtacctctccagcccaagtgggcctctccggcagagggcacccaacttcagcctggagcggacactggcagccgagatggcggttcctggctcagagtttgaggggcacaaacggatttctgaacagccccttcccaacaagacaatcagcccacccccagcccccgcccctgccgctgcgcctctaccctgtggaccaacagagaccatccccagcttcctgctcaccagggcagggcgagaccaggccatctgtgagctgcaagaagaggtgtcccggcttcgtctgcggctggaagacagcctgcaccagccactccagggcagcccgacacgcccagcatctgcctttgaccgccccgcccggacccgcggccggccagcagactccccagccacctggggctcccattatggcagtaaatccacagagagattgcctggtgagcctagaggtgaagagcagattgtccctccaggaaggcagcgagccaggtcttcctcagtgcctcgggaggtgctccgactgtccctgagttcagaatctgagctgccctccctaccactgttctctgagaagagcaagaccaccaaggacagtccacaggcagctcgggatggaaagagaggggtgggcagtgctggatggccagacagggtcaccttccggggccaatacacaggccacgaataccatgttctgtcccctaaggcggtcccaaaaggcaatggcacagtctcctgtccccactgccggcccattaggacccaggatgcgggtggtgctgtcacaggggacccactgggaccgcctcccgctgatacccttcagtgtcccctgtgtggtcaagttgggtctcccccagaggcagatggtccaggctcagccacctctggggcagagaaggccaccacgaggagaaaagcaccttcaactcccagccccaagcagaggagcaagcaggcggggtcgtcgccacgcccaccccccggactgtggtatctggcaacagcgcccccagcaccagcccctccagcctttgcctacatctcctcggttcccatcatgccttatccacctgccgctgtgtactatgcgcctgcaggacctacctcagcccaaccagctgccaagtggccgcccacagcctctcccccaccagcccggagacaccggcactccatccagctcgacctgggcgacctagaggagctcaacaaggccctgagccgggccgtgcaggctgccgagagcgtccgctctaccaccaggcagatgagaagctcgctgtcagccgacctgcgccaggctcacagcctgcggggctcctgcctcttctgacttcactgggggcccagaggcagatgggtgggtgggtgggcaggtggcctgccaggccaggagtgggctggagctgctgaggcccagaaggcccgcatagttcctcaccaggagggtctccctccagcacaggtcccgcctgctcagtccctgtgctttccaagtggagggggtgtcagctcggtcaccaagagaagtgacttcccaggagcaccagtcccctcacagaggtgctgtgagcgaggcctccttcggtccaggcagaacctcaggcagtctctcctggtcctgcatgtgtgcaactccagctaataataggtattttatatacagatggacagatatttttttaaactggggagttttcctgatcttgggtcctctttagggggccagacaagaaaggcctacggtttctggagcaaacctgtcccccacctgtgaccagtcactctggggcaagcatcactgggaagggcatagccggagacctttctcctagtgactggtagtcagtggggcattttaggatgtcagggccccagggtgacatgtgtccagcttttctatggcagcagaggcctttccctcagacaagctacaaagtgcccaggatgccatccaccatggtccccttcagtacctcacgcatggtccccagcttctcctaggatcccagtggcatttatcagtggccagctacctgccaggcccgggctggggcacggtctgcggccatgaggccaggccgcctcccgcacccctaccccgtggcagcagcatacctctgcatttctggaatgtgtgtgcatcaatgatgtttgtatatttgaggcatttaaaaatctattttcgttacgagggcaaatgaagaatgaatattgatcttaaaaaaagaaaagaagacaaaaaaaatacccaaagccaaacgtgt

SEQ ID NO: 37615 - DNA, 2102 bp, Homo sapiens
ctggggcacagccaggaagaggcctccactccttctgacacagtcatctgagcgctcatgtctgctggaggcggcaccaggggatactcacccaggagtccaggggccaccagccaggccatctgtgagctgcaagaagaggtgtcccggcttcgtctgcggctggaagacagcctgcaccagccactccagggcagcccgacacgcccagcatctgcctttgaccgccccgcccggacccgcggccggccagcagactccccagccacctggggctcccattatggcagtaaatccacagagagattgcctggtgagcctagaggtgaagagcagattgtccctccaggaaggcagcgagccaggtcttcctcagtgcctcgggaggtgctccgactgtccctgagttcagaatctgagctgccctccctaccactgttctctgagaagagcaagaccaccaaggacagtccacaggcagctcgggatggaaagagaggggtgggcagtgctggatggccagacagggtcaccttccggggccaatacacaggccacgaataccatgttctgtcccctaaggcggtcccaaaaggcaatggcacagtctcctgtccccactgccggcccattaggacccaggatgcgggtggtgctgtcacaggggacccactgggaccgcctcccgctgatacccttcagtgtcccctgtgtggtcaagttgggtctcccccagaggcagatggtccaggctcagccacctctggggcagagaaggccaccacgaggagaaaagcaccttcaactcccagccccaagcagaggagcaagcaggcggggtcgtcgccacgcccaccccccggactgtggtatctggcaacagcgcccccagcaccagcccctccagcctttgcctacatctcctcggttcccatcatgccttatccacctgccgctgtgtactatgcgcctgcaggacctacctcagcccaaccagctgccaagtggccgcccacagcctctcccccaccagcccggagacaccggcactccatccagctcgacctgggcgacctagaggagctcaacaaggccctgagccgggccgtgcaggctgccgagagcgtccgctctaccaccaggcagatgagaagctcgctgtcagccgacctgcgccaggctcacagcctgcggggctcctgcctcttctgacttcactgggggcccagaggcagatgggtgggtgggtgggcaggtggcctgccaggccaggagtgggctggagctgctgaggcccagaaggcccgcatagttcctcaccaggagggtctccctccagcacaggtcccgcctgctcagtccctgtgctttccaagtggagggggtgtcagctcggtcaccaagagaagtgacttcccaggagcaccagtcccctcacagaggtgctgtgagcgaggcctccttcggtccaggcagaacctcaggcagtctctcctggtcctgcatgtgtgcaactccagctaataataggtattttatatacagatggacagatatttttttaaactggggagttttcctgatcttgggtcctctttagggggccagacaagaaaggcctacggtttctggagcaaacctgtcccccacctgtgaccagtcactctggggcaagcatcactgggaagggcatagccggagacctttctcctagtgactggtagtcagtggggcattttaggatgtcagggccccagggtgacatgtgtccagcttttctatggcagcagaggcctttccctcagacaagctacaaagtgcccaggatgccatccaccatggtccccttcagtacctcacgcatggtccccagcttctcctaggatcccagtggcatttatcagtggccagctacctgccaggcccgggctggggcacggtctgcggccatgaggccaggccgcctcccgcacccctaccccgtggcagcagcatacctctgcatttctggaatgtgtgtgcatcaatgatgtttgtatatttgaggcatttaaaaatctattttcgttacgagggcaaatgaagaatgaatattgatctta

SEQ ID NO: 37616 - DNA, 1316 bp, Homo sapiens
gccctggatgtgtgcccattattcccattttagaggtaaagaaactgagacccagagagtaggagccactggcccagctgggatttagaagggggttgaccccacacacggtgctcctcggcttgtccccagccctccccatgtgtaacgagcccactcacttctctcctcaggtactatgcgcctgcaggacctacctcagcccaaccagctgccaagtggccgcccacagcctctcccccaccagcccggagacaccggcactccatccagctcgacctgggcgacctagaggagctcaacaaggccctgagccgggccgtgcaggctgccgagagcgtccgctctaccaccaggcagatgagaagctcgctgtcagccgacctgcgccaggctcacagcctgcggggctcctgcctcttctgacttcactgggggcccagaggcagatgggtgggtgggtgggcaggtggcctgccaggccaggagtgggctggagctgctgaggcccagaaggcccgcatagttcctcaccaggagggtctccctccagcacaggtcccgcctgctcagtccctgtgctttccaagtggagggggtgtcagctcggtcaccaagagaagtgacttcccaggagcaccagtcccctcacagaggtgctgtgagcgaggcctccttcggtccaggcagaacctcaggcagtctctcctggtcctgcatgtgtgcaactccagctaataataggtattttatatacagatggacagatatttttttaaactggggagttttcctgatcttgggtcctctttagggggccagacaagaaaggcctacggtttctggagcaaacctgtcccccacctgtgaccagtcactctggggcaagcatcactgggaagggcatagccggagacctttctcctagtgactggtagtcagtggggcattttaggatgtcagggccccagggtgacatgtgtccagcttttctatggcagcagaggcctttccctcagacaagctacaaagtgcccaggatgccatccaccatggtccccttcagtacctcacgcatggtccccagcttctcctaggatcccagtggcatttatcagtggccagctacctgccaggcccgggctggggcacggtctgcggccatgaggccaggccgcctcccgcacccctaccccgtggcagcagcatacctctgcatttctggaatgtgtgtgcatcaatgatgtttgtatatttgaggcatttaaaaatctattttcgttacgagggcaaatgaagaatgaatattgatctta

SEQ ID NO: 37617 - DNA, 1031 bp, Homo sapiens
gaggctggtctcagcttggaaggccatggaaacaccagccccatggctcttgggcatggtcaggccaggggctgggtggcttctggcgaacaagccagtggggacaaactttctgaacattccgaggtcaacccatccgttgaactcagcccggcaaggtcctggagcagtgggacagtgagcctcgaccaccctagtgacagccttgattctacctgggaaggagagaccgatggcccccagcccactgccctggcagaaaccttgccagagggccccagccaccacctcctaagcccagatggcagaactggaggcagtgttgctcgggcaacccccatggaattccaggactcctcagctcccccagcccagagtccgcagcatgccacagatagatggaggagagaaacgaccagattcttctgccctcagcccaaggaacacatctggaagcagacaaagacgtcacctaagccactcccttcccgattcattggctccatcagccccctgaatccccagcccaggccaacgcggcagggcaggccgctgcccagacagggagccactctggctggccgctcctcttctaatgcccccaagtatggccgggggcagttgaactacccactccctgatttctccaaggtagggccccgggtgagattccccaaagatgagagctaccgtccccccaagtccagaagccacaacaggaagcctcaggcccctgccaggcccctcatcttcaagtctccagctgagattgtgcaggaggtgctgttgagcagtggagaagcagccctggcaaaggacacgcctcctgcccaccctatcaccagggtaccccaagaatttcagacgcctgagcaagccactgagctggtccatcagctccaggaagactaccacaggctcctcaccaagtacgctgaggccgagaacaccattgaccagctacgcctcggggccaaggtgaacctgttttcggaaccccccccacactgggtaccgaagactcgaattcg

SEQ ID NO: 37618 - DNA, 296 bp, Homo sapiens
tgggttagcatgtggaggggctcagatgctgccgcctgagtgtctcactctgtgtgacccctgtgtgtcccttcctccacggtcccccagcacagcaggaacattagcccagccctttgctgcatctgtgcccagggatggagcttcctaccccaaggccaggggttctctgattcccagaagagccacagagcccagcacaccccggagccaagcacagaggtacctctccagcccaagtgggcctctccggcagagggcacccaacttcagcctggagcggacactggcagccg

SEQ ID NO: 37619 - DNA, 931 bp, Homo sapiens
  misc_feature (822)..(822): n is a, c, g, or t
gccctggatgtgtgcccattattcccattttagaggtaaagaaactgagacccagagagtaggagccactggcccagctgggatttagaagggggttgaccccacacacggtgctcctcggcttgtccccagccctccccatgtgtaacgagcccactcacttctctcctcaggtactatgcgcctgcaggacctacctcagcccaaccagctgccaagtggccgcccacagcctctcccccaccagcccggagacaccggcactccatccagctcgacctgggcgacctagaggagctcaacaaggccctgagccgggccgtgcaggctgccgagagcgtccgctctaccaccaggcagatgagaagctcgctgtcagccgacctgcgccaggctcacagcctgcggggctcctgcctcttctgacttcactgggggcccagaggcagatgggtgggtgggtgggcaggtggcctgccaggccaggagtgggctggagctgctgaggcccagaaggcccgcatagttcctcaccaggagggtctccctccagcacaggtcccgcctgctcagtccctgtgctttccaagtggagggggtgtcagctcggtcaccaagagaagtgacttcccaggagcaccagtcccctcacagaggtgctgtgagcgaggcctccttcggtccaggcagaacctcaggcagtctctcctggtcctgcatgtgtgcaactccagctaataataggtattttatatacagatggacagatatttttttaaactggggagttttcctgatcttgggtcctctttagggggcganagaagctcggtttgggaaccggcccccgggacgcctcgggcagctccggaggtgcgcactccctgaggccggttggtggccggtgtccttggaggctccaaaggcgcca

SEQ ID NO: 37620 - DNA, 666 bp, Homo sapiens
gaggctggtctcagcttggaaggccatggaaacaccagccccatggctcttgggcatggtcaggccaggggctgggtggcttctggcgaacaagccagtggggacaaactttctgaacattccgaggtcaacccatccgttgaactcagcccggcaaggtcctggagcagtgggacagtgagcctcgaccaccctagtgacagccttgattctacctgggaaggagagaccgatggcccccagcccactgccctggcagaaaccttgccagagggccccagccaccacctcctaagcccagatggcagaactggaggcagtgttgctcgggcaacccccatggaattccaggactcctcagctcccccagcccagagtccgcagcatgccacagatagatggaggagagaaacgaccagattcttctgccctcagcccaaggaacacatctggggcacggtctgcggccatgaggccaggccgcctcccgcacccctaccccgtggcagcagcatacctctgcatttctggaatgtgtgtgcatcaatgatgtttgtatatttgaggcatttaaaaatctattttcgttacgagggcaaatgaagaatgaatattgatcttaaaaaaagaaaagaagacaaaaaaaatacccaaagccaaacgtgt

SEQ ID NO: 37621 - DNA, 2895 bp, Homo sapiens
cacgaggagtgccttgccctaggtcacacagctagaaggtggcagaaccaggctgggcagccagggatgtctgactccagagcttgtgccctgggctgcttggctcccaggacaggccaacccctgcgtcagggctgcctggcagaactcaaggatggtcttctcttcccatgccagggaggccacggagaagatggtatctatgaagccaccaggtttccaggcatccctggctagagacgggcacatgtcaggcctgggcaaggctgaggcagcccctccaggccctggcgtgccaccccaccctccaggcaccaagtccgcagcatcccaccaaagtagtatgaccagcctggagggaagcggcatctctgagcgccttccacagaagcctttgcaccgaggcggtgggccccacctggaggagacctggatggcgtccccagagacagacagtggctttgtgggctcagaaacaagcagagtttcacccctcacccagactccagagcaccggctctcccacatcagcacagcaggaacattagcccagccctttgctgcatctgtgcccagggatggagcttcctaccccaaggccaggggttctctgattcccagaagagccacagagcccagcacaccccggagccaagcacagaggtacctctccagcccaagtgggcctctccggcagagggcacccaacttcagcctggagcggacactggcagccgagatggcggttcctggctcagagtttgaggggcacaaacggatttctgaacagccccttcccaacaagacaatcagcccacccccagcccccgcccctgccgctgcgcctctaccctgtggaccaacagagaccatccccagcttcctgctcaccagggcagggcgagaccaggccatctgtgagctgcaagaagaggtgtcccggcttcgtctgcggctggaagacagcctgcaccagccactccagggcagcccgacacgcccagcatctgcctttgaccgccccgcccggacccgcggccggccagcagactccccagccacctggggctcccattatggcagtaaatccacagagagattgcctggtgagcctagaggtgaagagcagattgtccctccaggaaggcagcgagccaggtcttcctcagtgcctcgggaggtgctccgactgtccctgagttcagaatctgagctgccctccctaccactgttctctgagaagagcaagaccaccaaggacagtccacaggcagctcgggatggaaagagaggggtgggcagtgctggatggccagacagggtcaccttccggggccaatacacaggccacgaataccatgttctgtcccctaaggcggtcccaaaaggcaatggcacagtctcctgtccccactgccggcccattaggacccaggatgcgggtggtgctgtcacaggggacccactgggaccgcctcccgctgatacccttcagtgtcccctgtgtggtcaagttgggtctcccccagaggcagatggtccaggctcagccacctctggggcagagaaggccaccacgaggagaaaagcaccttcaactcccagccccaagcagaggagcaagcaggcggggtcgtcgccacgcccaccccccggactgtggtatctggcaacagcgcccccagcaccagcccctccagcctttgcctacatctcctcggttcccatcatgccttatccacctgccgctgtgtactatgcgcctgcaggacctacctcagcccaaccagctgccaagtggccgcccacagcctctcccccaccagcccggagacaccggcactccatccagctcgacctgggcgacctagaggagctcaacaaggccctgagccgggccgtgcaggctgccgagagcgtccgctctaccaccaggcagatgagaagctcgctgtcagccgacctgcgccaggctcacagcctgcggggctcctgcctcttctgacttcactgggggcccagaggcagatgggtgggtgggtgggcaggtggcctgccaggccaggagtgggctggagctgctgaggcccagaaggcccgcatagttcctcaccaggagggtctccctccagcacaggtcccgcctgctcagtccctgtgctttccaagtggagggggtgtcagctcggtcaccaagagaagtgacttcccaggagcaccagtcccctcacagaggtgctgtgagcgaggcctccttcggtccaggcagaacctcaggcagtctctcctggtcctgcatgtgtgcaactccagctaataataggtattttatatacagatggacagatatttttttaaactggggagttttcctgatcttgggtcctctttagggggccagacaagaaaggcctacggtttctggagcaaacctgtcccccacctgtgaccagtcactctggggcaagcatcactgggaagggcatagccggagacctttctcctagtgactggtagtcagtggggcattttaggatgtcagggccccagggtgacatgtgtccagcttttctatggcagcagaggcctttccctcagacaagctacaaagtgcccaggatgccatccaccatggtccccttcagtacctcacgcatggtccccagcttctcctaggatcccagtggcatttatcagtggccagctacctgccaggcccgggctggggcacggtctgcggccatgaggccaggccgcctcccgcacccctaccccgtggcagcagcatacctctgcatttctggaatgtgtgtgcatcaatgatgtttgtatatttgaggcatttaaaaatctattttcgttacgagggcaaatgaagaatgaatattgatctta

SEQ ID NO: 37622 - DNA, 1300 bp, Homo sapiens
gcggccgcccccggggagcccggcgggcgccggcgcgcccccccccacgcccaccccccggactgtggtatctggcaacagcgcccccagcaccagcccctccagcctttgcctacatctcctcggttcccatcatgccttatccacctgccgctgtgtactatgcgcctgcaggacctacctcagcccaaccagctgccaagtggccgcccacagcctctcccccaccagcccggagacaccggcactccatccagctcgacctgggcgacctagaggagctcaacaaggccctgagccgggccgtgcaggctgccgagagcgtccgctctaccaccaggcagatgagaagctcgctgtcagccgacctgcgccaggctcacagcctgcggggctcctgcctcttctgacttcactgggggcccagaggcagatgggtgggtgggtgggcaggtggcctgccaggccaggagtgggctggagctgctgaggcccagaaggcccgcatagttcctcaccaggagggtctccctccagcacaggtcccgcctgctcagtccctgtgctttccaagtggagggggtgtcagctcggtcaccaagagaagtgacttcccaggagcaccagtcccctcacagaggtgctgtgagcgaggcctccttcggtccaggcagaacctcaggcagtctctcctggtcctgcatgtgtgcaactccagctaataataggtattttatatacagatggacagatatttttttaaactggggagttttcctgatcttgggtcctctttagggggccagacaagaaaggcctacggtttctggagcaaacctgtcccccacctgtgaccagtcactctggggcaagcatcactgggaagggcatagccggagacctttctcctagtgactggtagtcagtggggcattttaggatgtcagggccccagggtgacatgtgtccagcttttctatggcagcagaggcctttccctcagacaagctacaaagtgcccaggatgccatccaccatggtccccttcagtacctcacgcatggtccccagcttctcctaggatcccagtggcatttatcagtggccagctacctgccaggcccgggctggggcacggtctgcggccatgaggccaggccgcctcccgcacccctaccccgtggcagcagcatacctctgcatttctggaatgtgtgtgcatcaatgatgtttgtatatttgaggcatttaaaaatctattttcgttacgagggcaaatgaagaatgaatattgatctta

SEQ ID NO: 37623 - DNA, 3254 bp, Homo sapiens
gaggctggtctcagcttggaaggccatggaaacaccagccccatggctcttgggcatggtcaggccaggggctgggtggcttctggcgaacaagccagtggggacaaactttctgaacattccgaggtcaacccatccgttgaactcagcccggcaaggtcctggagcagtgggacagtgagcctcgaccaccctagtgacagccttgattctacctgggaaggagagaccgatggcccccagcccactgccctggcagaaaccttgccagagggccccagccaccacctcctaagcccagatggcagaactggaggcagtgttgctcgggcaacccccatggaattccaggactcctcagctcccccagcccagagtccgcagcatgccacagatagatggaggagagaaacgaccagattcttctgccctcagcccaaggaacacatctggaagcagacaaagacgtcacctaagccactcccttcccgattcattggctccatcagccccctgaatccccagcccaggccaacgcggcagggcaggccgctgcccagacagggagccactctggctggccgctcctcttctaatgcccccaagtatggccgggggcagttgaactacccactccctgatttctccaaggtagggccccgggtgagattccccaaagatgagagctaccgtccccccaagtccagaagccacaacaggaagcctcaggcccctgccaggcccctcatcttcaagtctccagctgagattgtgcaggaggtgctgttgagcagtggagaagcagccctggcaaaggacacgcctcctgcccaccctatcaccagggtaccccaagaatttcagacgcctgagcaagccactgagctggtccatcagctccaggaagactaccacaggctcctcaccaagtacgctgaggccgagaacaccattgaccagctacgcctcggggccaaggtgaacctgttctctgacccaccccagcccaaccacagcatccacacgggaatggtgccccaggggaccaaggtcttgtccttcaccatcccacagccccgctctgcagagtggtggccgggcccggccgaggacccccaggcctctgcggcctcagggtggccatcagctcgaggagacttgagcccctcctcgcttaccagcatgcccaccctggggtggcttccggagaaccgggacatctctgaggaccagtcctcagcagagcagacccaggcactggcttctcaggccagccagttcctggccaaggtggagtcctttgaaagactgatacaggcaggacgtctcatgccccaggaccaagtcaagggcttccagcggctgaaggctgcccacgcggccctagaggaggagtacctgaaggcttgtcgggagcaacaccctgcccagccgcttgccggctccaaggggacgcctggaagatttgatcctcgcagggagctggaggcagagatataccgtctgggaagctgcctggaagagctgaaggaacacatagaccagacccagcaagagcctgagccgcccgggtcagactcagctctggacagcaccccagccctgccctgcctccatcagccaacgcacctgcctgctccttctggacaagcccccatgccagccatcaagacctcctgccctgagcctgctaccaccactgccgccgccagcactggcccctgcccattgcacgtaaatgtggaggtgagctctggcaacagtgaggtggaggacaggccacaggaccccctggcccgactcaggcacaaggagctgcagatggagcaagtttaccatggcctcatggagcggtacctcagtgtgaagtctctcccagaagccatgagaatggaggaggaggaagaaggagaggaggaggaggaggaagaggggggaggtgactccctggaagttgatggggtggctgcaactccagggaaagcagaggccaccagggtcctcccaaggcagtgcccggtgcaggctgagaaaagtcatggggctcccctggaggaggccacggagaagatggtatctatgaagccaccaggtttccaggcatccctggctagagacgggcacatgtcaggcctgggcaaggctgaggcagcccctccaggccctggcgtgccaccccaccctccaggcaccaagtccgcagcatcccaccaaagtagtatgaccagcctggagggaagcggcatctctgagcgccttccacagaagcctttgcaccgaggcggtgggccccacctggaggagacctggatggcgtccccagagacagacagtggctttgtgggctcagaaacaagcagagtttcacccctcacccagactccagagcaccggctctcccacatcagcacagcaggaacattagcccagccctttgctgcatctgtgcccagggatggagcttcctaccccaaggccaggggttctctgattcccagaagagccacagagcccagcacaccccggagccaagcacagaggtacctctccagcccaagtgggcctctccggcagagggcacccaacttcagcctggagcggacactggcagccgagatggcggttcctggctcagagtttgaggggcacaaacggatttctgaacagccccttcccaacaagacaatcagcccacccccagcccccgcccctgccgctgcgcctctaccctgtggaccaacagagaccatccccagcttcctgctcaccagggcagggcgagaccaggccatctgtgagctgcaagaagaggtgtcccggcttcgtctgcggctggaagacagcctgcaccagccactccagggcagcccgacacgcccagcatctgcctttgaccgccccgcccggacccgcggccggccagcagactccccagccacctggggctcccattatggcagtaaatccacagagagattgcctggtgagcctagaggtgaagagcagattgtccctccaggaaggcagcgagccaggtcttcctcagtgcctcgggaggtgctccgactgtccctgagttcagaatctgagctgccctccctaccactgttctctgagaagagcaagaccaccaaggacagtccacaggcagctcgggatggaaagagaggggtgggcagtgctggatggccagacagggtcaccttccggggccaatacacaggtaggtcaggagggagggccgggatgggtgc

SEQ ID NO: 37624 - DNA, 849 bp, Homo sapiens
aagctgaccccaggagtccttctttccagcagcaggtcttgagctgcacttctctgtagctacaatccaggcaggaacaagccctaggtacctccggagaggagggcaagagaggaagaatgagttcagctactctagccaccaaactgattatgaattgccctgaaatctgaaaaatttcaattccaatcgtaagtttgttttgtttcattttgttttcttaaattgtatatttgaaagatggcattaactaaagatatatattcaatatagagtggaaaaaatggaatacttgcatagtatcttttacttataggtgatttatgatggggagtggggtggataggttggcagttcccccaagaagttggaaatgaagtttgtcctctgtgagttgaactaattagatccacaagtaatgaaagcagtattgtgttgtagttaagagcacactctagaaccagattgcttagtttcaaatcctggttctgccttttattatctgtgtactttgggcaagttacttgccctttgtgtgcttcatttttctcatctagaaaatggagaggccaggcgtagtggctcatgcctataatcccagcactttgggaggccgaggcgggcagatcacctgaggtgagaagttcaagaccagcctggccaacatggtgaaaccctgtctctacaaaaatacaaaaattagccaggcatgatggcgggtgcctgtaatcccagctacccaggagcctgaggcgggagaaacacttgaacctggaaggcagaggttgtagtgagccaggattgcaccactgcactccagcctgggtgacaagagctagactcagacta

SEQ ID NO: 37625 - DNA, 372 bp, Homo sapiens
gaagactatggtacagattgcgacaacatgagagtaacggccttcttggacattccaggccaggataacctgcctccactcactcgcctggagaagtatgctttcagcgagaacaccttcaaccggcagattattgccagagggctgcttgatatcttccgggacttcggtaacaatgaagaagacttcctcacggtaatggagattgtagtcagattgtcagaagatgcagagcccacagtgcggactgagctgatggaacagattcctcctattgccatttttttacaagaaaacagatcaaattttccagtggtgctctctgaatatctcatacctattgtagtgaggtacctcacagatccaaacaat

SEQ ID NO: 37626 - DNA, 428 bp, Homo sapiens
agctggttatataatgcgcgatgtggctaacaagaaaggcaagctatttttattttgtttaccgtatgctgtgcagtagggactcctccaaactggttctgtccccgaagagattcttagcttccctgcgagatccacaggatacaattagcaaaattagaagaccctattacacccacagaataaaaactaatgccttacagtggctttctccctgcacatcctgtcgtgcatgcacgggaatgtgtgtatgcaaataagttctcctttggcaatctagtagtcacatctcaatgacatttgtgttttataatgcaggctgtttttaatatttaaacatcattgttatatattgcacacagcagtgggtagttacttggttatttttaggcacagctagttactttttcaacagtgttagctgagac

SEQ ID NO: 37627 - DNA, 600 bp, Homo sapiens
agggagcccgccttgggggcgggggtctctgcagcctgttctggggctgggcctcggtgcaggtctggtcgggctggtggcctggtggccctgagcggagcgcgtgacaagaacgccgggtttaatgaggttctcagggaacggcctgctcctagcatgggatgtactttacgctggggaggtgaaggagacccctagtaacagtctccagctgcctactgctggaggcagtagaacaaggtgcattcccaagaacaatcctctccgtcggtgcaggaggaaaggtgggatttgctaaaggctcagtgggaaacaaaggaagcacttgggctgtgctgggggcatccacaaagaagataaagggctcctccccagactcagtgaccacatccacggtcgctcaaagcaggcagcaagaaaaggttcgaccacaaaagagacaataggtgatgatatttttattcgttgctttttacttttcaagctaacccttcatgggaaagtaactgtataagactattaaatttttttgttattttttaaaggagaatgccaatttattaacttacaatgtgtaataaaattgtcaactggaacaaa

SEQ ID NO: 37628 - DNA, 366 bp, Homo sapiens
ggagaaggaccttcacgttgtgcacatgtaccctagaacttaaagtataataatgaggagaaagaaagtggacgttcactacaaattttgattttttgttgttgttgtttgatgttgcagaaatgatacagtgtatctgtaatgattttgtgagtaaatgtttaatttttcacagattttataaagttaaagatgaagcaagatgattcaggaatcctgtaacttgcagcccacttcccacttcccaatccaacccatatccatcaccagcttgagaaagggaaagggaggaggacccagcaaagtggttgaatctcagcaaatcaatgagtttggaaagaaacagtttcagactgaagattgcag

SEQ ID NO: 37629 - DNA, 380 bp, Homo sapiens
caaattcaccagccaatccagagaggtctaaatagtagaccagtgccctgcccatgttgatttctgattcgtcattactcttacctctgtcttaatagctgtcatttgctccctgcttgctatctgctgggtgatctcaatgctttctctgtattctccttaagccttacagggactcaatgggatgtgcctgctgttattatacccattttaacagataaggaagctgagcctagaaagattgtataacttgtccaaggttactaggcaacaaaggcagaactaggcttcaagcctaagcctgatttcaaagcttttgctttttaacaaccacacagacccttttttattcttccttatttcagttatcaattgcacaa

SEQ ID NO: 37630 - DNA, 401 bp, Homo sapiens
gttgcttccaagaaaaagaatctcattctggggagtgtgttagctagggctttcactttgaaacatgcattatttatttgttattattattattatgcagaaagaacaacaaatggcttaaattaggcaccaagacacaggagttaaaatgtgtccttttgtcaaagagaatcataatgcaatcttacccgtatatggcatgtaactatatagtttacaaagagcttttatacgttcatcatcttgcttgattctcaaaaccaccctgtgcgtgggaaaggtcaccaaccccacttcacatatcaggacactgagaccttggatatgttcagagacttgctcaaggacacacaagcaggacaagctggcagaggaatctaagtcttcaattttcttctctg

SEQ ID NO: 37631 - DNA, 340 bp, Homo sapiens
ctaatgtaaaaaagttgaattgatgtttttaaaatttattgttactgcccaaatatcttgttttaagttcaaagaattgtttataggttagcaaaatacaatacaaaaacaccatgggaagtcttaaaacatgagagcctacagataatactgcaaacagtgaagagatttggttaaacattgaaagtatgcaatatacctggtctgtgtttacagaaaagttagaaaaacttcctcggaatacacctaaaattaagagcccagaggaaaaccaggtggccggctgattgcaacataccaggaatacacataatttaggatttctgattaacatcaactg

SEQ ID NO: 37632 - DNA, 336 bp, Homo sapiens
ctcagcgttattgggatagtctctgtctgtctagatctggactctgctttctttttgttgattgtcttataaggcaagttttccgacgcagaggctgctagaatcctcaagtttacattctaccagtggaagcaactctatgttccttgttgtcctagcaaaaccctatgccaagaactgttttgggtcttgtatagttgtggtcatgtgtgcattactggagtcatagccaggtcagccacttatggtgtggacttgttattttagagatgagttctcaaaagaaacttgaattagcctgggcaacaaagcaagactctgactcttaaaaaaaaa

SEQ ID NO: 37633 - DNA, 470 bp, Homo sapiens
cacttctgtcggtaatttttatgctcaccagacgccaaaacccaccattctagaaagtagatgatgcaaactattattacagtggagagaagaaatatttaataacagtcaatactgtctcagtttgtgcaatgtcccatgcaaatactagtactctataagtattagttcatttaaaacagcagtccccaacctttctggaaccagagaccagagttcacttaaaacagcggtccccaaccttttgcatcaggcaccagttttgtggaagacagtttttccatggaccacggtgtggggaggggtgcagttaagatgggtttttggatgaaactgtttcagctcagatcataaggcattagattgtcataaggaatgtgcaacctagatccctcacatatgcaattcacaatagggttcctgcttctgtgagaatctattgccattgctgatctgataggagacagggc

SEQ ID NO: 37634 - DNA, 414 bp, Homo sapiens
tcaatgtaggttcccatcaatgttggatgggataaagaaaatgtggtgctgtacaccatggaatactatgtaagccttaaaaaatattgaaatcatgtcctttgcaggaatatagatggaactggagtccaaaatcctaagtgaattaatgcagaaacagaaaactaaatacctcatgttctcacttataactgggagctaaacttgagcacccatagacttaaacatgggaacaatagccatggcaaactactatagggtcaagggagtggggcatgggtcataaaagcatctcttgggtatatgctcactacctgagtccaatatacccacgtaacaaacctgcacattaccccccccatatctaaaataaaagtcaagggtagaaaagcacactttgaaatttaagggatg

SEQ ID NO: 37635 - DNA, 3727 bp, Homo sapiens
ggcgggcagccgccggcggctgggagccgaggcgtcggtgcagacctggagacgggcatgggggggctgcggctgctggctgtggccctcacgtgctgctggtggccgcagggcagccagggtaagaccctgcggggcagcttcagcagcaccgcggcccaggacgcccagggccagcgcatcggccacttcgagttccatggtgaccatgctcttctgtgtgtcagaatcaacaacatagcagtagctgttggaaaagaagctaaactctacctgttccaagcccaggaatggctaaagctacagcaaagcagtcatggttatagctgtagtgaaaaattatccaaagctcagttgacaatgaccatgaaccagaccgaacataatctgacagtgtcccagattccgtctccacaaacgtggcatgtgttttatgcagacaagtatacatgccaagatgacaaggagaattctcaggtggaagatatcccatttgaaatggtgttactaaacccagatgctgaagggaatccatttgatcattttagtgctggagaatctgttactccaaagatggaataggggtaccatttatgggaagtttggcagaattttttgacatcgcttcccaaattcagatgttatacttacttttgagtctatgcatgggttggacaatagtcagaatgaagaagtctcaaagcagacctctccagtgggattctacgcctgcatccactggcattgcagtattcattgtcatgacacagagtgttttgctactttgggaacagtttgaagatatcagtcatcatagctaccattcacaccacaacttagcagggatcctcctaattgttctaagaatttgcctagcattgtcattaggctgtggactctatcagatcatcacagtggagagaagtacactcaaaagggagttctacatcacatttgccaaaggctgtatcttgtggtttttatgccatccagttcttgcatgcatttctgtcatttttagcgactaccaaagagacaaggttattacaataggtgttatcctttgccagtctgtttccatggttattctctacagactctttctgtctcacagtctatactgggaagtttcttcactttcttcagtaacactaccactgaccatatcatctggacacaaaagtcgccctcatttctgatacttgatttttgttgagaggaaaagtgaattggttaaaagagtgcaataaggatccaaatacagtgacttttttttcatacatttagtatgaaaacttgaacagcgaaagcagagcatgttatttatataactgcatttaagcagtaccaagactgaaaaaaaaggtaataaatgaaatgttttgaaatatacttaaacaacaaactttgaagaaagtgttgttataaaattattgaagcgatttctatgtggaaataaatgtgaaaaataactatgatattttggtaaaatattcaccacttataatgcctcatcttaatagctaactcaggtttaatagtcttataaaaagtaatcagttaaatgattacttgcttataaatatctaaactagtccagttatgaaatcagtgtaatacattgatttttaaaactgctgctttttatgctttaaggaaaatgtatttcatatttgagtttaaaggaattgaaattacttcaggaaatgaatataaaataggttcacagttaaatgaataagcttttgtttatttgtgggtggagttattctccaattttttctgccatttttggctctagttcaggttttagcttgattagcaaaggtttttgacaaacagtttatgaaaaaataaaacttaaatacattacacgggttgtaaggacaaaggattttaaaatctgagcacttaggtgaagggacaagcaggtttatgtgtttaaacagaaagaagggaaaaggtactatgtgatatggtactgaaattttgatcccaatagaattcatttctcttacgttgaatccccaatcataattaagccgtatacacagattaaattaacagaagcatttcacataaatgttggtttcagtcatcaactacccatgaattcctgcccaaggatacttaatcaggattaaattttctatgaataattgaaaaacaaaacactcactggatttgttataatccgtgttggcactggattctaagtagttgccatcttgaatcctttgtaataaagccatacttttgtgtgtgtgtgtgatgccccagtattgagtatgctagctaaaaaatatcaagtgcctgattaaagaattgctaaatggttgtcaatactcgctgtataaaatgagtattcccattaatagtcactgattggaaattattctgttgctgtttgtcaagctgttcaggccttttcctttttacttctggcttattttaaaaatattttttatctatttactgtgtgtttaagcaagcaacagtgcactgatctggtagttaaattttttaattaaatagttaaaataatgtagtgcaacttaaaaatatctatggctttgtttttgtttttcttttgtacctagtctcattggaaatgactagtattctgcctcattttcagggcagaatatgtgtttgtgacccaaaatgacaaagttaccaagttcaacctgctcatttaatcatctctctattagttctttgtaaatcacttagtacattagagctacaggttaagactagaaagtctgagttatgttttaggtatacatgatcgtctgagtggtcataaccttttcttttatcatgtctcgctaataaccccagctattgtctgttgtgttcagctgagatgcaaaaaagaaattaagcaaaaaagaaaaaggtgaagacttttcatgaattttgtgaacttgccaaaaggggaagggaaaaatctttgtgttacttcactcaaagaacataagtaactgcaattaacatatatgaaatttattactctgcttgcatttatgaaactaaccagttttttaaactttaattcttaaatttgtggttggaaatgctgataatttattttgttatttaagagctgttgttaagtggaggaaagtagttgttaataaatgtataaaactgttcttgactagtaatcagggacaaaatttatagttcataagtcatgacacagtattcgctctttttctgaatgtttacatagagattcatcactgcagattacagaaagttaagtgtatactacaaactctaattaaagataaaaatcttttctacttttctttgtcagataatgcttttttatgtgtttttacattttttgaaagaagataaatggttcatccagagctttattaagaagcatttcttttcttcccttaaaaaatagatgcttatttttattgacatgtgtataataagatgggtgcctactgtgatgcattttaccaggcattttaccttcattattactcatctctattgtgataaccaggctcccatttaactgagtataagagagaataaatgatttctctaaggtcatcaaactatttagtttttccactttaccttcatgatttaaggaacatgtattagctgtgttttagtgagaatgaattgctatccatcataatttttgctgttgatttgaacattaaaactggaattgtgctaaaatcagaaaatgcgc

SEQ ID NO: 37636 - DNA, 3908 bp, Homo sapiens
ggcgggcagccgccggcggctgggagccgaggcgtcggtgcagacctggagacgggcatgggggggctgcggctgctggctgtggccctcacgtgctgctggtggccgcagggcagccagggtaagaccctgcggggcagcttcagcagcaccgcggcccaggacgcccagggccagcgcatcggccacttcgagttccatggtgaccatgctcttctgtgtgtcagaatcaacaacatagcagtagctgttggaaaagaagctaaactctacctgttccaagcccaggaatggctaaagctacagcaaagcagtcatggttatagctgtagtgaaaaattatccaaagctcagttgacaatgaccatgaaccagaccgaacataatctgacagtgtcccagattccgtctccacaaacgtggcatgtgttttatgcagacaagtatacatgccaagatgacaaggagaattctcaggtggaagatatcccatttgaaatggtgttactaaacccagatgctgaagggaatccatttgatcattttagtgctggagaatctgggttacatgagttctttttcctcctagtcctagtgtactttgtgattgcttgcatttatgctcaatcattgtggcaggctattaagaaaggcggacccatgcacatgattttaaaggttctgacaactgcattgctgttacaagctggttcagctttagctaattacattcatttctccagttactccaaagatggaataggggtaccatttatgggaagtttggcagaattttttgacatcgcttcccaaattcagatgttatacttacttttgagtctatgcatgggttggacaatagtcagaatgaagaagtctcaaagcagacctctccagtgggattctacgcctgcatccactggcattgcagtattcattgtcatgacacagagtgttttgctactttgggaacagtttgaagatatcagtcatcatagctaccattcacaccacaacttagcagggatcctcctaattgttctaagaatttgcctagcattgtcattaggctgtggactctatcagatcatcacagtggagagaagtacactcaaaagggagttctacatcacatttgccaaaggctgtatcttgtggtttttatgccatccagttcttgcatgcatttctgtcatttttagcgactaccaaagagacaaggttattacaataggtgttatcctttgccagtctgtttccatggttattctctacagactctttctgtctcacagtctatactgggaagtttcttcactttcttcagtaacactaccactgaccatatcatctggacacaaaagtcgccctcatttctgatacttgatttttgttgagaggaaaagtgaattggttaaaagagtgcaataaggatccaaatacagtgacttttttttcatacatttagtatgaaaacttgaacagcgaaagcagagcatgttatttatataactgcatttaagcagtaccaagactgaaaaaaaaggtaataaatgaaatgttttgaaatatacttaaacaacaaactttgaagaaagtgttgttataaaattattgaagcgatttctatgtggaaataaatgtgaaaaataactatgatattttggtaaaatattcaccacttataatgcctcatcttaatagctaactcaggtttaatagtcttataaaaagtaatcagttaaatgattacttgcttataaatatctaaactagtccagttatgaaatcagtgtaatacattgatttttaaaactgctgctttttatgctttaaggaaaatgtatttcatatttgagtttaaaggaattgaaattacttcaggaaatgaatataaaataggttcacagttaaatgaataagcttttgtttatttgtgggtggagttattctccaattttttctgccatttttggctctagttcaggttttagcttgattagcaaaggtttttgacaaacagtttatgaaaaaataaaacttaaatacattacacgggttgtaaggacaaaggattttaaaatctgagcacttaggtgaagggacaagcaggtttatgtgtttaaacagaaagaagggaaaaggtactatgtgatatggtactgaaattttgatcccaatagaattcatttctcttacgttgaatccccaatcataattaagccgtatacacagattaaattaacagaagcatttcacataaatgttggtttcagtcatcaactacccatgaattcctgcccaaggatacttaatcaggattaaattttctatgaataattgaaaaacaaaacactcactggatttgttataatccgtgttggcactggattctaagtagttgccatcttgaatcctttgtaataaagccatacttttgtgtgtgtgtgtgatgccccagtattgagtatgctagctaaaaaatatcaagtgcctgattaaagaattgctaaatggttgtcaatactcgctgtataaaatgagtattcccattaatagtcactgattggaaattattctgttgctgtttgtcaagctgttcaggccttttcctttttacttctggcttattttaaaaatattttttatctatttactgtgtgtttaagcaagcaacagtgcactgatctggtagttaaattttttaattaaatagttaaaataatgtagtgcaacttaaaaatatctatggctttgtttttgtttttcttttgtacctagtctcattggaaatgactagtattctgcctcattttcagggcagaatatgtgtttgtgacccaaaatgacaaagttaccaagttcaacctgctcatttaatcatctctctattagttctttgtaaatcacttagtacattagagctacaggttaagactagaaagtctgagttatgttttaggtatacatgatcgtctgagtggtcataaccttttcttttatcatgtctcgctaataaccccagctattgtctgttgtgttcagctgagatgcaaaaaagaaattaagcaaaaaagaaaaaggtgaagacttttcatgaattttgtgaacttgccaaaaggggaagggaaaaatctttgtgttacttcactcaaagaacataagtaactgcaattaacatatatgaaatttattactctgcttgcatttatgaaactaaccagttttttaaactttaattcttaaatttgtggttggaaatgctgataatttattttgttatttaagagctgttgttaagtggaggaaagtagttgttaataaatgtataaaactgttcttgactagtaatcagggacaaaatttatagttcataagtcatgacacagtattcgctctttttctgaatgtttacatagagattcatcactgcagattacagaaagttaagtgtatactacaaactctaattaaagataaaaatcttttctacttttctttgtcagataatgcttttttatgtgtttttacattttttgaaagaagataaatggttcatccagagctttattaagaagcatttcttttcttcccttaaaaaatagatgcttatttttattgacatgtgtataataagatgggtgcctactgtgatgcattttaccaggcattttaccttcattattactcatctctattgtgataaccaggctcccatttaactgagtataagagagaataaatgatttctctaaggtcatcaaactatttagtttttccactttaccttcatgatttaaggaacatgtattagctgtgttttagtgagaatgaattgctatccatcataatttttgctgttgatttgaacattaaaactggaattgtgctaaaatcagaaaatgcgc

SEQ ID NO: 37637 - DNA, 2272 bp, Homo sapiens
ggcgggcagccgccggcggctgggagccgaggcgtcggtgcagacctggagacgggcatgggggggctgcggctgctggctgtggccctcacgtgctgctggtggccgcagggcagccagggtaagaccctgcggggcagcttcagcagcaccgcggcccaggacgcccagggccagcgcatcggccacttcgagttccatggtgaccatgctcttctgtgtgtcagaatcaacaacatagcagtagctgttggaaaagaagctaaactctacctgttccaagcccaggaatggctaaagctacagcaaagcagtcatggttatagctgtagtgaaaaattatccaaagctcagttgacaatgaccatgaaccagaccgaacataatctgacagtgtcccagattccgtctccacaaacgtggcatgtgttttatgcagacaagtatacatgccaagatgacaaggagaattctcaggtggaagatatcccatttgaaatggtgttactaaacccagatgctgaagggaatccatttgatcattttagtgctggagaatctgggttacatgagttctttttcctcctagtcctagtgtactttgtgattgcttgcatttatgctcaatcattgtggcaggctattaagaaaggcggacccatgcacatgattttaaaggttctgacaactgcattgctgttacaagctggttcagctttagctaattacattcatttctccagttactccaaagatggaataggggtaccatttatgggaagtttggcagaatgtgagtatctttctgagcattttttaaaaagcttttacactcgctatctgctttttttttatttcttgtcatagtataaattttctgtcgaaaattgtttagaaatcagcttgactgagaacaggattacagtttaagttcccatatgtcttacttagtttcttcttaataataggtaatgtgtacagctcctcgttgtttttttgtttgtttgtttgagacagggttcttactccgtagcccaggctggagtgcagtggcacagtcacggctcactgcagcctcaaactcctaggctcaggtgatcctcctgcctcaggccttcccagtagctgggattacaggcacataccatcatgcctggctgatttttaaatttccttttctgtagatggggtctcactatgttgcccaggctggccttatactcttgggcttgagggatccacccaccctggcctcccaaagtcctggaattacaggcatgagtctccacactctgccttttcattgtttttaggtatatttatatacattctctcatcttatcctcaatagaaaaggggtctgcatatccttattttgcagataaaggatctgggctcagtgatgtgaaacatacttccacatgtcagtcagctattgagtggtagagactagactcagacctaaattttcttacctcaaagctgaagtttttcttcctattataattccactctctgttataactgactcttttctatttctgacccaaagcctaaaactcacatcaaaatatgctgtgaagaaaagtgataagttttcttaaaaatcattaaatgctacctcataaaataaatatatatatgaaacttgaagcatttatagatttctgttgttttcttgtagtgttaacctggatacaggtggttttgatacatcttttctgtttgaagtagcaggcttcccctgcagtgtaggtgatggccacctggtggcacatcacactaatgcatggagcttctcatttgtcttcaggattctgaaagtaaagccaatgtttggatgttatgggagctatgcatttcattgtattgtttcttgttaatagttttagaaaatactcttcacattatagttcagccatcaaaaaaaattcacccagaaatgaaggtactagtattctccatattgcagaaatcgtatttagaatttgctttaataagcagtgagttatagagaacaggattatgtagttagaaaagctaagaaaaatgggaaacgaaaagagttaaggttggacttaatggacatatggtatgggcatatatatgtatttttaaatagtattgctgctgttttaactattttaataaatatattacaaaatttatggcaatttttaaatctttagaattattacctgcgaatatctcttaatgaatttcgttagcttctctttgaaaatggctttttgtggtttttcttaaaaaaaaa

SEQ ID NO: 37638 - DNA, 380 bp, Homo sapiens
  misc_feature (359)..(359): n is a, c, g, or t
aattaccctgaatttctaagtagaatattatactttttaaaagactttcagatgtaattctaagctttaaaaaaaaaaaaaaattctaccacagttacattgcttaccaaatactgagttccattacttttctttttttcctttttaatttttttgagacaggttcttgctctgtcacccagggctggagtgcagtggcacaatctctactcattgcaaccttgggcctcctgggcttcaagagatcctcccacatcagcttcccaggtagctgagactacaggcacatgccaccacgcccaggtaatttttgtatttttttagagacagcgttttgccacgttgcccatggtggggtngacaggggcaaggaacctttt

SEQ ID NO: 37639 - DNA, 593 bp, Homo sapiens
aattaccctgaatttctaagtagaatattatactttttaaaagactttcagatgtaattctaagctttaaaaaaaaaaaaaaattctaccacagttacattgcttaccaaatactgagttccattacttttctttttttcctttttaatttttttgagacaggttcttgctctgtcacccagggctggagtgcagtggcacaatctctactcattgcaaccttgggcctcctgggcttcaagagatcctcccacatcagcttcccaggtagctgagactacaggcacatgccaccacgcccaggtaatttttgtatttttttagagacagcgttttgccacgttgcccatgctgatctcaaactccttggcaagtgatccgcccacctcagcctctcaaattgctcagattacaggcatgagccaccatcacgcccagccccattactgtctccctccaacccccacctgagacagggtttcactctgttgcccaggtggactgccaaggtgcaaacacagcttaccacagcctcgacctcccaggctcagtctctgaagtagctgggactacaagcatgcaccaccatgctc

SEQ ID NO: 37640 - DNA, 313 bp, Homo sapiens
gtcccattcttcccaacatgtttctgaagcaactttgtatttctgtctgcagattttcaggtccaggacccgtcaatcaaatttcagattctaataaagtccaagggtctctccacttaggtttgtcttagctgtttcatcaatgagcccctccccctttcccagcaaattgcacacttattcccacttaaaaaaaaaaaagagagagagagagagacagaaaaataacccttcccactggttctaatgacatcttcagtcattaatgagttaataaaaatctcgaagtcatctgggctagataagaaagaag

SEQ ID NO: 37641 - DNA, 208 bp, Homo sapiens
aacagagaactagaatttattttctaaaaatccaatgaatgtcctagagttaaatataagactttaagttagcaaatgataacatctgttcatagacatgaatgtctgatatgaagaaggtgaatatttttagtagctttattccttcgtttagtttctcaatctccaaaaccgtatccaggccatcaccaatcattctatcgcaatg

SEQ ID NO: 37642 - DNA, 188 bp, Homo sapiens
ggtgggataaagtgtggtgagaacatgactaaatgtcaaagtagatcagacagaataggagcaccttggcaattctgatggaggggtccagaaacaatactttgaaaagcacaaccatagggcaactgttggagggaaagttcctggctctaggtgctctgctagactgtctggtgttggggactgtc

SEQ ID NO: 37643 - DNA, 414 bp, Homo sapiens
tttaagaaattacaaataccttggaaatatatctaatgaaagatatgtaagacctctacattgaaaactaaaacactaatgagataaatgaacagaaactttaaataaaattgaagatatttaatggactcaatattaagatgtcaattctccataaattgatctacaaattcaatgcaatctgaattaaaatcccagcaagattttgaatatgtgtttgtttataaaaattaacaagctgattctcaaattgatataacaatgcaaaggacctagaatagctaagataatgttgaagagtaacaaagttagaagatttacactaccagatagacttattataaagctacaataatgatgacagtacattactggcacacgacagagaccaacggaacagaataaatagtccag

SEQ ID NO: 37644 - DNA, 363 bp, Homo sapiens
gttttgggataacatgaattattacactttcgtgtgtgatacagttatacttaacgcattctaaaataattcatggagttctaaaataagaacactaggtttttatagtaagtatattatattgttagttttaaaaatattataaccagatgagatcttagtgattattcaatttctgttacagataaggttaggtaaagcccagataggttaagtgaattccctatgatttccagctagagttaggcttggaactcaagaatcttgggttctttctcttaggtctgcatgttttctgctataccatccttaggaaactctgttatctccttacccacaatttcatgtgtagataaaatgaag

SEQ ID NO: 37645 - DNA, 658 bp, Homo sapiens
gtcaaaatctaagtgacttctttcaagccatttagtaaagagttttgcaaaagtgtaaaacaaaatgttttgcttcttaccatatttttgcatatatatttaagattttttaacagtttttcctttctaatgtggtaactatttataatccatgtgtataaagaagtcctgaaaccaagatgtttgaaaatcactgatatgtagatctatggattataaaaaaagctcatgattttttagaatctatattagaaatcctcatgtatttacagtgagttgtattctagagttttctttaaaattgccttatagtcagtggaagtagtgtgaaggagaataaaatagtctgaaatgaaaaactgggaaattgaggccggtcgcaacagctcatgcctgtaatcctagcatgttgggaggctaaggcaggtggatcacttgagatcaggagtttgagacctgcctggccaacatggagaaacatcatttctactaaaaatacaaaaattagctgggaacagtggtgcatggctgtaatcccagctacttgggaggtagaggagggagaatagcttgaacctgggaggcagaggctgcagtgacctgagatggcgcccctgcactcccgcctggttgacagccagactctatctcaaaaaaa

SEQ ID NO: 37646 - DNA, 721 bp, Homo sapiens
tttacagagatagggtctccctatgttgcctaggctggtctcgaattcctggagtcaagggatcctcctgcctctgcctcccaaagtgctaggattacaggtgtgagccaccacacctggccatgtaaactcttaatagagcacctgacacacactgaatgtcagctcaaaaatttcagttattttattttcaaaaccttcttggctcttttagcctccattctttgttactcccaaaatcacttcccatttttctatctctgtcttactacattctaggacactgatggtattaggccacattaggttcattcacctataatgttaataagttctacagcattatcattgaacagatctcaaaatatcttctgaatttatagaaaagctccaatatattccctaaattagaagtaaataattttaaaattttctgaatttaaaattgtattatcttcaaagtagcttaataattacatttaccagccaggcatgatgattcatacctgtagtctccacactttgggaggccaaggcaggaggatcgcttgagcccagaagtttgaaaccagcctgggcaacatggcaagacttcgtctcgacaggtgtggtgttacatgcctgcagtcccagctacttggaagttgagccaggagaactgcttgagcccaggcggttaagagtgcagtgagctgtgattgtgccactgcactccagtctg

SEQ ID NO: 37647 - DNA, 787 bp, Homo sapiens
gccaagaattcggcacgaggggagcggcgcatgttattttcttgagagtgaagagttacatacctctggtgttctcaatcaatttctatcatttctctggatttgtggtctcttcagccaagactatttcctcaatggcaattgcagaattgcttttcttaaacaatttctctttactgctattcatagcccatcttttcttagactgagcagatgacagtgtgtagccatgtgaggggtcatgcaccattacctctttttctgagctccattttccatgggaagcccttcaagcattgttctctgtagcaataatatcagagtttacatgggtcaacacctcatctgtcccgaactagaaaggtccttcatggaacacccacacgaaaaaatgttaagaagggcattttgctccaaatggaggcaagaaatgtgctgatccagttaatctgatggaacgcttttgataaatcaagaaagaaaaaacaaaaacccaatctaaataacctatcctttggaaaaaagcttgtagatctttgctagaaagaagttaatgagaaaatggccaaaaggaaaaatgagtgtccagtgttttaggagctcaggttttaaactgacatatccaagtttattccatctaagtattattgacattcatcctacttagtcaacattgacagttaataccttgtaaacattttgggatcattaactgacattaacaattttaacttacatgaaagattttaattattttttaaacatcttagtttactgttgtacagca

SEQ ID NO: 37648 - DNA, 3931 bp, Homo sapiens
  misc_feature (3766)..(3766): n is a, c, g, or t
  misc_feature (3789)..(3789): n is a, c, g, or t
agacaaagcggaggccgagcccaggaagcaagcgcgctctccgccccgcctggagggagggcccaaccacagcacagccgcgctcactcctcacccggacgtgacctagttctcacagaggcccggcctcttccgccacaactccggcccgcggtcccgccccgttccgtgaatggtcggccggcctcaggtcaaaaaagcgtttaggtgtctgcgacggagcctccggagaaaggcaagcacgtcgcagccaatgaggtgatagaaacgcaaagcagcgaccaatgactagctgagttgggctgggccggccgacgaatcacgaggcttcgcacccggatatggttatgggctcggaaatctagttcgggaaaagtgtgaggggctcttcacgtggggaaggaacagcaggcgcggaggagggggcaagcgtgtgtgagattcagtggtccatgcgtgcgtttgtcgtgtaagggtcattcctggggtttggagtgggggaacaaatcaatgtggctgtttttccgtggaaagaattcccactgcagtgtcccggagcctgcgtgtggtgggcaagctcctcaaatggtatctcacagggaataggggagtcttgaaaacgcagcttcggcagtaggaacatgaacctcttacctaaaagttccagggagtttggctccgttgactattgggagaagttcttccagcagcgaggaaagaaagctttcgagtggtatggaacctacctggaactgtgcggggtgctacataaatatatcaagcccagggaaaaggtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaagcctgtgcggctggagagtgccgagcggctggccgaggcggtgcaggagcgacagcagtatgcctggctgtgcagccagctgcgccgcaaggccaggctggggagtgtgtctctggacttgtgcgatggggacacgggggagccacgctacaccctccacgtggtggacagccccactgtgaaaccatcgcgggacaatcattttgcgattttcatcatccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttgtcctcttcagtaccacttgggttggtttgtctttgcttcctacaccacgtccttgagtggagttccctgctgaagcccctagcacacactgcatgccttaacaagtgtgtgcaagcccctcagaactcaagacatccaaattttattgcgtctctacttatactggtttgcttttgatttattcctctattagttctataggagtgatctcaagtgagatagcagagcaagatgccaaaagaccataaatagagtaaggtttctatagatgtgagacagatttgagagagcatttactctgtctccctgtggatgaaactgctgctgaaatggttccaatttttaggaatctgcttacccacttcattatttgacagctttccttggtgacccaaaccttgtagcctaagccatttgtctttttctcagtggagggagtgtatggacctggccccatggctttgcatgttagagacctggcagactaaagtctctagtgtttgtttgctcacatttgctgagtgacagctatgtgccagactgcataaagggtggtggcagaagtgaaaatgtttaagaatgaccaaaaacattagtaatgaaagttaatgtgttccaggcattcttctaagtggtttacatgcactgtctcatttaatctgagataaaggatacttaagcccaaactatatctaaacccaaatctcacttggctggaaacatcaatcttaaccatttattcagaaccattaaaccaatgattccaaaaaaaaaaagaagtcttattacggccagctatcgttagtaggtattagctgcctgcgcgttcacgcngcatggacatgggtctactagcntagaccactcgcgcggactgaagtcccatgtcctcactcatcttggcgccctcggcgggttgcgtgacaccgcctgtctttatgctaccagctggcttgcgcaaaatgctgcttgtcggttcacactcgtcggaattccgtt

SEQ ID NO: 37649 - DNA, 3606 bp, Homo sapiens
  misc_feature (3441)..(3441): n is a, c, g, or t
  misc_feature (3464)..(3464): n is a, c, g, or t
agacaaagcggaggccgagcccaggaagcaagcgcgctctccgccccgcctggagggagggcccaaccacagcacagccgcgctcactcctcacccggacgtgacctagttctcacagaggcccggcctcttccgccacaactccggcccgcggtcccgccccgttccgtgaatggtcggccggcctcaggtcaaaaaagcgtttaggtgtctgcgacggagcctccggagaaaggcaagcacgtcgcagccaatgaggtgatagaaacgcaaagcagcgaccaatgactagctgagttgggctgggccggccgacgaatcacgaggcttcgcacccggatatggttatgggctcggaaatctagttcgggaaaagtgtgaggggctcttcacgtggggaaggaacagcaggcgcggaggagggggcaagcgtgtgtgagattcagtggtccatgcgtgcgtttgtcgtgtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaagcctgtgcggctggagagtgccgagcggctggccgaggcggtgcaggagcgacagcagtatgcctggctgtgcagccagctgcgccgcaaggccaggctggggagtgtgtctctggacttgtgcgatggggacacgggggagccacgctacaccctccacgtggtggacagccccactgtgaaaccatcgcgggacaatcattttgcgattttcatcatccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttgtcctcttcagtaccacttgggttggtttgtctttgcttcctacaccacgtccttgagtggagttccctgctgaagcccctagcacacactgcatgccttaacaagtgtgtgcaagcccctcagaactcaagacatccaaattttattgcgtctctacttatactggtttgcttttgatttattcctctattagttctataggagtgatctcaagtgagatagcagagcaagatgccaaaagaccataaatagagtaaggtttctatagatgtgagacagatttgagagagcatttactctgtctccctgtggatgaaactgctgctgaaatggttccaatttttaggaatctgcttacccacttcattatttgacagctttccttggtgacccaaaccttgtagcctaagccatttgtctttttctcagtggagggagtgtatggacctggccccatggctttgcatgttagagacctggcagactaaagtctctagtgtttgtttgctcacatttgctgagtgacagctatgtgccagactgcataaagggtggtggcagaagtgaaaatgtttaagaatgaccaaaaacattagtaatgaaagttaatgtgttccaggcattcttctaagtggtttacatgcactgtctcatttaatctgagataaaggatacttaagcccaaactatatctaaacccaaatctcacttggctggaaacatcaatcttaaccatttattcagaaccattaaaccaatgattccaaaaaaaaaaagaagtcttattacggccagctatcgttagtaggtattagctgcctgcgcgttcacgcngcatggacatgggtctactagcntagaccactcgcgcggactgaagtcccatgtcctcactcatcttggcgccctcggcgggttgcgtgacaccgcctgtctttatgctaccagctggcttgcgcaaaatgctgcttgtcggttcacactcgtcggaattccgtt

SEQ ID NO: 37650 - DNA, 3739 bp, Homo sapiens
  misc_feature (3574)..(3574): n is a, c, g, or t
  misc_feature (3597)..(3597): n is a, c, g, or t
agacaaagcggaggccgagcccaggaagcaagcgcgctctccgccccgcctggagggagggcccaaccacagcacagccgcgctcactcctcacccggacgtgacctagttctcacagaggcccggcctcttccgccacaactccggcccgcggtcccgccccgttccgtgaatggtcggccggcctcaggtcaaaaaagcgtttaggtgtctgcgacggagcctccggagaaaggcaagcacgtcgcagccaatgaggtgatagaaacgcaaagcagcgaccaatgactagctgagttgggctgggccggccgacgaatcacgaggcttcgcacccggatatggttatgggctcggaaatctagttcgggaaaagtgtgaggggctcttcacgtggggaaggaacagcaggcgcggaggagggggcaagcgtgtgtgagattcagtggtccatgcgtgcgtttgtcgtttccagggagtttggctccgttgactattgggagaagttcttccagcagcgaggaaagaaagctttcgagtggtatggaacctacctggaactgtgcggggtgctacataaatatatcaagcccagggaaaaggtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaagcctgtgcggctggagagtgccgagcggctggccgaggcggtgcaggagcgacagcagtatgcctggctgtgcagccagctgcgccgcaaggccaggctggggagtgtgtctctggacttgtgcgatggggacacgggggagccacgctacaccctccacgtggtggacagccccactgtgaaaccatcgcgggacaatcattttgcgattttcatcatccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttgtcctcttcagtaccacttgggttggtttgtctttgcttcctacaccacgtccttgagtggagttccctgctgaagcccctagcacacactgcatgccttaacaagtgtgtgcaagcccctcagaactcaagacatccaaattttattgcgtctctacttatactggtttgcttttgatttattcctctattagttctataggagtgatctcaagtgagatagcagagcaagatgccaaaagaccataaatagagtaaggtttctatagatgtgagacagatttgagagagcatttactctgtctccctgtggatgaaactgctgctgaaatggttccaatttttaggaatctgcttacccacttcattatttgacagctttccttggtgacccaaaccttgtagcctaagccatttgtctttttctcagtggagggagtgtatggacctggccccatggctttgcatgttagagacctggcagactaaagtctctagtgtttgtttgctcacatttgctgagtgacagctatgtgccagactgcataaagggtggtggcagaagtgaaaatgtttaagaatgaccaaaaacattagtaatgaaagttaatgtgttccaggcattcttctaagtggtttacatgcactgtctcatttaatctgagataaaggatacttaagcccaaactatatctaaacccaaatctcacttggctggaaacatcaatcttaaccatttattcagaaccattaaaccaatgattccaaaaaaaaaaagaagtcttattacggccagctatcgttagtaggtattagctgcctgcgcgttcacgcngcatggacatgggtctactagcntagaccactcgcgcggactgaagtcccatgtcctcactcatcttggcgccctcggcgggttgcgtgacaccgcctgtctttatgctaccagctggcttgcgcaaaatgctgcttgtcggttcacactcgtcggaattccgtt

SEQ ID NO: 37651 - DNA, 3726 bp, Homo sapiens
  misc_feature (3561)..(3561): n is a, c, g, or t
  misc_feature (3584)..(3584): n is a, c, g, or t
ccgggttcgcgcccatgtgtgttgagagcttctcagactatcagctttgggtcgctttgctgttcgtgatatgagacagacagttgcggtgggtgtcatcaaagcagtggacaagaaggctgctggagctggcaaggtcaccaagtctgcccagaaagctcagaaggctaaatgaatattatccctaatacctgccaccccactcttaatcagtggtggaagaacggtctcagaactgtttgtatcaattggccatttaagtttagtagtaaaagactggttaatgataacaatgcatcgtaaaaccttcagaaggaaaggagaatgttttgtggaccactttggttttctttcctgcgtgtggtgggcaagctcctcaaatggtatctcacagggaataggggagtcttgaaaacgcagcttcggcagtaggaacatgaacctcttacctaaaagttccagggagtttggctccgttgactattgggagaagttcttccagcagcgaggaaagaaagctttcgagtggtatggaacctacctggaactgtgcggggtgctacataaatatatcaagcccagggaaaaggtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaagcctgtgcggctggagagtgccgagcggctggccgaggcggtgcaggagcgacagcagtatgcctggctgtgcagccagctgcgccgcaaggccaggctggggagtgtgtctctggacttgtgcgatggggacacgggggagccacgctacaccctccacgtggtggacagccccactgtgaaaccatcgcgggacaatcattttgcgattttcatcatccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttgtcctcttcagtaccacttgggttggtttgtctttgcttcctacaccacgtccttgagtggagttccctgctgaagcccctagcacacactgcatgccttaacaagtgtgtgcaagcccctcagaactcaagacatccaaattttattgcgtctctacttatactggtttgcttttgatttattcctctattagttctataggagtgatctcaagtgagatagcagagcaagatgccaaaagaccataaatagagtaaggtttctatagatgtgagacagatttgagagagcatttactctgtctccctgtggatgaaactgctgctgaaatggttccaatttttaggaatctgcttacccacttcattatttgacagctttccttggtgacccaaaccttgtagcctaagccatttgtctttttctcagtggagggagtgtatggacctggccccatggctttgcatgttagagacctggcagactaaagtctctagtgtttgtttgctcacatttgctgagtgacagctatgtgccagactgcataaagggtggtggcagaagtgaaaatgtttaagaatgaccaaaaacattagtaatgaaagttaatgtgttccaggcattcttctaagtggtttacatgcactgtctcatttaatctgagataaaggatacttaagcccaaactatatctaaacccaaatctcacttggctggaaacatcaatcttaaccatttattcagaaccattaaaccaatgattccaaaaaaaaaaagaagtcttattacggccagctatcgttagtaggtattagctgcctgcgcgttcacgcngcatggacatgggtctactagcntagaccactcgcgcggactgaagtcccatgtcctcactcatcttggcgccctcggcgggttgcgtgacaccgcctgtctttatgctaccagctggcttgcgcaaaatgctgcttgtcggttcacactcgtcggaattccgtt

SEQ ID NO: 37652 - DNA, 2632 bp, Homo sapiens
  misc_feature (2467)..(2467): n is a, c, g, or t
  misc_feature (2490)..(2490): n is a, c, g, or t
attgtatatgttaaatgtttaatgactatgtctttgtggggcggggtagggggggcacatcctaatttatagtgtttatcagttctctagtataaataccaccactgtatttgtttgttttacgttgcttataaaggaatacctgagactggataatttgtaaagaaaagacttttattttggcttatggttctgcagactgtacaagaagcatggtaccaacttctgcatttggtgaggcttcaggaagcttacaattatcacagaaggtgaagggagaccaggtacatcacatagcaagagagggagcaaaagagatgccaggcttttttcaacaacagctctagagtgagaactcactcaataccatggggaaggcacccagccattcatgagggatctgcccccgtgaccagcatggtggctccgacattggggatcacatttcaacgtgagatttgtaggggacaaacatcccagatgatttcactacggccagtttcaagctatcaacatgatgtcaaccagtttgcaaaattttaacgattgggtcttttgagtgttcaagccatctggagcacactgctgccagtaacccttgcttcctgaggactagtgtactaagcatagggcttcatatctcttgtttagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttgtcctcttcagtaccacttgggttggtttgtctttgcttcctacaccacgtccttgagtggagttccctgctgaagcccctagcacacactgcatgccttaacaagtgtgtgcaagcccctcagaactcaagacatccaaattttattgcgtctctacttatactggtttgcttttgatttattcctctattagttctataggagtgatctcaagtgagatagcagagcaagatgccaaaagaccataaatagagtaaggtttctatagatgtgagacagatttgagagagcatttactctgtctccctgtggatgaaactgctgctgaaatggttccaatttttaggaatctgcttacccacttcattatttgacagctttccttggtgacccaaaccttgtagcctaagccatttgtctttttctcagtggagggagtgtatggacctggccccatggctttgcatgttagagacctggcagactaaagtctctagtgtttgtttgctcacatttgctgagtgacagctatgtgccagactgcataaagggtggtggcagaagtgaaaatgtttaagaatgaccaaaaacattagtaatgaaagttaatgtgttccaggcattcttctaagtggtttacatgcactgtctcatttaatctgagataaaggatacttaagcccaaactatatctaaacccaaatctcacttggctggaaacatcaatcttaaccatttattcagaaccattaaaccaatgattccaaaaaaaaaaagaagtcttattacggccagctatcgttagtaggtattagctgcctgcgcgttcacgcngcatggacatgggtctactagcntagaccactcgcgcggactgaagtcccatgtcctcactcatcttggcgccctcggcgggttgcgtgacaccgcctgtctttatgctaccagctggcttgcgcaaaatgctgcttgtcggttcacactcgtcggaattccgtt

SEQ ID NO: 37653 - DNA, 2778 bp, Homo sapiens
agacaaagcggaggccgagcccaggaagcaagcgcgctctccgccccgcctggagggagggcccaaccacagcacagccgcgctcactcctcacccggacgtgacctagttctcacagaggcccggcctcttccgccacaactccggcccgcggtcccgccccgttccgtgaatggtcggccggcctcaggtcaaaaaagcgtttaggtgtctgcgacggagcctccggagaaaggcaagcacgtcgcagccaatgaggtgatagaaacgcaaagcagcgaccaatgactagctgagttgggctgggccggccgacgaatcacgaggcttcgcacccggatatggttatgggctcggaaatctagttcgggaaaagtgtgaggggctcttcacgtggggaaggaacagcaggcgcggaggagggggcaagcgtgtgtgagattcagtggtccatgcgtgcgtttgtcgtgtaagggtcattcctggggtttggagtgggggaacaaatcaatgtggctgtttttccgtggaaagaattcccactgcagtgtcccggagcctgcgtgtggtgggcaagctcctcaaatggtatctcacagggaataggggagtcttgaaaacgcagcttcggcagtaggaacatgaacctcttacctaaaagttccagggagtttggctccgttgactattgggagaagttcttccagcagcgaggaaagaaagctttcgagtggtatggaacctacctggaactgtgcggggtgctacataaatatatcaagcccagggaaaaggtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaagcctgtgcggctggagagtgccgagcggctggccgaggcggtgcaggagcgacagcagtatgcctggctgtgcagccagctgcgccgcaaggccaggctggggagtgtgtctctggacttgtgcgatggggacacgggggagccacgctacaccctccacgtggtggacagccccactgtgaaaccatcgcgggacaatcattttgcgattttcatcatccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcccattcaagacgcttctctgacgacggccagtgcacatttgggatgcccaattcaacccaggatttggtacggaccccggagacagactgggaggcgttgcggatgacacgcatgtcttgctcacataatgattcacagtcgatgaaaatatgtctgactgcttagcgccagcgacacttcctgcttagc

SEQ ID NO: 37654 - DNA, 2617 bp, Homo sapiens
agacaaagcggaggccgagcccaggaagcaagcgcgctctccgccccgcctggagggagggcccaaccacagcacagccgcgctcactcctcacccggacgtgacctagttctcacagaggcccggcctcttccgccacaactccggcccgcggtcccgccccgttccgtgaatggtcggccggcctcaggtcaaaaaagcgtttaggtgtctgcgacggagcctccggagaaaggcaagcacgtcgcagccaatgaggtgatagaaacgcaaagcagcgaccaatgactagctgagttgggctgggccggccgacgaatcacgaggcttcgcacccggatatggttatgggctcggaaatctagttcgggaaaagtgtgaggggctcttcacgtggggaaggaacagcaggcgcggaggagggggcaagcgtgtgtgagattcagtggtccatgcgtgcgtttgtcgtgtaagggtcattcctggggtttggagtgggggaacaaatcaatgtggctgtttttccgtggaaagaattcccactgcagtgtcccggagcctgcgtgtggtgggcaagctcctcaaatggtatctcacagggaataggggagtcttgaaaacgcagcttcggcagtaggaacatgaacctcttacctaaaagttccagggagtttggctccgttgactattgggagaagttcttccagcagcgaggaaagaaagctttcgagtggtatggaacctacctggaactgtgcggggtgctacataaatatatcaagcccagggaaaaggtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaagcctgtgcggctggagagtgccgagcggctggccgaggcggtgcaggagcgacagcagtatgcctggctgtgcagccagctgcgccgcaaggccaggctggggagtgtgtctctggacttgtgcgatggggacacgggggagccacgctacaccctccacgtggtggacagccccactgtgaaaccatcgcgggacaatcattttgcgattttcatcatccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaagggtcaccagatcctcctcctcctgcaggctcaccatggcttcaaaagaattcagtgttctgcaagactcttcagtcctactactgctctctattgagattggatcatgtgcccataatccaagagatttccttcaaatctgtgtaccaggt

SEQ ID NO: 37655 - DNA, 2428 bp, Homo sapiens
agacaaagcggaggccgagcccaggaagcaagcgcgctctccgccccgcctggagggagggcccaaccacagcacagccgcgctcactcctcacccggacgtgacctagttctcacagaggcccggcctcttccgccacaactccggcccgcggtcccgccccgttccgtgaatggtcggccggcctcaggtcaaaaaagcgtttaggtgtctgcgacggagcctccggagaaaggcaagcacgtcgcagccaatgaggtgatagaaacgcaaagcagcgaccaatgactagctgagttgggctgggccggccgacgaatcacgaggcttcgcacccggatatggttatgggctcggaaatctagttcgggaaaagtgtgaggggctcttcacgtggggaaggaacagcaggcgcggaggagggggcaagcgtgtgtgagattcagtggtccatgcgtgcgtttgtcgtgtaagggtcattcctggggtttggagtgggggaacaaatcaatgtggctgtttttccgtggaaagaattcccactgcagtgtcccggagcctgcgtgtggtgggcaagctcctcaaatggtatctcacagggaataggggagtcttgaaaacgcagcttcggcagtaggaacatgaacctcttacctaaaagttccagggagtttggctccgttgactattgggagaagttcttccagcagcgaggaaagaaagctttcgagtggtatggaacctacctggaactgtgcggggtgctacataaatatatcaagcccagggaaaaggtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaagcctgtgcggctggagagtgccgagcggctggccgaggcggtgcaggagcgacagcagtatgcctggctgtgcagccagctgcgccgcaaggccaggctggggagtgtgtctctggacttgtgcgatggggacacgggggagccacgctacaccctccacgtggtggacagccccactgtgaaaccatcgcgggacaatcattttgcgattttcatcatccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctaggtgagagagatgccactgccttccacagaagggagcataaagattacagacctaaacaattggtgtcacttgcattgtagttgaagaacagcaattacaagctgacaatgtatctttcttcatctcaaccatgttataagttaatgagcattctaattaactgttgcctcaaactcaacctgttatattgaaattgtattgaaatatgttagagtctaagtggtattttttctgttcatttctttttaaaattaaggtatatcatgtattcaatgagatatgtaaaaatacacagattttaattgttcaaatt

SEQ ID NO: 37656 - DNA, 1428 bp, Homo sapiens
  misc_feature (1263)..(1263): n is a, c, g, or t
  misc_feature (1286)..(1286): n is a, c, g, or t
aaaaagattcaccggtggtcaggtctcactgcagtgatcctctccaatatagtccggaggacatgaagcttaacacaagtgacgcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttgtcctcttcagtaccacttgggttggtttgtctttgcttcctacaccacgtccttgagtggagttccctgctgaagcccctagcacacactgcatgccttaacaagtgtgtgcaagcccctcagaactcaagacatccaaattttattgcgtctctacttatactggtttgcttttgatttattcctctattagttctataggagtgatctcaagtgagatagcagagcaagatgccaaaagaccataaatagagtaaggtttctatagatgtgagacagatttgagagagcatttactctgtctccctgtggatgaaactgctgctgaaatggttccaatttttaggaatctgcttacccacttcattatttgacagctttccttggtgacccaaaccttgtagcctaagccatttgtctttttctcagtggagggagtgtatggacctggccccatggctttgcatgttagagacctggcagactaaagtctctagtgtttgtttgctcacatttgctgagtgacagctatgtgccagactgcataaagggtggtggcagaagtgaaaatgtttaagaatgaccaaaaacattagtaatgaaagttaatgtgttccaggcattcttctaagtggtttacatgcactgtctcatttaatctgagataaaggatacttaagcccaaactatatctaaacccaaatctcacttggctggaaacatcaatcttaaccatttattcagaaccattaaaccaatgattccaaaaaaaaaaagaagtcttattacggccagctatcgttagtaggtattagctgcctgcgcgttcacgcngcatggacatgggtctactagcntagaccactcgcgcggactgaagtcccatgtcctcactcatcttggcgccctcggcgggttgcgtgacaccgcctgtctttatgctaccagctggcttgcgcaaaatgctgcttgtcggttcacactcgtcggaattccgtt

SEQ ID NO: 37657 - DNA, 137 bp, Homo sapiens
catgcttttctccatctgcctttctatgctgtgtattctctgcaaactcatcaccaccgtgtgttttagtccaccagtctccctgggacaggaattggtattttcctcaaagccgatccttgtctttcatatgtctc

SEQ ID NO: 37658 - DNA, 3471 bp, Homo sapiens
  misc_feature (3306)..(3306): n is a, c, g, or t
  misc_feature (3329)..(3329): n is a, c, g, or t
agacaaagcggaggccgagcccaggaagcaagcgcgctctccgccccgcctggagggagggcccaaccacagcacagccgcgctcactcctcacccggacgtgacctagttctcacagaggcccggcctcttccgccacaactccggcccgcggtcccgccccgttccgtgaatggtcggccggcctcaggtcaaaaaagcgtttaggtgtctgcgacggagcctccggagaaaggcaagcacgtcgcagccaatgaggtgatagaaacgcaaagcagcgaccaatgactagctgagttgggctgggccggccgacgaatcacgaggcttcgcacccggatatggttatgggctcggaaatctagttcgggaaaagtgtgaggggctcttcacgtggggaaggaacagcaggcgcggaggagggggcaagcgtgtgtgagattcagtggtccatgcgtgcgtttgtcgtgtaagggtcattcctggggtttggagtgggggaacaaatcaatgtggctgtttttccgtggaaagaattcccactgcagtgtcccggagcctgcgtgtggtgggcaagctcctcaaatggtatctcacagggaataggggagtcttgaaaacgcagcttcggcagtaggaacatgaacctcttacctaaaagttccagggagtttggctccgttgactattgggagaagttcttccagcagcgaggaaagaaagctttcgagtggtatggaacctacctggaactgtgcggggtgctacataaatatatcaagcccagggaaaaggtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcagtccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttgtcctcttcagtaccacttgggttggtttgtctttgcttcctacaccacgtccttgagtggagttccctgctgaagcccctagcacacactgcatgccttaacaagtgtgtgcaagcccctcagaactcaagacatccaaattttattgcgtctctacttatactggtttgcttttgatttattcctctattagttctataggagtgatctcaagtgagatagcagagcaagatgccaaaagaccataaatagagtaaggtttctatagatgtgagacagatttgagagagcatttactctgtctccctgtggatgaaactgctgctgaaatggttccaatttttaggaatctgcttacccacttcattatttgacagctttccttggtgacccaaaccttgtagcctaagccatttgtctttttctcagtggagggagtgtatggacctggccccatggctttgcatgttagagacctggcagactaaagtctctagtgtttgtttgctcacatttgctgagtgacagctatgtgccagactgcataaagggtggtggcagaagtgaaaatgtttaagaatgaccaaaaacattagtaatgaaagttaatgtgttccaggcattcttctaagtggtttacatgcactgtctcatttaatctgagataaaggatacttaagcccaaactatatctaaacccaaatctcacttggctggaaacatcaatcttaaccatttattcagaaccattaaaccaatgattccaaaaaaaaaaagaagtcttattacggccagctatcgttagtaggtattagctgcctgcgcgttcacgcngcatggacatgggtctactagcntagaccactcgcgcggactgaagtcccatgtcctcactcatcttggcgccctcggcgggttgcgtgacaccgcctgtctttatgctaccagctggcttgcgcaaaatgctgcttgtcggttcacactcgtcggaattccgtt

SEQ ID NO: 37659 - DNA, 2927 bp, Homo sapiens
agacaaagcggaggccgagcccaggaagcaagcgcgctctccgccccgcctggagggagggcccaaccacagcacagccgcgctcactcctcacccggacgtgacctagttctcacagaggcccggcctcttccgccacaactccggcccgcggtcccgccccgttccgtgaatggtcggccggcctcaggtcaaaaaagcgtttaggtgtctgcgacggagcctccggagaaaggcaagcacgtcgcagccaatgaggtgatagaaacgcaaagcagcgaccaatgactagctgagttgggctgggccggccgacgaatcacgaggcttcgcacccggatatggttatgggctcggaaatctagttcgggaaaagtgtgaggggctcttcacgtggggaaggaacagcaggcgcggaggagggggcaagcgtgtgtgagattcagtggtccatgcgtgcgtttgtcgtgtaagggtcattcctggggtttggagtgggggaacaaatcaatgtggctgtttttccgtggaaagaattcccactgcagtgtcccggagcctgcgtgtggtgggcaagctcctcaaatggtatctcacagggaataggggagtcttgaaaacgcagcttcggcagtaggaacatgaacctcttacctaaaagttccagggagtttggctccgttgactattgggagaagttcttccagcagcgaggaaagaaagctttcgagtggtatggaacctacctggaactgtgcggggtgctacataaatatatcaagcccagggaaaaggtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaagcctgtgcggctggagagtgccgagcggctggccgaggcggtgcaggagcgacagcagtatgcctggctgtgcagccagctgcgccgcaaggccaggctggggagtgtgtctctggacttgtgcgatggggacacgggggagccacgctacaccctccacgtggtggacagccccactgtgaaaccatcgcgggacaatcattttgcgattttcatcatccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttccca

SEQ ID NO: 37660 - DNA, 3766 bp, Homo sapiens
  misc_feature (3601)..(3601): n is a, c, g, or t
  misc_feature (3624)..(3624): n is a, c, g, or t
agacaaagcggaggccgagcccaggaagcaagcgcgctctccgccccgcctggagggagggcccaaccacagcacagccgcgctcactcctcacccggacgtgacctagttctcacagaggcccggcctcttccgccacaactccggcccgcggtcccgccccgttccgtgaatggtcggccggcctcaggtcaaaaaagcgtttaggtgtctgcgacggagcctccggagaaaggcaagcacgtcgcagccaatgaggtgatagaaacgcaaagcagcgaccaatgactagctgagttgggctgggccggccgacgaatcacgaggcttcgcacccggatatggttatgggctcggaaatctagttcgggaaaagtgtgaggggctcttcacgtggggaaggaacagcaggcgcggaggagggggcaagcgtgtgtgagattcagtggtccatgcgtgcgtttgtcgtgtaagggtcattcctggggtttggagtgggggaacaaatcaatgtggctgtttttccgtggaaagaattcccactgcagtgtcccggagcctgcgtgtggtgggcaagctcctcaaatggtatctcacagggaataggggagtcttgaaaacgcagcttcggcagtaggaacatgaacctcttacctaaaagttccagggagtttggctccgttgactattgggagaagttcttccagcagcgaggaaagaaagctttcgagtggtatggaacctacctggaactgtgcggggtgctacataaatatatcaagcccagggaaaaggtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaagcctgtgcggctggagagtgccgagcggctggccgaggcggtgcaggagcgacagcagtatgcctggctgtgcagccagctgcgccgcaaggccaggctggggagtgtgtctctggacttgtgcgatggggacacgggggagccacgctacaccctccacgtggtggacagccccactgtgaaaccatcgcgggacaatcattttgcgattttcatcatccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttgtcctcttcagtaccacttgggttggtttgtctttgcttcctacaccacgtccttgagtggagttccctgctgaagcccctagcacacactgcatgccttaacaagtgtgtgcaagcccctcagaactcaagacatccaaattttattgcgtctctacttatactggtttgcttttgatttattcctctattagttctataggagtgatctcaagtgagatagcagagcaagatgccaaaagaccataaatagagtaaggtttctatagatgtgagacagatttgagagagcatttactctgtctccctgtggatgaaactgctgctgaaatggttccaatttttaggaatctgcttacccacttcattatttgacagctttccttggtgacccaaaccttgtagcctaagccatttgtctttttctcagtggagggagtgtatggacctggccccatggctttgcatgttagagacctggcagactaaagtctctagtgtttgtttgctcacatttgctgagtgacagctatgtgccagactgcataaagggtggtggcagaagtgaaaatgtttaagaatgaccaaaaacattagtaatgaaagttaatgtgttccaggcattcttctaagtggtttacatgcactgtctcatttaatctgagataaaggatacttaagcccaaactatatctaaacccaaatctcacttggctggaaacatcaatcttaaccatttattcagaaccattaaaccaatgattccaaaaaaaaaaagaagtcttattacggccagctatcgttagtaggtattagctgcctgcgcgttcacgcngcatggacatgggtctactagcntagaccactcgcgcggactgaagtcccatgtcctcactcatcttggcgccctcggcgggttgcgtgacaccgcctgtctttatgctaccagctggcttgcgcaaaatgctgcttgtcggttcacactcgtcggaattccgtt

SEQ ID NO: 37661 - DNA, 2789 bp, Homo sapiens
agacaaagcggaggccgagcccaggaagcaagcgcgctctccgccccgcctggagggagggcccaaccacagcacagccgcgctcactcctcacccggacgtgacctagttctcacagaggcccggcctcttccgccacaactccggcccgcggtcccgccccgttccgtgaatggtcggccggcctcaggtcaaaaaagcgtttaggtgtctgcgacggagcctccggagaaaggcaagcacgtcgcagccaatgaggtgatagaaacgcaaagcagcgaccaatgactagctgagttgggctgggccggccgacgaatcacgaggcttcgcacccggatatggttatgggctcggaaatctagttcgggaaaagtgtgaggggctcttcacgtggggaaggaacagcaggcgcggaggagggggcaagcgtgtgtgagattcagtggtccatgcgtgcgtttgtcgtgtaagggtcattcctggggtttggagtgggggaacaaatcaatgtggctgtttttccgtggaaagaattcccactgcagtgtcccggagcctgcgtgtggtgggcaagctcctcaaatggtatctcacagggaataggggagtcttgaaaacgcagcttcggcagtaggaacatgaacctcttacctaaaagttccagggagtttggctccgttgactattgggagaagttcttccagcagcgaggaaagaaagctttcgagtggtatggaacctacctggaactgtgcggggtgctacataaatatatcaagcccagggaaaaggtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaagcctgtgcggctggagagtgccgagcggctggccgaggcggtgcaggagcgacagcagtatgcctggctgtgcagccagctgcgccgcaaggccaggctggggagtgtgtctctggacttgtgcgatggggacacgggggagccacgctacaccctccacgtggtggacagccccactgtgaaaccatcgcgggacaatcattttgcgattttcatcatccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttccagctttaggggaaaaaaatttaaaacaggcattggaacggacactgagacagcctgggactcgttaggatgacaacctatgtcttcgctgagatatgactccagtcgatgacaagttgtgtgactggctctagaaccagtcagcactactgtcatagtcaatatta

SEQ ID NO: 37662 - DNA, 2663 bp, Homo sapiens
agacaaagcggaggccgagcccaggaagcaagcgcgctctccgccccgcctggagggagggcccaaccacagcacagccgcgctcactcctcacccggacgtgacctagttctcacagaggcccggcctcttccgccacaactccggcccgcggtcccgccccgttccgtgaatggtcggccggcctcaggtcaaaaaagcgtttaggtgtctgcgacggagcctccggagaaaggcaagcacgtcgcagccaatgaggtgatagaaacgcaaagcagcgaccaatgactagctgagttgggctgggccggccgacgaatcacgaggcttcgcacccggatatggttatgggctcggaaatctagttcgggaaaagtgtgaggggctcttcacgtggggaaggaacagcaggcgcggaggagggggcaagcgtgtgtgagattcagtggtccatgcgtgcgtttgtcgtgtaagggtcattcctggggtttggagtgggggaacaaatcaatgtggctgtttttccgtggaaagaattcccactgcagtgtcccggagcctgcgtgtggtgggcaagctcctcaaatggtatctcacagggaataggggagtcttgaaaacgcagcttcggcagtaggaacatgaacctcttacctaaaagttccagggagtttggctccgttgactattgggagaagttcttccagcagcgaggaaagaaagctttcgagtggtatggaacctacctggaactgtgcggggtgctacataaatatatcaagcccagggaaaaggtgctggtgattgggtgtggcaactcagaactgagtgagcaactgtatgatgtgggctatcgggatatagtgaacatcgacatcagtgaggttgtcatcaagcaaatgaaggaatgtaatgccacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaagcctgtgcggctggagagtgccgagcggctggccgaggcggtgcaggagcgacagcagtatgcctggctgtgcagccagctgcgccgcaaggccaggctggggagtgtgtctctggacttgtgcgatggggacacgggggagccacgctacaccctccacgtggtggacagccccactgtgaaaccatcgcgggacaatcattttgcgattttcatcatccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtcccctttctgtctgtgggtggggacattggggtccggaccgttcagcaccaagactgcagccccttgagcggtgactatgtcattgaggatgtgcaaggggatgacaagcgatacttccgtcgactgatcttcctcagcaacaggaatgtggtgcagtccgaagccaggttgctgaaggatgtgtctcacaaagcccagaagaagcggaaaaaggacaggaagaagcagcggcctgctgatgcggaggacctccctgcagccccggggcagtccattgataagagttacctgtgttgtgaacaccacaaagccatgatcgctggccttgccctgctgagaaacccagagctactcctagagatcccactggcattgttggtggtaggcctgggcgggggcagcctccccctctttgtccacgatcattttccaaagtcctgcattgatgctgtggagatcgatccctccatgttggaagtggccacccagtggtttggcttctcccagagtgaccgaatgaaggtccacattgcagatggcctggactatatcgccagcttggcaggaggaggagaagcacggccttgctacgatgtcataatgtttgatgttgacagtaaggacccaacactgggaatgagttgtccgcccccagcatttgtggagcaatcttttctacagaaggttaaaagcatcttgactcctgaaggtatggagaacaaaaggtgggagagggaggagagaagggaccattaacaaaaattatctttttaatgaaaaatgcacagaagtgcgagctcgatcaatttttccaaatttaatacacccatttactagcactagacacagaaaatttccagcttgccagaaagtcgtatctcttatcccctttcagtaacttgtcct

SEQ ID NO: 37663 - DNA, 1501 bp, Homo sapiens
  misc_feature (1336)..(1336): n is a, c, g, or t
  misc_feature (1359)..(1359): n is a, c, g, or t
tcctaccgaacgttgtacccatctcgactccttaatgtttgtcttttctctaccctttttgaaattgttctccgataaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttgtcctcttcagtaccacttgggttggtttgtctttgcttcctacaccacgtccttgagtggagttccctgctgaagcccctagcacacactgcatgccttaacaagtgtgtgcaagcccctcagaactcaagacatccaaattttattgcgtctctacttatactggtttgcttttgatttattcctctattagttctataggagtgatctcaagtgagatagcagagcaagatgccaaaagaccataaatagagtaaggtttctatagatgtgagacagatttgagagagcatttactctgtctccctgtggatgaaactgctgctgaaatggttccaatttttaggaatctgcttacccacttcattatttgacagctttccttggtgacccaaaccttgtagcctaagccatttgtctttttctcagtggagggagtgtatggacctggccccatggctttgcatgttagagacctggcagactaaagtctctagtgtttgtttgctcacatttgctgagtgacagctatgtgccagactgcataaagggtggtggcagaagtgaaaatgtttaagaatgaccaaaaacattagtaatgaaagttaatgtgttccaggcattcttctaagtggtttacatgcactgtctcatttaatctgagataaaggatacttaagcccaaactatatctaaacccaaatctcacttggctggaaacatcaatcttaaccatttattcagaaccattaaaccaatgattccaaaaaaaaaaagaagtcttattacggccagctatcgttagtaggtattagctgcctgcgcgttcacgcngcatggacatgggtctactagcntagaccactcgcgcggactgaagtcccatgtcctcactcatcttggcgccctcggcgggttgcgtgacaccgcctgtctttatgctaccagctggcttgcgcaaaatgctgcttgtcggttcacactcgtcggaattccgtt

SEQ ID NO: 37664 - DNA, 1270 bp, Homo sapiens
ccaaggtcccccaggcctgaagcagatgcatctcagacctcctccccacctcacccagttggtcaccgaggtctgctaatccttgctccgaaatgtttcacagctctgtccttttcgagctgttggctccagttccagctgcatctctagcctgctatgttcagcattttcctggtggctgtgtcttgtttccctcaaaggcacctgtgcactgtcatcagagtcatcttataatgagtctggggtcttgctgtgctggaggatggggatgagctccctcagagtgtgagcctcaacagtcctcgcccacacacccgacagtgtgcgcccactgtccccagccttgagtgctgcttctgtctcccgagtcacatgggagaacctcacacagctgactgttctcccggggtcccagtctgggtctcacctccactctcaggccccctctgctgggatacagtatccccgccccatcttatcctccgagttcagcttacatgccctcttcaggaacccttttcctcgggtttcctgcacataggcgtctctggaattggcatttatcaagctgtactctaactacttccacccccttcactaggttgtgggaggtttttgaggtcaaaactatgcctcattgatctttgtaacccccagcaaatgctcagtgcatacatgtttattgaacagatgaactgataaatggatgaatggctggatggcgtatcctgatctccagccccacacccgcacacggtggcagctgtggccaacctactcttttgcttttgcttggttccttccttccttacctcacaccacaaacaccttcatagacctgcctggggcccaacacctggctgcagcctctgcttggggtctctttgattcttccctttatgagagatttgaagcttcctttctggggttgtgtatctgctccccagacccagttacctgttcttcctcctgcaggtgtccctcgcccttttggtttgttcaaggagctgctgctttgcatagctgctctagtgtctggtatcatcggatctggttttgaataattcccaggagtcctgggtccctggcctccaaagctggaatgtgaacgcatgccacggtggtctgaccctcacactccttttctcttaacagcaaaatgcaatggaaggaagaaaagttccaacaaagaatgattttgtgaattctgtgatttttcttctgatcagtttcaatctgtaataaatgccttatttttcctgtaaaactt

SEQ ID NO: 37665 - DNA, 941 bp, Homo sapiens
atgatttccagaatggagaagatgacgatgatgatgaagatattgattatgtttgctcttggaatgaactactggtcttgctcaggtttcccagtgtacgactacgatccatcctccttaagggatgccctcagtgcctctgtggtaaaagtgaattcccagtcactgagtccgtatctgtttcgggcattcagaagctcattaaaaagagttgaggtcctagatgagaacaacttggtcatgaatttagagttcagcatccgggagacaacatgcaggaaggattctggagaagatcccgctacatgtgccttccagagggactactatgtgtccacagctgtttgcagaagcaccgtgaaggtatctgcccagcaggtgcagggcgtgcatgctcgctgcagctggtcctcctccacgtctgagtcttacagcagcgaagagatgatttttggggacatgttgggatctcataaatggagaaacaattatctatttggtctcatttcagacgagtccataagtgaacaattttatgatcggtcacttgggatcatgagaagggtattgcctcctggaaacagaaggtacccaaaccaccggcacagagcaagaataaatactgactttgagtaacggccttgaggtgtccctcgcccttttggtttgttcaaggagctgctgctttgcatagctgctctagtgtctggtatcatcggatctggttttgaataattcccaggagtcctgggtccctggcctccaaagctggaatgtgaacgcatgccacggtggtctgaccctcacactccttttctcttaacagcaaaatgcaatggaaggaagaaaagttccaacaaagaatgattttgtgaattctgtgatttttcttctgatcagtttcaatctgtaataaatgccttatttttcctgtaaaactt

SEQ ID NO: 37666 - DNA, 431 bp, Homo sapiens
atgatttccagaatggagaagatgacgatgatgatgaagatattgattatgtttgctcttggaatgaactactggtcttgctcaggtttcccagtgtacgactacgatccatcctccttaagggatgccctcagtgcctctgtggtaaaagtgaattcccagtcactgagtccgtatctgtttcgggcattcagaagctcattaaaaagattgacaaatgggatctaattaaactaaagagcttctgcacggcaaaataaactaccatcagagtgaacaggcaacctacagaatgggagaaaatttttgcaatctactcatctgacaaagggctaatatccagaatctacaatgaactcaaacaaatttacaagaaaaaaaacaaacaaccccatcaacaagtgggcgaaggatatgaacagacacttctc

SEQ ID NO: 37667 - DNA, 761 bp, Homo sapiens
atgatttccagaatggagaagatgacgatgatgatgaagatattgattatgtttgctcttggaatgaactactggtcttgctcaggtttcccagtgtacgactacgatccatcctccttaagggatgccctcagtgcctctgtggtaaaagtgaattcccagtcactgagtccgtatctgtttcgggcattcagaagctcattaaaaagagttgaggtcctagatgagaacaacttggtcatgaatttagagttcagcatccgggagacaacatgcaggaaggattctggagaagatcccgctacatgtgccttccagagggactactatgtgtccacagctgtttgcagaagcaccgtgaaggtatctgcccagcaggtgcagggcgtgcatgctcgctgcagctggtcctcctccacgtctgagtcttacagcagcgaagagatgatttttggggacatgttgggatctcataaatggagaaacaattatctatttggtctcatttcagacgagtccataagtgaacaattttatgatcggtcacttgggatcatgagaagggtattgcctcctggaaacagaaggtacccaaaccaccggcacagagcaagaataaatactgactttgagtaacggccttgagcaaaatgcaatggaaggaagaaaagttccaacaaagaatgattttgtgaattctgtgatttttcttctgatcagtttcaatctgtaataaatgccttatttttcctgtaaaactt

SEQ ID NO: 37668 - DNA, 1967 bp, Homo sapiens
  misc_feature (934)..(934): n is a, c, g, or t
  misc_feature (1250)..(1250): n is a, c, g, or t
  misc_feature (1916)..(1916): n is a, c, g, or t
aaacaaactattctgtataggtaatgaacgattttcaaaaatcttagatgaatcaatgagataacagccaaacactcactcaactggcatctactcaaaaagctattggtttctcatgattagctttgccaaaccatctccctagattatttttctttttaaatttcactttgcatttggttaatcattccctgggaaagcacacggggcaggtgggcctccttgtcttcactttgccattccctatctgatgaattctgaacctcagtttttcatccaagaactggagttaaaacacctgcactattatacagggcgtgaggctgttgtcatgataatcaatgagctgatgtgtggttgaagctcttatctgactccatagatagttttaaactacctaagtataaattcagcagctttgcttaagatttaaagcaggtattataaatatgcattcctttgccgatcttttaatagaaggacaggcctattcttttgaagatggatctgctgatgagagctcccctttgtctactttacatcaaccacacccttatttcattgttttgtgattccagtgttggtttctttaaagtaaaggaagaatttagatatttgccgagccattctgaatatagaaacttcctagatcgcatatcccttgatcttttatcgttaatttactctcatctaattaacagcgttttgtttttttttttagaaattgacttttattaagtctttccaaagtagccaacttagttttcaaagaaaatttctctctatttttatgttcatctaatcagtgacagtaataagtcaatcagctcatgtaatcccagtaacaaacagcaggattgtggacacacacagtggagccctgatatgctgcagctggacagtgggagctgagcaggcagggcacccccccccnccgccggccaggactccaggccttcggtgttcagtcttgccatggcatcagtcattggttttgtatagggagcagagaaggttatttaatctggttagtcagataagtggagtttactcgtatgtgaaattgctttctttgctgtgctgtgaggagctgtacaaatataaggtgctgttactgattattcagccaacatttatggactaccaactctgtacctggcacagttttggttctggggtcagagatgacaaactcctaccctgggagtccactgagcgaccataccaataggtcatggcctcagagccgngtggcccacggcccctgtgactctctctgctgtggacctttctcctagaacccgatcatcagccagttcttccccaccctcctgctctggtccttctcggccctgctcccctccattgtctactactctacactgctggagtctcactggaccaagtgagtgcccgggagccccgaggccctgcccctaagaaggatatctctgaccgctcccttgtccacaccctaaccccccagctgctcaggcagtgggcacatggcaggggcctcactggggcacatagagcatttgggggactgcgagtgctcacctttgacttcctgcaggtcgggggaaaaccagatcatgatgaccaaagtctacatattcttgatcttcatggtgctgatcctgccctccctgggtctcaccaggtatatgccaccaccttctgctctaaattcagaataagagtcacatcaggagagcactgtccccaggagaatgcaaacggtttggcagcagaagcaaacctctaacaatatctaagcctgtcgcaaccactcggcgtgcagtagggctgggtcattgattcttctggcaatatgattgattgttcttctttaaaaaagaaaaaaacaccatattggtcaggctgttcttgagctcctgacctcaggtgatccncccgcctcggcctcccaaagtgctgggattacaggcgtgagactctgtctc

SEQ ID NO: 37669 - DNA, 2150 bp, Homo sapiens
cttggttccaggcctgggtcctcctctgatctgctgtgtgaccgcatttgagtcacttcccctctttctcagtctcctgccatgcaaagaaggctcatagagttgctttggaagtggattctttgtacagcctggaagaagacgctgtgtaaatgacatgctttgggggctcccccggccacagaaggagaaaactggagccttctgatttcctgttgtttactttccagaggctggagttgggtaggaaacctgagcataccggcacactggcttgtgggtgacttctctccctgctgtatttcccggacaggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaatcacatggcaggcaagtttgtgaattaatggcagagaaggaatcctggtccccctgggtattttaacctgcatatttgaaactgttgaggagatagagtcttgtctcgattcatggccatcccccttggtttcagttccctgctctctttccttctctgcatatttaatgcctgccctacgtgcctcggattctgaacggcttggcctcggagaggacagcactgtctccgcagcagcagcagcagcagacctatggtgcc

SEQ ID NO: 37670 - DNA, 1975 bp, Homo sapiens
cttggttccaggcctgggtcctcctctgatctgctgtgtgaccgcatttgagtcacttcccctctttctcagtctcctgccatgcaaagaaggctcatagagttgctttggaagtggattctttgtacagcctggaagaagacgctgtgtaaatgacatgctttgggggctcccccggccacagaaggagaaaactggagccttctgatttcctgttgtttactttccagaggctggagttgggtaggaaacctgagcataccggcacactggcttgtgggtgacttctctccctgctgtatttcccggacaggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaccctacgtgcctcggattctgaacggcttggcctcggagaggacagcactgtctccgcagcagcagcagcagcagacctatggtgcc

SEQ ID NO: 37671 - DNA, 1488 bp, Homo sapiens
cttggttccaggcctgggtcctcctctgatctgctgtgtgaccgcatttgagtcacttcccctctttctcagtctcctgccatgcaaagaaggctcatagagttgctttggaagtggattctttgtacagcctggaagaagacgctgtgtaaatgacatgctttgggggctcccccggccacagaaggagaaaactggagccttctgatttcctgttgtttactttccagaggctggagttgggtaggaaacctgagcataccggcacactggcttgtgggtgacttctctccctgctgtatttcccggacaggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccagccttccagtacgagtttggaccattcactcgccgcgatctctagagt

SEQ ID NO: 37672 - DNA, 1698 bp, Homo sapiens
cttggttccaggcctgggtcctcctctgatctgctgtgtgaccgcatttgagtcacttcccctctttctcagtctcctgccatgcaaagaaggctcatagagttgctttggaagtggattctttgtacagcctggaagaagacgctgtgtaaatgacatgctttgggggctcccccggccacagaaggagaaaactggagccttctgatttcctgttgtttactttccagaggctggagttgggtaggaaacctgagcataccggcacactggcttgtgggtgacttctctccctgctgtatttcccggacaggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtgagtgcccgggagccccgaggccctgcccctaagaaggatatctctgaccgctcccttgtccacaccctaaccccccagctgctcaggcagtgggcacatggcaggggcctcactggggcacatagagcatttgggggactgcgagtgctcacctttgacttcctgcaggtcgggggaaaaccagatcatgatgaccaaagtctacatattcttgatcttcatggtgctgatcctgccctccctgggtctcaccaggtatatgccaccaccttctgctctaaattcagaataagagtcacatcaggagagcactgtccccaggagaatgcaaacggtttggcagcagaagcaaacctctaacaatatctaagcctgtcgcaaccactcggcgtgcagtagggctgggtcattgattcttctggcaatatgattgattgttcttctttaaaaaagaaaaaaacaccatattggtcaggctgttcttgagctcctgaaaaagataatccaccccctcgaaaacaaagtgtaggttaaaagagaagactctgactcaaaaatataaaaggaaaaaga

SEQ ID NO: 37673 - DNA, 453 bp, Homo sapiens
agtagcctgggcctggctgttgctacatttccttgcagcatcctgaaagatttcaatgcctgcaagtgtcagagccttcagtgcaaaggtgagccccagccgtcctcccatagcagggagctctatacctccaagtggacagtcacctttgctgctgaccctgaggacatctgctggtaagctcctagaccaaggagaggtgggagagaggcctgggttcctggtgggagctgcccatcacctggagcacaggtgtgacctggcagtcaatggagatctccacacatctgcaattctgtgggctgtgatgctgtgatgtgctcggtgtggcccaactggggtatctgcccagcccttccctccagtgttcctccctagcattcaagtgctacccagcagaaatataatgccagttctgcatctaattttaaatttcctaatagccatgctaaa

SEQ ID NO: 37674 - DNA, 1684 bp, Homo sapiens
gaacctgggaggcagaggttgcagtgagccgagatcacaccactgcactctagcctgggtgactgagcaagactctgtctcccaaaaaaaaaaaacagaaaaagaaaaaataaatgccatgctggagccttgtttggcctgcttgggtgctcatgccatctctttgggtaggttctggcccccagactttagctggggagccacatctgagagaataattgttccctctgagctcttggggacctaagatttggtctttctgtagttgaaggtcagtgcagagaacttgcccccaggctagtctcttggtctgcctaaatctgaccttctgacccacctaagccacgagcactgggagacaagcctcgagacctgtatcccctctcccgctgcaggaagaacctctctatccagggcctccgctggtggctacagtggctgggcatcaacttcaccctcttcctggggctatttttcctgaccacaccctccatcatcctgtccaccatggacaagtttaatgtcaccaaacccatccatgcgctgaataacccgatcatcagccagttcttccccaccctcctgctctggtccttctcggccctgctcccctccattgtctactactctacactgctggagtctcactggaccaagtcgggggaaaaccagatcatgatgaccaaagtctacatattcttgatcttcatggtgctgatcctgccctccctgggtctcaccagtctagattttttcttccggtggctctttgacaaaacttcctcggaggcctccatcaggttggagtgcgtcttcctgcctgaccagggtgccttctttgtgaactatgtcatcgcctcggccttcatcggcaatggcatggagctgctgcggctgccaggtctcatcctctataccttccgcatgatcatggccaagacggctgctgaccgcaggaatgtcaagcagaaccaggccttccagtacgagtttggagccatgtatgcatggatgctgtgtgtcttcactgtcatcgtggcctacagcatcacttgtcccatcatcgcgccatttggcctcatctacatcctgctcaagcacatggtggaccggcacaacctctacttcgtctacctcccagccaagctggagaaggggatccactttgccgctgtgaaccaggccttggcagcccccatcctgtgcctcttctggctctacttcttttccttcctgcgcctgggtatgaaggcccccgccactctgttcaccttcctggtgctgctgctcaccatcctggtctgcctggctcacacctgctttggatgcttcaagcacctcagccctctgaactacaaaacagaagagcctgcaagtgacaaaggaagtgaggcagaggcccacatgcccccaccgttcacaatcacatggcaggcaagtttgtgaattaatggcagagaaggaatcctggtccccctgggtattttaacctgcatatttgaaactgttgaggagatagagtcttgtctcgattcatggccatcccccttggtttcagttccctgctctctttccttctctgcatatttaatgcctgccctacgtgcctcggattctgaacggcttggcctcggagaggacagcactgtctccgcagcagcagcagcagcagacctatggtgcc

SEQ ID NO: 37675 - DNA, 1302 bp, Homo sapiens
cttggttccaggcctgggtcctcctctgatctgctgtgtgaccgcatttgagtcacttcccctctttctcagtctcctgccatgcaaagaaggctcatagagttgctttggaagtggattctttgtacagcctggaagaagacgctgtgtaaatgacatgctttgggggctcccccggccacagaaggagaaaactggagccttctgatttcctgttgtttactttccagaggctggagttgggtaggaaacctgagcataccggcacactggcttgtgggtgacttctctccctgctgtatttcccggacaggtgaggcggaccctgttcatcacaggactccccagagatgccaggaaggagactgtggagagccacttccgggacgcgtatcccacgtgtgaggtggttgatgtgcagctgtgctacaacgtggccaaactgatctacctgtgcaaggagaaaaagaagactgagaagagcctgacctattacacaaacctgcaggtgaagacaggccagcggaccctcatcaaccccaagccctgtggccagttttgctgctgtgaagtgctgggctgtgagtgggaagacgccatctcttactacacacggatgaaggacaggctgctggagaggatcacagaggaagaacgccacgtccaggaccagcccctgggaatggccttcgtcaccttccaggagaagtccatggccacctacatcctgaaagatttcaatgcctgcaagtgtcagagccttcagtgcaaaggtgagccccagccgtcctcccatagcagggagctctatacctccaagtggacagtcacctttgctgctgaccctgaggacatctgctggtaagctcctagaccaaggagaggtgggagagaggcctgggttcctggtgggagctgcccatcacctggagcacaggtgtgacctggcagtcaatggagatctccacacatctgcaattctgtgggctgtgatgctgtgatgtgctcggtgtggcccaactggggtatctgcccagcccttccctccagtgttcctccctagcattcaagtgctacccagcagaaatataatgccagttctgcatctaattttaaatttcctaatagccatgctaaaaaagtaaaaagaaacagttgaaattaattttaataatgtatctcgcccaatatatccaaactgttatttcaacatgcaatttttgaaaaatgtgagatgttttacattctctttttcacacttagtcttcaatatctggtgtgtattttacacttctagcacct

SEQ ID NO: 37676 - DNA, 178 bp, Homo sapiens
cagcatggggccacgtcatcccaatgggatgtgtcttgtggcaggaagacgccatctcttactacacacggatgaaggacaggctgctggagaggatcacagaggaagaacgccacgtccaggaccagcccctgggaatggccttcgtcaccttccaggagaagtccatggccaccta

SEQ ID NO: 37677 - DNA, 645 bp, Homo sapiens
caatgctgttgcagatagaactgttttcttaatttcctttttgaattatttatagtatataactctatgcaactgatttgtatgtgttgatttttatatactgcagctttgctgaatttgtttgttctaatggttttttttggtggaatcttcagggtcttaacttagtttttgatccctaaaattagtgctgcatatgtagactcagaaacctcacgtaaaaatttaaattggcctcaggttggcaatgttccaaggcaatggttagaagcaaattcagattctccaaggcctcaaataattcctacagataaaatcccaaggaaattcagcagtgcctagtcaaaaatccacaaatcaggcaaggtaataaggcactatgaataagaacctaagaaaaagtacacaacaaaaacacatccgccctcgggaggctgaggcaggagaatggcttgaacccgggaggcaaagcttgcagtgagccgacatcatgccactacactccagcctgggcgacagagcaagactccgtctcaaaaaaaaaccaaaaaaaccaacaaaaaaaccacacccaccaaagcttcggattatataagaaatataaaaacacgtttattatgatgaaagaaataaaatagaaacctg

SEQ ID NO: 37678 - DNA, 418 bp, Homo sapiens
gcatatatttagtaacttttttgtagagattattgatgagattatttagagagaatgtttattgaagaatggtgttgaaaatgtaaggaaaataatttttaaactggttttctgggatgatttatttatagtcttgtgcagtcatgggcaaggattggaatatttttcagtcctcactagatctctgaatctatgacttattttgttaacttaaaattacatgcatgtttggggattgtcttgttattcaaaacagtgacataatggatatatttgatttttcaaggtctttgatcttttatgatttcatttattaactattagagaattgttattactctgttaataatgattaagttattctgaagaaacgtacaggaaaatattttgaaaaaaatttaaaacttccatggtcaga

SEQ ID NO: 37679 - DNA, 1451 bp, Homo sapiens
gtatcaacgcagagtgcccattacggccgggtaatgtctttaacagcaatcttttatttatttatttatttatttttgagacggagtcttgctgtgtcaccaggctggagcagtggcacgatctcgcctcactgcaacctccgcctcccaggttcaagctattctcctgcctcagcctcccaagtaactgggactgcaggcacatgccaccacatccagctaattttgtatttttagtagagacggggtttcaccttgttggccaggatgatctcgatctcttgatctcgtgatctgcccgcattggcctcctgaagtgctgggattacaggcatgagccactgcgcccggcccaaatcttttattttttaacagccttagttatttataattcaaatgcactaaaatatcatcgctgtcatgaactttgctgtttacaggttctgtgtaattcagaatgctttgtacttagaaaataatttctaggcttatcttgttttgcagttttcatgttttgacaattgcccaccatttacaatactcaatttttgattatgaaatgaatagtaaaattcaaacatatctaataataatttgccttagtttgattaataaattatatcaaaaaacttggggatagaaagaggcttttttttccccctgtagtatttttaaaactttttagatgagctggatgaaaccttagtacattggagctggagttgtattgagtacagccccaactctgaagccttatattcatgtcttaagtaccattgattgttctgtgaattgttgttagtttcatatttgacattgtagtaatccaccttgcattttagtctttgcaaaaaggatattgctaggtatattcttatttctgattgagtattgaatttacatttttcagaatttcattctttgtcattataatccaaaaacaatgtccacatcagacttggaacttctcacttcaaaaatgaaatacagatttagcagtgttgtacataatgatgtccaagcatttttccacctgtttactgagttttccaaccatttactatgtgttgagattggtgggttttctggctgtttttctgaggtgaatgacttgttacagagcctcagtaagaaatttcaactaaaatcacaaaaacataaagtccaggaaaccaccagaagatggatttttagtgtttttgaaatcttgtatttccttttgatatcatttactcattttaattttacgactgccaacttgttacggtattaattatatgtatgtgtttatatgtatgcatataatatatgtatatgtatatgaagaataaagttaagatttggtcaaactatattttcccattcaagtacaaaaatgttttcaaggctgcaaaaagtgtacagttgttaaacaagttgtaaataaagacttgtataaaaattcaaaaaaa

SEQ ID NO: 37680 - DNA, 522 bp, Homo sapiens
tatattaatattcaaatcatagttcaaaaatactgaaatacttgtttattatgttacataaatatggacacaattactgccaaagaatagagagatttgcttatgagaacattctgtcatttgttctgtttgtagatgagagacatgcttttaaagtacaaaacgtttctcttctaccttaccccctgttctactgacgtgctttgcatgagaagctcatctagaagagagcaacgctggaatagagaagtctagaccctggcctttgagggaaaggactgctttttttctctcccaaagtgctgggattattataggtgtgagccaccatgcccagtgaacttggccattttcttacattcatatatagcaaagttttcaacttgtctaccgagagactttctttaggagccaggacttctacatttgtaacttgagtatattaatattcaaatcatagttcaaaaatactgaaatacttgtttattatgtacataatatgacacaatactgctaagaaca

SEQ ID NO: 37681 - DNA, 3251 bp, Homo sapiens
tatattaatattcaaatcatagttcaaaaatactgaaatacttgtttattatgttacataaatatggacacaattactgccaaagaatagagagatttgcttatgagaacattctgtcatttgttctgtttgtagatgagagacatgcttttaaagtacaaaacgtttctcttctaccttaccccctgttctactgacgtgctttgcatgagaagctcatctagaagagagcaacgctggaatagagaagtctagaccctggcctttgagggaaaggactgctttttttctctcccaaattagaaaattaaaagtgaaacataacacataaggacgaaatacaatgttctgaatatcttccactaattaattgttgaatgattaagtctctaagtatcttaacttccattgtcttcttgttaacctagacaagagtagattattcagtagccacatgtgacagttaaaattaagtaaaattaaaactatagtttctcagtggcctagccacatttcaagtgttccacagtcacatgtggatagtagttacctatcagacagtacaggtatagaacatttccagtattgccaaaaatgctattcaacagcacttttattgcccagagagaaaataaggacaaaataaaggcagtgaagtaacttaagacaactctgagattttaccaccatacttagagaaagtttttctgttataaaaattaatactaatcctttttaaagaccttggaaaaaatcaaaaccccattcctttaagctagtcttcagtatatatttttctaagaacagattctcaatactttatttttcaagtgataaaatcattttataaatcatttcttaatatcttcagtgttttttccctttttatgtaaactcttttaaaattgatattagctgggcatggtagctcatgcctgtagtcccagctactccagaggtcgaggcaggagcatcgcttaagcccaggaggttcaggctgcagtaaggtctgatcacacctgactgcactccagcctgggtggcaaagcaagacccctgtctctaaaaaaaaataatataaattgatgttatatagttaacatttatcaggcaaattcatatgaatgcttatttcaaataaagattgatagatttaatgatatccttccttttaaatttatatagatctaatgaacattgccaacagttttttttgtttctgtcccttaaacatttcccctgaaagtccacctcaaaggtacatcaagatgcaaacaatttttttatcttcataacttcctgctcttattaacttgtattatgaatcaaattaagttttatgtataaggcatttactattccagtgacttagctaatgaaaacatttaaaaatatgtattaatttacttggcctgctactaaagtgcttaacataactaaatggatctatagtaacatgtctaaattttttaatggaaataagggactaaccataatccttttgagtcagcttggtgcttacaattattttgttaggaaatcttgatgctttcttctttctctttaaatttttgtaatcaagcaacagacttgatccagcagtgtcgaattccaagcaagttatgatgattcttattgtagttcaagtacagatgagtaagtggtgtgacttcagtttattatcttcttggtgacctactttagtatgtgttctgtagcgattcatattagttaagggacgttttcaatatgcttgaaataagaaatagcattttactctaaatacaagaaatgactgtacacaaatgctaatcagtgatttggggccttttaatgtctttaacagcaatcttttatttatttatttatttatttttgagacggagtcttgctgtgtcaccaggctggagcagtggcacgatctcgcctcactgcaacctccgcctcccaggttcaagctattctcctgcctcagcctcccaagtaactgggactgcaggcacatgccaccacatccagctaattttgtatttttagtagagacggggtttcaccttgttggccaggatgatctcgatctcttgatctcgtgatctgcccgcattggcctcctgaagtgctgggattacaggcatgagccactgcgcccggcccaaatcttttattttttaacagccttagttatttataattcaaatgcactaaaatatcatcgctgtcatgaactttgctgtttacaggttctgtgtaattcagaatgctttgtacttagaaaataatttctaggcttatcttgttttgcagttttcatgttttgacaattgcccaccatttacaatactcaatttttgattatgaaatgaatagtaaaattcaaacatatctaataataatttgccttagtttgattaataaattatatcaaaaaacttggggatagaaagaggcttttttttccccctgtagtatttttaaaactttttagatgagctggatgaaaccttagtacattggagctggagttgtattgagtacagccccaactctgaagccttatattcatgtcttaagtaccattgattgttctgtgaattgttgttagtttcatatttgacattgtagtaatccaccttgcattttagtctttgcaaaaaggatattgctaggtatattcttatttctgattgagtattgaatttacatttttcagaatttcattctttgtcattataatccaaaaacaatgtccacatcagacttggaacttctcacttcaaaaatgaaatacagatttagcagtgttgtacataatgatgtccaagcatttttccacctgtttactgagttttccaaccatttactatgtgttgagattggtgggttttctggctgtttttctgaggtgaatgacttgttacagagcctcagtaagaaatttcaactaaaatcacaaaaacataaagtccaggaaaccaccagaagatggatttttagtgtttttgaaatcttgtatttccttttgatatcatttactcattttaattttacgactgccaacttgttacggtattaattatatgtatgtgtttatatgtatgcatataatatatgtatatgtatatgaagaataaagttaagatttggtcaaactatattttcccattcaagtacaaaaatgttttcaaggctgcaaaaagtgtacagttgttaaacaagttgtaaataaagacttgtataaaaattcaaaaaaa

SEQ ID NO: 37682 - DNA, 3197 bp, Homo sapiens
tatattaatattcaaatcatagttcaaaaatactgaaatacttgtttattatgttacataaatatggacacaattactgccaaagaatagagagatttgcttatgagaacattctgtcatttgttctgtttgtagatgagagacatgcttttaaagtacaaaacgtttctcttctaccttaccccctgttctactgacgtgctttgcatgagaagctcatctagaagagagcaacgctggaatagagaagtctagaccctggcctttgagggaaaggactgctttttttctctcccaaattagaaaattaaaagtgaaacataacacataaggacgaaatacaatgttctgaatatcttccactaattaattgttgaatgattaagtctctaagtatcttaacttccattgtcttcttgttaacctagacaagagtagattattcagtagccacatgtgacagttaaaattaagtaaaattaaaactatagtttctcagtggcctagccacatttcaagtgttccacagtcacatgtggatagtagttacctatcagacagtacaggtatagaacatttccagtattgccaaaaatgctattcaacagcacttttattgcccagagagaaaataaggacaaaataaaggcagtgaagtaacttaagacaactctgagattttaccaccatacttagagaaagtttttctgttataaaaattaatactaatcctttttaaagaccttggaaaaaatcaaaaccccattcctttaagctagtcttcagtatatatttttctaagaacagattctcaatactttatttttcaagtgataaaatcattttataaatcatttcttaatatcttcagtgttttttccctttttatgtaaactcttttaaaattgatattagctgggcatggtagctcatgcctgtagtcccagctactccagaggtcgaggcaggagcatcgcttaagcccaggaggttcaggctgcagtaaggtctgatcacacctgactgcactccagcctgggtggcaaagcaagacccctgtctctaaaaaaaaataatataaattgatgttatatagttaacatttatcaggcaaattcatatgaatgcttatttcaaataaagattgatagatttaatgatatccttccttttaaatttatatagatctaatgaacattgccaacagttttttttgtttctgtcccttaaacatttcccctgaaagtccacctcaaaggtacatcaagatgcaaacaatttttttatcttcataacttcctgctcttattaacttgtattatgaatcaaattaagttttatgtataaggcatttactattccagtgacttagctaatgaaaacatttaggatctatagtaacatgtctaaattttttaatggaaataagggactaaccataatccttttgagtcagcttggtgcttacaattattttgttaggaaatcttgatgctttcttctttctctttaaatttttgtaatcaagcaacagacttgatccagcagtgtcgaattccaagcaagttatgatgattcttattgtagttcaagtacagatgagtaagtggtgtgacttcagtttattatcttcttggtgacctactttagtatgtgttctgtagcgattcatattagttaagggacgttttcaatatgcttgaaataagaaatagcattttactctaaatacaagaaatgactgtacacaaatgctaatcagtgatttggggccttttaatgtctttaacagcaatcttttatttatttatttatttatttttgagacggagtcttgctgtgtcaccaggctggagcagtggcacgatctcgcctcactgcaacctccgcctcccaggttcaagctattctcctgcctcagcctcccaagtaactgggactgcaggcacatgccaccacatccagctaattttgtatttttagtagagacggggtttcaccttgttggccaggatgatctcgatctcttgatctcgtgatctgcccgcattggcctcctgaagtgctgggattacaggcatgagccactgcgcccggcccaaatcttttattttttaacagccttagttatttataattcaaatgcactaaaatatcatcgctgtcatgaactttgctgtttacaggttctgtgtaattcagaatgctttgtacttagaaaataatttctaggcttatcttgttttgcagttttcatgttttgacaattgcccaccatttacaatactcaatttttgattatgaaatgaatagtaaaattcaaacatatctaataataatttgccttagtttgattaataaattatatcaaaaaacttggggatagaaagaggcttttttttccccctgtagtatttttaaaactttttagatgagctggatgaaaccttagtacattggagctggagttgtattgagtacagccccaactctgaagccttatattcatgtcttaagtaccattgattgttctgtgaattgttgttagtttcatatttgacattgtagtaatccaccttgcattttagtctttgcaaaaaggatattgctaggtatattcttatttctgattgagtattgaatttacatttttcagaatttcattctttgtcattataatccaaaaacaatgtccacatcagacttggaacttctcacttcaaaaatgaaatacagatttagcagtgttgtacataatgatgtccaagcatttttccacctgtttactgagttttccaaccatttactatgtgttgagattggtgggttttctggctgtttttctgaggtgaatgacttgttacagagcctcagtaagaaatttcaactaaaatcacaaaaacataaagtccaggaaaccaccagaagatggatttttagtgtttttgaaatcttgtatttccttttgatatcatttactcattttaattttacgactgccaacttgttacggtattaattatatgtatgtgtttatatgtatgcatataatatatgtatatgtatatgaagaataaagttaagatttggtcaaactatattttcccattcaagtacaaaaatgttttcaaggctgcaaaaagtgtacagttgttaaacaagttgtaaataaagacttgtataaaaattcaaaaaaa

SEQ ID NO: 37683 - DNA, 2369 bp, Homo sapiens
gaggacccgatacactggaggagcatatcaattgatagattgattgattgactgattgagacagagtctcactctgtcgcccaggcaggaatgcagtggtgcgatctcagctcactgcagtctctggctcctgagttcaagtgactctccagcctgggtggcaaagcaagacccctgtctctaaaaaaaaataatataaattgatgttatatagttaacatttatcaggcaaattcatatgaatgcttatttcaaataaagattgatagatttaatgatatccttccttttaaatttatatagatctaatgaacattgccaacagttttttttgtttctgtcccttaaacatttcccctgaaagtccacctcaaaggtacatcaagatgcaaacaatttttttatcttcataacttcctgctcttattaacttgtattatgaatcaaattaagttttatgtataaggcatttactattccagtgacttagctaatgaaaacatttaaaaatatgtattaatttacttggcctgctactaaagtgcttaacataactaaatggatctatagtaacatgtctaaattttttaatggaaataagggactaaccataatccttttgagtcagcttggtgcttacaattattttgttaggaaatcttgatgctttcttctttctctttaaatttttgtaatcaagcaacagacttgatccagcagtgtcgaattccaagcaagttatgatgattcttattgtagttcaagtacagatgagtaagtggtgtgacttcagtttattatcttcttggtgacctactttagtatgtgttctgtagcgattcatattagttaagggacgttttcaatatgcttgaaataagaaatagcattttactctaaatacaagaaatgactgtacacaaatgctaatcagtgatttggggccttttaatgtctttaacagcaatcttttatttatttatttatttatttttgagacggagtcttgctgtgtcaccaggctggagcagtggcacgatctcgcctcactgcaacctccgcctcccaggttcaagctattctcctgcctcagcctcccaagtaactgggactgcaggcacatgccaccacatccagctaattttgtatttttagtagagacggggtttcaccttgttggccaggatgatctcgatctcttgatctcgtgatctgcccgcattggcctcctgaagtgctgggattacaggcatgagccactgcgcccggcccaaatcttttattttttaacagccttagttatttataattcaaatgcactaaaatatcatcgctgtcatgaactttgctgtttacaggttctgtgtaattcagaatgctttgtacttagaaaataatttctaggcttatcttgttttgcagttttcatgttttgacaattgcccaccatttacaatactcaatttttgattatgaaatgaatagtaaaattcaaacatatctaataataatttgccttagtttgattaataaattatatcaaaaaacttggggatagaaagaggcttttttttccccctgtagtatttttaaaactttttagatgagctggatgaaaccttagtacattggagctggagttgtattgagtacagccccaactctgaagccttatattcatgtcttaagtaccattgattgttctgtgaattgttgttagtttcatatttgacattgtagtaatccaccttgcattttagtctttgcaaaaaggatattgctaggtatattcttatttctgattgagtattgaatttacatttttcagaatttcattctttgtcattataatccaaaaacaatgtccacatcagacttggaacttctcacttcaaaaatgaaatacagatttagcagtgttgtacataatgatgtccaagcatttttccacctgtttactgagttttccaaccatttactatgtgttgagattggtgggttttctggctgtttttctgaggtgaatgacttgttacagagcctcagtaagaaatttcaactaaaatcacaaaaacataaagtccaggaaaccaccagaagatggatttttagtgtttttgaaatcttgtatttccttttgatatcatttactcattttaattttacgactgccaacttgttacggtattaattatatgtatgtgtttatatgtatgcatataatatatgtatatgtatatgaagaataaagttaagatttggtcaaactatattttcccattcaagtacaaaaatgttttcaaggctgcaaaaagtgtacagttgttaaacaagttgtaaataaagacttgtataaaaattcaaaaaaa

SEQ ID NO: 37684 - DNA, 2049 bp, Homo sapiens
tatattaatattcaaatcatagttcaaaaatactgaaatacttgtttattatgttacataaatatggacacaattactgccaaagaatagagagatttgcttatgagaacattctgtcatttgttctgtttgtagatgagagacatgcttttaaagtacaaaacgtttctcttctaccttaccccctgttctactgacgtgctttgcatgagaagctcatctagaagagagcaacgctggaatagagaagtctagaccctggcctttgagggaaaggactgctttttttctctcccaaattagaaaattaaaagtgaaacataacacataaggacgaaatacaatgttctgaatatcttccactaattaattgttgaatgattaagtctctaagtatcttaacttccattgtcttcttgttaacctagacaagagtagattattcagtagccacatgtgacagttaaaattaagtaaaattaaaactatagtttctcagtggcctagccacatttcaagtgttccacagtcacatgtggatagtagttacctatcagacagtacaggtatagaacatttccagtattgccaaaaatgctattcaacagcacttttattgcccagagagaaaataaggacaaaataaaggcagtgaagtaacttaagacaactctgagattttaccaccatacttagagaaagtttttctgttataaaaattaatactaatcctttttaaagaccttggaaaaaatcaaaaccccattcctttaagctagtcttcagtatatatttttctaagaacagattctcaatactttatttttcaagtgataaaatcattttataaatcatttcttaatatcttcagtgttttttccctttttatgtaaactcttttaaaattgatattagctgggcatggtagctcatgcctgtagtcccagctactccagaggtcgaggcaggagcatcgcttaagcccaggaggttcaggctgcagtaaggtctgatcacacctgactgcactccagcctgggtggcaaagcaagacccctgtctctaaaaaaaaataatataaattgatgttatatagttaacatttatcaggcaaattcatatgaatgcttatttcaaataaagattgatagatttaatgatatccttccttttaaatttatatagatctaatgaacattgccaacagttttttttgtttctgtcccttaaacatttcccctgaaagtccacctcaaaggtacatcaagatgcaaacaatttttttatcttcataacttcctgctcttattaacttgtattatgaatcaaattaagttttatgtataaggcatttactattccagtgacttagctaatgaaaacatttaaaaatatgtattaatttacttggcctgctactaaagtgcttaacataactaaatggatctatagtaacatgtctaaattttttaatggaaataagggactaaccataatccttttgagtcagcttggtgcttacaattattttgttaggaaatcttgatgctttcttctttctctttaaatttttgtaatcaagcaacagacttgatccagcagtgtcgaattccaagcaagttatgatgattcttattgtagttcaagtacagatgagtaagtggtgtgacttcagtttattatcttcttggtgacctactttagtatgtgttctgtagcgattcatattagttaagggacgttttcaatatgcttgaaataagaaatagcattttactctaaatacaagaaatgactgtacacaaatgctaatcagtgatttggggccttttaatgtctttaacagcaatcttttatttatttatttatttatttttgagacggagtcttgctgtgtcaccaggctggagcagtggcacgatctcgcctcactgcaacctccgcctcccaggagaattacttaaacccaggagacggaggttgcagtgagccgagattgcgccactgcacaccagcctgggcaacaagagtgaaactctgtcccaaagg

SEQ ID NO: 37685 - DNA, 2016 bp, Homo sapiens
agactggagtgcaatggtacaatctcggctcactgcatcctcttcctcccagtttcaagtgatcctcccgcctcagctttccaagtagctgggagtataagcgtgtgccaccacactcagctaatttttgtatttttagtggaggtggagtttcaccatgttagccaggctagtctccaactcctgacctcagcctcccgagtagctgggactacaggcgcccaccaccacgcccagctaatttttttgtatttttagtagagatggggtttcaccatcttaacaaagctatcattaaatcatttgcttgtaatgaaattcagccgttgtcagctgtgagcgttgcggggctggtggggtgtgtttgagtatgtaagtgtctatttcctgtgctctaacagtgactatttcagttctaacccttcaattgctaattggatgagggaatggcctcttagattgtccttgttttgacttatctgctaaggcgagagaatgtctgggtttgccacacagtcccgcagggacccctgctctttgccaggatttttatatcaagtacttagtttggccaaatttagagtatagtttaaaggggaaaaaaagtttgtatttgatgagtctaattactatattagaatgctttttaaatgaatatgctgtgattggaatctcttcttgggggccggggagagtgctgagagatgcagctgtgtctctgctctctgcagtcttgggcaggcagcaccgctgtctcctgatacagagggttgaatgcactgcttcacattgatgccacattttcaaatctaaacatgattaacatgttttttaagtatttatcaaataattcacatttttgcaggtttaagtgctgttttttaagatattaaacatgttccttgtttcttttttctttttaaccactggagactatgtgaaaatcttgtgttatatggaatttttctaaaacaatttccttttacttttcatgttgcatattttccagtggggataaattggaggttcttattactaataatcctgaaactaaaatttgcttttcctgcatagacatcttttgttagtccatttgagttttgttgccatccagtttcatgatcatgttgtattagtctaatagacaatgagttactgcttgaatgatatgaaattctctagtaaaaaatgctctgaagatgtgagaagctctgttgtattacttggcaccaggaatgttacaaaaatgttgttgctagcatattgctaacctagtccttaagtttcagggattcctgtaatatgttgagtttggagtattaatagcaggctaacagaatacagtaccaatatgccaagttaaataattgagaatatatacagtatagtttgctatgtataatagacctcatttcatttacagtacacctcacacttgggattaattcacctataacctctgtgaactgcgagtgctcggcagaagcagccctgtgtcttacatgtctacatttatatttatatttatatttatttttttgagacagagtctcactctgtcacccaggctagagtgcagtggcatgatcatagctcacttgcgtcttgaactcctggctcaagtgatcctcccacctcagcctgctgagtagctgggactacaggtgcacaccaccatgcctggctaaaggcatgtctgcatttatgcgaggtgtgttgaccgggtggggagggagctaggactgagattcgcctgtgtaaaatgcacaaaaagggtttgctaagcaaattgatatttgaaatgaaagatggattaggtgagagacttagtttattcaggaataagagcaaaaccaaccacatcaaaaaatgtatttcactgagacagccttttgtacatacagcagggtgctgtttacagatttcaagaaaggagaaaaagaatgcttatactgagattacctacctcccagtagtgaaaataataaatttatcccttgaaatataatcgtgtgt

SEQ ID NO: 37686 - DNA, 281 bp, Homo sapiens
gcttccatccctatccccttaccttgatatatataatgtccttcagagcccattaccaccactgatatttatttgtttttctattggaattaaacagagatttgtttttaaattttattatggaaagtttaaaacacagagaaaagtagagtaatatataatgaactcctgtatgcccatcacacccaggtgcaactatttaaggctgaatgaaaacagggattttattttatttcatttttatttattttttttgagacagcatttcgctcttgttgccc

SEQ ID NO: 37687 - DNA, 229 bp, Homo sapiens
gatttttgacttaaatattttctttaaaaggagtgacaggatacattgatcgagatacatgtagtgttaaatgacctctgaggacataaaatagactaccagaaaatgtacattcagaacatgaacttaataaattttctgaactgctgttagcagcaagttgacttgaaatccttaaaaatagttgcaggataattttattatcttagaaattatcaccagaaaaaat

SEQ ID NO: 37688 - DNA, 443 bp, Homo sapiens
ttgagatggagtcttaactctgttacccaggctggagtgccgtggcacaatcttggctcactgcaacctccgcctcccaggttcaaactattctcctgcctcagctgcccaagtagctgggattacaggcgcccgccaccatgcccgactaatttttgtatttttagtagagacgaggtttcaccatgttagccaggctgctctcgaactcctgacctcaagtgatccacccatcttggcctccctaagtgctgggattacaggcgtgagctgccgcacccagctgatattttggattctattttcctaaagctcatgggttgcaatctggaatcccacaagcggtatccaacctgctgacatgtcccctttgaccctttcactacttttaaaaaaatgagttgccgacattttaataaatgtcacataaaaatctggattcc

SEQ ID NO: 37689 - DNA, 1514 bp, Homo sapiens
tggtggagtctgtagcaaggctggaaattttgacttggaatcacttggatttctctaagagaataccccaggttggatgtgttactgtggcagcagagaagacttaaaaattacattgtttttagcttgaacttcgtcttgtgaagtcctaattagggaagaggagtcaggctgggggtctaggggaaagcaaagagataaagcagataagccataggtctaccttgcttcatggtccaggacatacaaacaaaaagaagaagcagataagctataggtctgcctttctttatggcccaggacatacgaccctcctgcacacataactcacaatcttcctgcgtatcatcaaatgcttcaacttatcatcaaacatctcggctgaccgaaaaatgcaagttagctccctgctaccttggcgttgtcagtcctccacatagcactcttcagcttaaattgcattttataaaatccccagcaagcctttgtctcctggcagtcaactcgtctcttactgacctgcccattgctcccttgcaatgtattttcctactttctctaataaatctgcctttcttgacctaaactgtcatggtaaattcttcttactcctatgtcaccagccacagacagtcgccacaagccatgacaagtctgcgatttcatggtctttttttattttgatgatatttccccagtgtttgggggacagaagaatgcccacaatctataggtcttagtcacatggatggggacagaatatctgagagagagagaaggaacaagatctactggggctccttaaaattcttcttgaagaactcctttctcaccttggagtagggaagactttctgattatgactcaaaatttagaagctaagaaagaaaatacctttaaatctgaaaacataaaactcaaaaacttctgggtgtttttttgggggggttgtttttttttaaacagcacaagcaactcaaagggcaagtgacaaactggggagagaagaaaaagatgtgactcatatcacagtttcccttctacttaaaaaaaaaaaaaactgcaaaccagtaagaaaatagcaacagctcaacagaaaaattgccaaaggcacgaacagttaatgagaaggagatgcaaatcgctcttaaacctatgaaaagatgaaggtgttccatcacaaagagtaagagaaatacaaattaatattaatgtgaaagacaacttttcatttatgaatttgagaaaaatccaagaacttgatgatatacctctaagaagcaacggtagggaaacgaaaattctcacacattgcaggtggttatgtaaattggtatagccccgcgggtggtcagtgtgacagtttctatccaaattacagatgcatagtttcattgccaggtctcttctgtctgcttcttcagacccaccctcccctctccccactgtttagttggcccaggaccctgtctggtaaggatacaactccaggccccttgccctatggcttctgg

SEQ ID NO: 37690 - DNA, 1879 bp, Homo sapiens
tgagcactcaggcgccatcactgccttcttggggcttacaccctattggggtgtcagagatattataacactcaatattgacccaatgggatgaaaattgttatcttcatgatttcttccaatgggcttagatttgttgggacagggcagaattagaataattatttctcacatataagagtaagtgatatgagattgggaatttcttgccaacactcaagcaaactgcagaagataattactccattttactagctcacctagtttctgaaggatggggtggggagtgagacatggagcctctggggacaaggataggggggtgggactgtcccagtggagggtgccactggaagcctccacccaagtgggccagcagctgtgcaagggtgcagcagtaggctggtgaaagccaggttgtccagatctttctaggggaagagaaggattatagaaaaggagaaaagggaggagcaagaacatctctccatggcctatttttatttttgttccccaagagactagtgtaataaccttatgcccccaaagacagcccagaactgagtatcttcagtgttcctgagtgtaaatcagtgaatctgttatatagaaagttaacatttcaggagcacaattatttcctgatttcaaatatgaacagaagactaaatgtcatttttttaaatcataaatttggtatccatagttactttacacattccagagtctaagcatggaatttaagttttgtattttgaacaaaaatagcaacatctgttttctgtatggcaaagaaaaactaaatcccagacttttatttttaaccacagaaaccatcacttctttctaaattatttgcttgcctgctcatttcccctaaacatctctgtttatgccaatggctttttaaatccaaataatactagttattgccaaattgcattagaatcctattgaattagaataattcatatacttcatatactaggcagtaaatggttagagacggtaaagatctgattgtgatcaaaagtagggtttttgttttgtttttaatcatgagcacatataaaaggaaattcaaatgaaaccaagccaatttctgatttagtaagattaaaaccatagatggagctcagttattaaggatggaaaggaggaaagcacagagtgaggagagaaaaaggggaaggaaaaaaagtagtgtttttttggggaacagtataatgtctcagaagttcttctctcttatcctgctgatgttgagacagtggctttgtataagcttttatttatacctatttcaacatcatgaaaatttttccatcagcattttcttgcaactttaaaaatcacaagggattatttgtttataaagagatacaggatctataatttattggcaatactttattttaggaatcttcaaattgtacttaataaataaatcacaggtcaaaatgactgtaaaatcaatcaggctttctcgtaagttatttcctgaaaaccatccatgataaatacaacaaggcttggcgaaacctcattactcttggaagtcttcagaggttattatacctactgatctgtatttgtctctaagagacatttgaaacacagttacaatgtcaatttggtgtaacattacctgtagtagagctcagagtatatggcagtgcacggtcactcaagatgcatggcgtgtcatttgggtcgctttgatgggtgctcgggtagaattagccttgtagagactaatgtgttcatgctatctctgatcctgtggtgttgtataaaaatgaacagctaaaaatttacccatgacaagattaaagcaaaaataaacacaaagttgttagactttaaacatgaaaaaaat

SEQ ID NO: 37691 - DNA, 433 bp, Homo sapiens
tttttgagacagggtcttgccctgtcacccaggctgtagtgcagtggcaggatcacagctcactgcaacctctgcctcctgggctcaattgatcttcccacctcagcttcctgagtagctgagactacagttgtgtgccaccatgcccggctaatttttgtattttttgtagagatggggtttcaccatgttgcccaggctggtctcaaactcctgggctcaagcaatccacccacctcggcttccccaagtgctgggattacaggtgtgagccactacacctggcctgtacctatttttcatatgtacccagtcataatcttttgattttttggtcacatgtaattccccgttggtgacattctctactcctcattccctacttcatgcttctttcttctgtctctctcactctttcagtttctggtcgacc

SEQ ID NO: 37692 - DNA, 306 bp, Homo sapiens
ttttttgtggagacagggtctcagtctcactatgttttatggaggcctcaggcaatcctctcacctcagcctcccagagtgttgggtttacaagtgtgagccaatgcgcccagcttgtacagttgaaaagggtgaattttacagtgtgtaagttaaatgtcaatcatttaaaaaaaaaaaaaaaaaaggccaggcgcggtcacacctgtaatcccggcactttgggaggccaaggcgggcagatcacctgaggtcaagagttcaagaccagcctagccaacatggtgaaaccccatccctgcaaaa

SEQ ID NO: 37693 - DNA, 584 bp, Homo sapiens
ggaagatgggatatgtgggagagcaccttgtaaatgcctggtcattcctcatctgtcacaccccattactgccactccctgagtacgaattgccctctgttttttgggaatgagttagtgccactcccccactagaccctcagcttcccaaggactggagtcatgacatctgtgtctcctctccctctagttcagaaacagagctagaaacagagaaagccagcgataaataactattcacatttcctgtgggccaggcgtgatgccaagctccctaaatgggtttcttctttcatctctgcaatagccaagtattattgtccccattttaaagataagacactgaggctcaggggttcctggaggtggcctggcctcaggtcctaggacggggaggtgctggcttggctaagaggtcaggaagcttcccagcagggagggggaatgcagcagtgtgcagcgctatggtccttgaggatctggtgagactccttccctcagcagtcagattccagaggtgacaaatgggaaagggttttcttctttccagtcattgccttcagctagacttggctgaatcttcc

SEQ ID NO: 37694 - DNA, 425 bp, Homo sapiens
cgcaacagcccccatcatcacttgggcttccttgaacttaaaacttcattgccatgaacgatgttccaaatctgatttgctgttgtaaagcacagagagaactaaaactagctgtaactcttcattgtgtcttttaacactgagatgataaaaaagatggtgttattctctgaagtcttacctctttagctgggtaactacatctgttactactatacttacttgatcactattaaaacattaaaattaaaattatgttcagtaagataaaatcatcaaattgtttaaaattctcccataaaagttactgagaattatttgaaaaacatcttaaaatatcctactacacttgcctcttcagatgttctgtgggtgtgttttcccattaattaaagctcattcttctggctgctgcaattgtttca

SEQ ID NO: 37695 - DNA, 710 bp, Homo sapiens
ttttactctaaaacaacatttagccagtattttagaaacagtattgatcagcagaagatctactgcaaagctcaattttatgttgactagtcattaagaaaaggaatactggctccgatgtatttaccagtcagtagaattgggtcttgtctgctttctatcatttttccctgataagctttttatattcccacaacactgttctctcaaactgttaggctcatttttgtcagatcagcatgtggaagtcttctgccaattccatcttactgtcctaatctgttggtttattttgttattctctgactttactacattaatatagtagataacaaagaagggatcctgttctttaggttaaactaaaacaaaaaaaaaaaaacggagactatctttattaccaagaccaactgtaatctgtataatagtttgaaatgtgtgtatgtcataatgatttcttcttgctgtgctgctttatcatagttttgatagaagaaaacagaaaagtaaaaaaagatttagccagaaacaatggaagaatctctaaatatcagaaaagaagaatggttttctcgttgatgtcttataaatgaatgttagttcctttaggaaacttgatctccaaagacactatttttgctttgctttgctttgcttttcctattccttgattacgcccacacaaatgttagagttcagtgcaaggtttt

SEQ ID NO: 37696 - DNA, 413 bp, Homo sapiens
tcaagccaatctagaagtgtaggaggcatctttgacaatcgcctcaccctcagcatctaatcagtccctatgtcctgcagattccaccaccaaaatccatgtattaataaaactgaccacacctccatcttcactgtcatctcaagccaagctaccaactctaaccttgacatgtgcagtagcagtagccgcctgtcttctttccccactttcacttttacctttgtctacttcattttctgcacaacagccagaaggatcttttgaatttacttatatttatttgctgtttttataaaaagttattgattgaaaaaatgtagttttgttatacgttcttaaagtggtagagatctccattgttttagggtttaaaaaaattttaaaataatttttatattttgcaataactt

SEQ ID NO: 37697 - DNA, 406 bp, Homo sapiens
aaaaaactttattcatttaataaattggcgtattccataatcaggtacaatattaggggacagaaggatatagtagccaaaaagacaagtgtagtctccacacatatgcaaattatagcaagttaaatagagacatgcaataaacagaaagtcacacaaatgaccaattatttgtacttgtagggttataagagccaagtgggagggcataaaaattaattatgaaagtgggaaggtgccacaggcatacttaaccaatttcacaatttgccaacggctaacttttgctaagtctaatacaaggctttgattttacatttgatgaaatttcccaacatgctcctatgatcagctcagggaacagacactgccctaagagtgcctgttattgacaaatctttggtct

SEQ ID NO: 37698 - DNA, 458 bp, Homo sapiens
ttgtgcagtggttaataacataatcaatactgtttatttgtagaataaccattttcagagcattttcactagattcttaaactgtgtaaacaggatatatgctatttttattttgtagataaaaatcccctgagacttagagaggttaagtgtttatccaaagctgcacagctagtaaaatgtcagaactaagatgtagggtatttagttttgaaaattctattatttaaagtaaatgtgtgttatttataaatagtgtatagttctgagtttcttgacccattttcccatatgaaaagctataagcaaagagagatagaagtgagctagaaaaaatgtctagaaggagaccagtagtggggagtcaaattaaattcttacaaatatctgcccaaatgacagacttagtgattttcaaaggcttgcaaatccaagcatacaaagtaataaaaaaaaaa

SEQ ID NO: 37699 - DNA, 377 bp, Homo sapiens
cccagcaggagaatcacttgaacccgggaggtggaggttgcagtgccaagataacaccactgcactccagcctgcatgacagagcgagaccccatctcaaaaaaacaaaaaacaaaaacactacctttggcttctgaaaactaatactgtttactccctgctactagtaggtattcagtaatagtgaacaacttcctccgggtcctgtggagagtgggagaggtccagctgtacagttaagcatctctgttaagggaccagttttgaaagaattgatgcatggtaacatcttggttaataaagtggcaatttggtaatgacattttgcttttctgtgaatagaactgatcttttattaaagttatggaaactgaact

SEQ ID NO: 37700 - DNA, 197 bp, Homo sapiens
gcattctctaatgactgacttaatcctgaaggatttttgtctctgttttcatttagctttctgccatcctgtttttaaaacaccttcatattgtccagattcactcacttcataaaaatgctgtggttctagtcccagagtattctagtcccaggaattcctgaaggatgtgattcctaaattcctaaatcctcata

SEQ ID NO: 37701 - DNA, 390 bp, Homo sapiens
cattctagggaagtgtattatagtcttcttcctcatggtataaaggagagcgtggcataaatgctgtgccactaatttgcatatttgaagaagtaaaggtaattggatgacagaaaacatcaggattgatctttcctttttcctctcttcctttgtcttcttcctgtttcttctttctaaaagatagttatctgtggtcccttaaatagctttgtaatgcaataaataaattggtgtttaaaaattatgaaatatgaatataaaataatattcataatacatgatacataaatatataatataaataaatataaaagtataagtaagaggctaggtgcggtggcttatgcctgtaatcttagccctttgggagactgaggtgggaggatc

SEQ ID NO: 37702 - DNA, 319 bp, Homo sapiens
tccgtctcaaaaaaaaagaaagaggggctcaaccatgtcacattaaatcctaggttgaattgttaactttgtagtcagaagaaggaacaccagagcgaggggtcttaaactctcatgctggttccccccgtgaggctgtggaaagtcagctccctgagaagcccatgcacctgcctcctttgtgaaatgatggggtggctcccaccagaacccattggtttgtccaagtcgcagtagtcccaattcctttagaagcagccctggaaagaaagggcatctgaggagaagtctagggagccccaccagccccaaacacaga

SEQ ID NO: 37703 - DNA, 474 bp, Homo sapiens
gcgtcgacgggtgtatgtttggtagtaaaagtataaagacggccaggcgcggtggctctcccaaagtgctgtgattacaggcgtgacgactgtgcccggccgagtattatttttaaaactaaattatgctaggtacactcttaacaaggcaaggatttccattcacaaaaggaagcgtaaattatgcaggctaaatgaagcactgtcatacccaaaatattagatacaatattttcttatgatttaacttttacaaagggcctctttgtcagaagttgctgaagttcccggttcagcctattaattgctgcatattctttgaaaacaaaattgttgatgattcagatgtatgtgtgactgtgcgaagaaaccccgtccatagtaaaaaatgcaaaattagctgggaatggtggcacatacctgtaatcccagctactcgggaggctgaggcaggagaattgcttgaaccccgga

SEQ ID NO: 37704 - DNA, 612 bp, Homo sapiens
aagtacccaccttacctggcttcacagtgaatccttacccctggccttgtttcgttacttagacctggctagcaggccctatgtcaccagagtctccgcaggccagagggcataaaaacacccagagactgtagtgggtatttatcaatcctggtgaggcctctccccacaggtagaatcatctgtagctgtgtacactcatgatgttggggaagtagctggcactacgtgccgtacatctgatggagggcatggtgtgtatcctgctttgtgtagtcgtgcccatatggtgattttggaatcctttgtgtagcctttaacgttgtctattattagcatgtttctgtcgtgactgccataggtggagcccacaacagtgcaggtgtttctttatcctttgagctgggcacctggtgggaactttcaatttggaaaatcatgtttctgacgccaggaaatttcttgtatgatttatttgataatatccaactcctgcctttccctacctttttttcctctcctgtttctgtactttaaaaagtctacaagtcagatattggggccattttggattgatgctctgatattcatctttttctccttttgcccatt

SEQ ID NO: 37705 - DNA, 226 bp, Homo sapiens
tcctaatgttggtctcaattattagcctattttatatcattacatcataagcatgaaatgtcacataaataaaattgcataattcagtttggttcattagcatgatagaagttcagctcataacaatgttctcacacttcacttcattcaaaattaaaccaacacaaacacagaaattcaagaactaaagaaatatctactaacacttagaatgagacttttccat

SEQ ID NO: 37706 - DNA, 414 bp, Homo sapiens
ttgactggcccttgatgtgaataaatcaactgcgaaaagagatttatgaagctgctgggaacacctgactggatgctcgtaagaacgttcaggtgttatgatgctgtggtgtttctctgaatttaaagaaacgtactcagagcatataagattcaaaactatgggtttgctttaaaagaatccagtccaccaggtgcagtggctcacgcctgtagtcccagaactttgggaggccgaggcaggcagatcacgaggccaggagtccaagagaagactggccaaaatggtgaaaccccacaaaagatacaaaaaattagccgggtgtggtggcgtgcacctgtaatcccagttactcaggaggttaaagcagaagaatcgcttgaacctgggaggcggaggttgcagtgagccaag

SEQ ID NO: 37707 - DNA, 535 bp, Homo sapiens
ttttttttttttgtagagatgaggtttcaccatattgtccaggctgatgaagttttctataaaggtccagagagtaaacattttctgctttgagagccatatgatctgttgcaactattcaactctgctgttgcagacaaaagcagtcaaaggtaatatgtattaaataaatgagtgagtgtggctgttttccagtaaaatttagtttacaaaaataggtacaagctaaacatagctcatgggctgtagtttgagggctcctgtgctaatttaaagctcttctcgtccatctgaccatccattcatataactacccatccatttgtctattcaaccatccatccatccaaccatccatccatctatccatccaatcatccaatcagccatccacccaactatccagcattctaaaaaatattcattggatatctattatgtacaggaaactatgattagatgctgaaaacacagcaaagagctaaaaagacaaggttcctgaccgaatttaaaaaacagtttaatggaggaggca

SEQ ID NO: 37708 - DNA, 241 bp, Homo sapiens
ggacacaaaaaacataaacaacataaaccactgaagaaaataatgacaaaattttaaaattttcagtctttgaaagatatcattacaaaaatcaaaatgtggtccatagtcttggggaacatagtctaggggaacatattttcaacctataaatctggatattatgtaaatctctatccagaatacataaaggagtcttacaacccactaataaaaaagacaaacaccccaataaaaaatg

SEQ ID NO: 37709 - DNA, 463 bp, Homo sapiens
aaaggatcccctcctatctttccttccaaaataattgtgtgtggtccagattaagttttaagtctggtttaggccggagaactaggtggatactttgtatacctcatccttgactagttacttaggggtaggagcctcagcctccacatccctacaatgagaattctagagctcttcatcaagtaattatagggaacaaatgggaaaatgattgtggccattctctggaaactgcaaagcgtcatacaatatatatattgtttatttagacttgatggaagataggttaaaacattttctttttattaatcttctgagctcctgaagtcttcaatgtatttattcacttatagtcagaatgaaatagtcctgaaggaagagtagtgtctcagcctcataacatcaaagactgtttcctctgacttctttttcttttattcctggaaactgaagctttgttcat

SEQ ID NO: 37710 - DNA, 303 bp, Homo sapiens
aaaaatgaaagcacatttattatagcaattagaaataatttatgtgctgaaagataaacactgtggtttgatggttcatttttgtctgtatgaagatggtaatttcaattttgtcatttaagctacaaaatttaaatgtgtcttaagtgtattatattacacttatttttcaagctcacccttacatttttggttatgtataaccatttttaaaatcacccaaaagtgattttctgctgttcagtttcattcttatacagttgatagaatccaggttgcctatagggttaaaagaaaaagaaa

SEQ ID NO: 37711 - DNA, 534 bp, Homo sapiens
aaggaattctaggcacaaagttcaggatcatggttaactgaggggagagaacagggagtatgatggcaagatagaaggtatcgttcacatccaagtttataggttgggttcttgatttagtcattattcaaaggctaataactaaataaaaggtagctagcgtgagagtgcaacatgaaccaaagatcatgactggctttgcgcatcgaggggccattaaagagtctacttttcatgttatcacttaaaatcattttgcacccaccagggcatgagcatctcgtgctggcaaacaccacatgaccgtggtgacctcagggccagcccgggggtcatcttgaatctctcctgctgaagagacccaggagggtaacacacgcccctccaatctctgagttctaggaaatgaacacctggtatttaaaggggctgacataatgcaaatcatctgatgaaatgtttgttttagttcacttaaagatcaacacgagagtcttcactctgaatgggccacacctgaattaagagaatcct

SEQ ID NO: 37712 - DNA, 439 bp, Homo sapiens
acaacattgtccagttgtaatagtgttgatatttcattatgtgtaagtaatgtgatcatttatagtaaaaacattaggagtgagaaaagatatgaagagcacgtatttcctctctggaatttctataattgtgtccagattcacaatgataaagagtgccactttacataatggcaactaaatctttattatgctttttattaaatatgaaagtcattactattatctgatactgaatattttcttaaatagttgttttggtttttgtcttttgctgttttttaatgtcaaggaaagtgaagggcattggctatacctgcaaagacaaagtgggatagggtgaaaccaacccaatatttgtaataaactgtgttctgtatgatccaggaagcaattcattgagcatctattacgcactagggccattaagttgaaggag

SEQ ID NO: 37713 - DNA, 566 bp, Homo sapiens
caagacttcttaggaagccttctcagtggttgactacagtttgaggtctaaatgtgaaagaaggcatgtataatatgaaggatattgtgtaaggtgagaaaacatgatgaatatattgctatcatgtaaattgtgttatcttaatcctacataaacagatttttaacatctgagattctctgtcttgtaattgatgaaactagtccattcatattcattttgattattgaaatctttggaattatttttacttgtgtacttttgtttgctgttgtcttttttatgttctttttccagaaagtttttttcatttattttaaaaattcatcatttttctattaaccagttcgaaatgtatgtgctctcttttgcttactttaatgcataccttgaatattttattatacatatttattatagaaatacatgctattcttttatttctttaagaagtgtacttaaaatcctattcattaatagccaagtatttcatgaaattattatcttactctcatttctcaaagtcataagttgaggaagtaaatccttaatttcatctgatggtc

SEQ ID NO: 37714 - DNA, 416 bp, Homo sapiens
taaaaaaaacacacacacacacacacacaccaaaaagcaaataataaattatcccagatgatgattcaggacttattttctttatgcaatttaacaatctcttgtaaatgctcaagactttttcccttaatgctatttcttgtacagctataggggaagttgacaaaacattcctttatttaagcaagaaaacaacttccatatttgaagacacctgaaaatctctatcagattcttttattctgtgttcacatccaatattccatttccaacgccctttctagctatcataactgaggttaaactgcccctctgttactatttcttatctccattattcaggttaagactcttagttgaaaatcacaggatgatttctaactaatttgagcaaaatgagacttattgaatatatg

SEQ ID NO: 37715 - DNA, 418 bp, Homo sapiens
ttaaacaaggtacctagagtagtcaaactcatagggctagaaagtagaatggtagttgcaagggctaaagggaggggagaaagggagttattgtttaatggatacagagtttggaaagctgaaaaagttctgcatattgataatactgatggttgcacaacactgtgaatgtacttaatgccactgaactgtacccttaaaaatggttaagatggtacattttgtgttatgtatataaaaaaatatgtattttacaaaaccactactgtcaaaatccttaaaaagacagagcaggctggccgtagtggctcacacctgtaatcccagcactttgggaggccaagacaggaggattgcttgagcccaggagtttgagatcagcctaagcaacacagcaagaccctgtctctagaaaaaa

SEQ ID NO: 37716 - DNA, 742 bp, Homo sapiens
atagtagagttattgtagagtaactactatatatttaattgtttgaatataccatagtttgtccattcttctatgcaagaacatttaatttgcttttaggtttttgctgttacacacaaagctacaataagcacatcttcttcttgcacacctcccacccctagttgccatttttctatacagcaaaaatactcttggaaaattataaatggtgtcacaaagacactgagttaaccatggctagcgagggtttagacacctctgtgatcagagctcatgacctggagcttagtctctggaatctgaatggctccttccatactttctaagtacttctctgctctgtacattcattcaacacacatatcccaagtgccagtgagtgccaggtcagtttacaatccaacatggtatgtgctacagctctgccaagccactgcgaaatcagccctcattagcataggtttgaaacatgcctttcaatgcactctggggcttccctggatctagctctcttcctggagagtaaacaaacaccagaaagcatgaaggacaagcacagctccagaagatttctcccccaagatcaaatgtctgtattcctcatgggctcttctcacaattctcccctgaaactctgcgatggaagattgtcactcaatgtatagtataatgactttccaggttttttttctaccatgacccagaagaagaaatgtcatgttgccaacgaggactaaga

SEQ ID NO: 37717 - DNA, 2082 bp, Homo sapiens
gcacaatcagggaagacacgcgtgacccggaaggtcttcccgccacactccagagcgggtgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctggggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcaaccctcccagcagccccgtgcggacctgcgggccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagctgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatctgcgggacttcaccaactacggcctggagcactggggctcggacacgcagggcgtggagaagacccggcgctttctgctcgagtggctgtccttcctgtgccggtacgtcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattctttt

SEQ ID NO: 37718 - DNA, 2071 bp, Homo sapiens
  misc_feature (37)..(37): n is a, c, g, or t
  misc_feature (39)..(39): n is a, c, g, or t
  misc_feature (51)..(51): n is a, c, g, or t
  misc_feature (57)..(57): n is a, c, g, or t
aatcgcccttttatggggtacacataaatgaaacccngntgtggctctaanacaaangcagggtccgtcgaatcggattgtagggcgcgatgcgaggacgcgagtctctaagatgtgggggcgatcggagcgacttggacgagagtgcgccattagcgtcatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctggggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcaaccctcccagcagccccgtgcggacctgcgggccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagctgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatctgcgggacttcaccaactacggcctggagcactggggctcggacacgcagggcgtggagaagacccggcgctttctgctcgagtggctgtccttcctgtgccggtacgtcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattctttt

SEQ ID NO: 37719 - DNA, 1848 bp, Homo sapiens
aaggctagtacgaggccggtggttaatcggccgagggctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctggggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcaaccctcccagcagccccgtgcggacctgcgggccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagctgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatctgcgggacttcaccaactacggcctggagcactggggctcggacacgcagggcgtggagaagacccggcgctttctgctcgagtggctgtccttcctgtgccggtacgtcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattctttt

SEQ ID NO: 37720 - DNA, 723 bp, Homo sapiens
cgcctgtgtctctctctgtctctctcagcctggctctcttggtctcttcctctctgcatctcactctctgcctcctaccctgcgtggcggcttctcccccagctccacggccgctctcgggagcagcgctacaccaagctagctgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatctgcgggacttcaccaactacggcctggagcactggggctcggacacgcagggcgtggagaagacccggcgctttctgctcgagtggctgtccttcctgtgccggtacgtcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattctttt

SEQ ID NO: 37721 - DNA, 540 bp, Homo sapiens
tttaggatcccaatcgccacgaccagagcagcggcactgggacatctcgtcgtccgagcgcctggacatctgcgggacttcaccaactacggcctggagcactggggctcggacacgcagggcgtggagaagacccggcgctttctgctcgagtggctgtccttcctgtgccggtacgtcccgtggggctgctggagcggctcccacagaggatcaacgagcggccgccctactacctgggccgcgactacctggagacgctgatggccagccagaaggcagccgactggatccgcatcaggtgcctgggtgggctggagttggggagctgcagtcgggggcccggggtcacggagggtactttgcaggtcctgggcctgacctcgctttccacctgctctcccacagcgagatgctccttgggccagtgccccccagcttcgccttcttgccgaagcacaaggccaacgcgtacaagtagcctcaggctttcccaggggcaccctggggcgaggagagtacaataaattttattctttt

SEQ ID NO: 37722 - DNA, 800 bp, Homo sapiens
gcacaatcagggaagacacgcgtgacccggaaggtcttcccgccacactccagagcgggtgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagatcggacacgcagggcgtggagaagacccggcgctttctgctcgagtggctgtccttcctgtgccggtacgtcccgtggggctgctggagcggctcccacagaggatcaacgagcggccgccctactacctgggccgcgactacctggagacgctgatggccagccagaaggcagccgactggatccgcatcaggtgcctgggtgggctggagttggggagctgcagtcgggggcccggggtcacggagggtactttgcaggtcctgggcctgacctcgctttccacctgctctcccacagcgagatgctccttgggccagtgccccccagcttcgccttcttgccgaagcacaaggccaacgcgtacaagtagcctcaggctttcccaggggcaccctggggcgaggagagtacaataaattttattctttt

SEQ ID NO: 37723 - DNA, 2189 bp, Homo sapiens
gcacaatcagggaagacacgcgtgacccggaaggtcttcccgccacactccagagcgggtgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctggggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcaaccctcccagcagccccgtgcggacctgcgggccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagctgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatctgcgggacttcaccaactacggcctggagcactggggctcggacacgcagggcgtggagaagacccggcgctttctgctcgagtggctgtccttcctgtgccggtacgtcccgtggggctgctggagcggctcccacagaggatcaacgagcggccgccctactacctgggccgcgactacctggagacgctgatggccagccagaaggcagccgactggatccgcatcaggtgcctgggtgggctggagttggggagctgcagtcgggggcccggggtcacggagggtactttgcaggtcctgggcctgacctcgctttccacctgctctcccacagcgagatgctccttgggccagtgccccccagcttcgccttcttgccgaagcacaaggccaacgcgtacaagtagcctcaggctttcccaggggcaccctggggcgaggagagtacaataaattttattctttt

SEQ ID NO: 37724 - DNA, 1079 bp, Homo sapiens
  misc_feature (37)..(37): n is a, c, g, or t
  misc_feature (39)..(39): n is a, c, g, or t
  misc_feature (51)..(51): n is a, c, g, or t
  misc_feature (57)..(57): n is a, c, g, or t
aatcgcccttttatggggtacacataaatgaaacccngntgtggctctaanacaaangcagggtccgtcgaatcggattgtagggcgcgatgcgaggacgcgagtctctaagatgtgggggcgatcggagcgacttggacgagagtgcgccattagcgtcatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagtggcgccctgctcaagccgtggctcttcacggagatcaaggagcagcggcactgggacatctcgtcgtccgagcgcctggacatctgcgggacttcaccaactacggcctggagcactggggctcggacacgcagggcgtggagaagacccggcgctttctgctcgagtggctgtccttcctgtgccggtacgtcccgtggggctgctggagcggctcccacagaggatcaacgagcggccgccctactacctgggccgcgactacctggagacgctgatggccagccagaaggcagccgactggatccgcatcaggtgcctgggtgggctggagttggggagctgcagtcgggggcccggggtcacggagggtactttgcaggtcctgggcctgacctcgctttccacctgctctcccacagcgagatgctccttgggccagtgccccccagcttcgccttcttgccgaagcacaaggccaacgcgtacaagtagcctcaggctttcccaggggcaccctggggcgaggagagtacaataaattttattctttt

SEQ ID NO: 37725 - DNA, 1089 bp, Homo sapiens
  misc_feature (37)..(37): n is a, c, g, or t
  misc_feature (39)..(39): n is a, c, g, or t
  misc_feature (51)..(51): n is a, c, g, or t
  misc_feature (57)..(57): n is a, c, g, or t
aatcgcccttttatggggtacacataaatgaaacccngntgtggctctaanacaaangcagggtccgtcgaatcggattgtagggcgcgatgcgaggacgcgagtctctaagatgtgggggcgatcggagcgacttggacgagagtgcgccattagcgtcatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctggggcccgagggacttcaccaactacggcctggagcactggggctcggacacgcagggcgtggagaagacccggcgctttctgctcgagtggctgtccttcctgtgccggtacgtcccgtggggctgctggagcggctcccacagaggatcaacgagcggccgccctactacctgggccgcgactacctggagacgctgatggccagccagaaggcagccgactggatccgcatcaggtgcctgggtgggctggagttggggagctgcagtcgggggcccggggtcacggagggtactttgcaggtcctgggcctgacctcgctttccacctgctctcccacagcgagatgctccttgggccagtgccccccagcttcgccttcttgccgaagcacaaggccaacgcgtacaagtagcctcaggctttcccaggggcaccctggggcgaggagagtacaataaattttattctttt

SEQ ID NO: 37726 - DNA, 312 bp, Homo sapiens
tccaaaaatccttcttcaagcaattaaaaaaaatcctttattttgaaagaatctaagtctctaacttctgtcccttatagcaagtcactctctggaaaaactattacctgattgggttgtttcgctgttcaatagaacaattctcatactgcaactatttcaaagactctcataagttcaacttgctaagtaaccatcaaaatggaactcatattaattttctttgtctactcaatttccagtaattccttactgcaatgacttaaaatactttgttgtcaatgttagcaacctattttcagtagacccttc

SEQ ID NO: 37727 - DNA, 488 bp, Homo sapiens
tatccaccaaagctaaggttcaccatcacaacaataaagccccaggttttagggtatagaaaaaaattcaacagccatgttttcagacataggactccatcagaggggaatattagtgtgttccaccttcagaaaaaatcctgcaatgtagtgataattcaccccatcttacagatgtggttaaaccacttacccagagtcacacagctagtaaggaacagatcccaaattcaaatttaggaatgctcttatcttttttacctgcatcatgcagcctgccatacaaacatatttgaaatgagggtgctgagggttccagtagattcttcagatctttcaaaaatctttctggcctccactattctgactttcaaaaatcttcagttttcctgggtctcttccctaacagtacacaaatgcaggttaagtgagcacctgctaaaagtttagtttaaatagcaactaacttgattaagctcctctagtct

SEQ ID NO: 37728 - DNA, 351 bp, Homo sapiens
aatgggagcagaggagaaggccggagcacggagaaggggcgggggtgtcacctcccatctccccaaagggctgtctccaacgcctccaactccacctagcaggtgccacctgcacactggagagccatgggggcaggtcgggggtggccgcctcgactctccagtcctcagtttctccaggggtcatgtctatttggctcaaagtcaagaaacaggcttttctcggctgggcacagtggctcacgcctataatctccgcactttgggaggctgaggtggccagatcacttgaggtcaggagttcgagaccagcctggccaacacggtgaaactctgtctctactaaatata

SEQ ID NO: 37729 - DNA, 3346 bp, Homo sapiens
ggtggggggaagcgcagtgcgcaggcgcaactgcctggctctgctcgctccggcgctccggcccagctctcgcggacaagtccagacatcgcgcgcccccccttctccgggtccgccccctcccccttctcggcgtcgtcgaagataaacaatagttggccggcgagcgcctagtgtgtctcccgccgccggattcggcgggctgcgtgggaccggcgggatcccggccagccggccatggcggggctgtactcgctgggagtgagcgtcttctccgaccagggcgggaggaagtacatggaggacgttactcaaatcgttgtggagcccgaaccgacggctgaagaaaagccctcgccgcggcggtcgctgtctcagccgttgcctccgcggccgtcgccggccgcccttcccggcggcgaagtctcggggaaaggcccagcggtggcagcccgagaggctcgcgaccctctcccggacgccggggcctcgccggcacctagccgctgctgccgccgccgttcctccgtggcctttttcgccgtgtgcgacgggcacggcgggcgggaggcggcacagtttgcccgggagcacttgtggggtttcatcaagaagcagaagggtttcacctcgtccgagccggctaaggtttgcgctgccatccgcaaaggctttctcgcttgtcaccttgccatgtggaagaaactggcggaatggccaaagactatgacgggtcttcctagcacatcagggacaactgccagtgtggtcatcattcggggcatgaagatgtatgtagctcacgtaggtgactcaggggtggttcttggaattcaggatgacccgaaggatgactttgtcagagctgtggaggtgacacaggaccataagccagaacttcccaaggaaagagaacgaatcgaaggacttggtgggagtgtaatgaacaagtctggggtgaatcgtgtagtttggaaacgacctcgactcactcacaatggacctgttagaaggagcacagttattgaccagattccttttctggcagtagcaagagcacttggtgatttgtggagctatgatttcttcagtggtgaatttgtggtgtcacctgaaccagacacaagtgtccacactcttgaccctcagaagcacaagtatattatattggggagtgatggactttggaatatgattccaccacaagatgccatctcaatgtgccaggaccaagaggagaaaaaatacctgatgggtgagcatggacaatcttgtgccaaaatgcttgtgaatcgagcattgggccgctggaggcagcgtatgctccgagcagataacactagtgccatagtaatctgcatctctccagaagtggacaatcagggaaactttaccaatgaagatgagttatacctgaacctgactgacagcccttcctataatagtcaagaaacctgtgtgatgactccttccccatgttctacaccaccagtcaagtcactggaggaggatccatggccaagggtgaattctaaggaccatatacctgccctggttcgtagcaatgccttctcagagaattttttagaggtttcagctgagatagctcgagagaatgtccaaggtgtagtcataccctcaaaagatccagaaccacttgaagaaaattgcgctaaagccctgactttaaggatacatgattctttgaataatagccttccaattggccttgtgcctactaattcaacaaacactgtcatggaccaaaaaaatttgaagatgtcaactcctggccaaatgaaagcccaagaaattgaaagaacccctccaacaaactttaaaaggacattagaagagtccaattctggccccctgatgaagaagcatagacgaaatggcttaagtcgaagtagtggtgctcagcctgcaagtctccccacaacctcacagcgaaagaactctgttaaactcaccatgcgacgcagacttaggggccagaagaaaattggaaatcctttacttcatcaacacaggaaaactgtttgtgtttgctgaaatgcatctgggaaatgaggtttttccaaacttaggatataagagggctttttaaatttggtgccgatgttgaactttttttaaggggagaaaattaaaagaaatatacagtttgactttttggaattcagcagttttatcctggccttgtacttgcttgtattgtaaatgtggattttgtagatgttagggtataagttgctgtaaaatttgtgtaaatttgtatccacacaaattcagtctctgaatacacagtattcagagtctctgatacacagtaattgtgacaatagggctaaatgtttaaagaaatcaaaagaatctattagattttagaaaaacatttaaactttttaaaatacttattaaaaaatttgtataagccacttgtcttgaaaactgtgcaactttttaaagtaaattattaagcagactggaaaagtgatgtattttcatagtgacctgtgtttcacttaatgtttcttagagccaagtgtcttttaaacattattttttatttctgatttcataattcagaactaaatttttcatagaagtgttgagccatgctacagttagtcttgtcccaattaaaatactatgcagtatctcttacatcagtagcatttttctaaaaccttagtcatcagatatgcttactaaatcttcagcatagaaggaagtgtgtttgcctaaaacaatctaaaacaattcccttctttttcatcccagaccaatggcattattaggtcttaaagtagttactcccttctcgtgtttgcttaaaatatgtgaagttttccttgctatttcaataacagatggtgctgctaattcccaacatttcttaaattattttatatcatacagttttcattgattatatgggtatatattcatctaataaatcagtgaactgttcctcatgttgctgaatttgtagttgttggtttattttaatggtatgtacaagttgagtatcccttatccaaaatgcttgggaccagaagtgtttcagattttttaaaattttggaatatttgctttatactgagcttttgagtgttcccaatctgaaattcaaaatgctctaatgagcatttcctttgagcatcatgcctgctctgaaaaagtttctgattctggagcattttggattttggattttcagattagggatgcttaacctggattaacattctgttgtgccatgatcatgctttacagtgagtgtattttatttatttattattttgtttgtttgtttgagatggagtctcactctgtcatc

SEQ ID NO: 37730 - DNA, 2092 bp, Homo sapiens
tctccctactgtatcctacgaatcgaaggacttggtgggagtgtaatgaacaagtctggggtgaatcgtgtagtttggaaacgacctcgactcactcacaatggacctgttagaaggagcacagttattgaccagattccttttctggcagtagcaagagcacttggtgatttgtggagctatgatttcttcagtggtgaatttgtggtgtcacctgaaccagacacaagtgtccacactcttgaccctcagaagcacaagtatattatattggggagtgatggactttggaatatgattccaccacaagatgccatctcaatgtgccaggaccaagaggagaaaaaatacctgatgggtgagcatggacaatcttgtgccaaaatgcttgtgaatcgagcattgggccgctggaggcagcgtatgctccgagcagataacactagtgccatagtaatctgcatctctccagaagtggacaatcagggaaactttaccaatgaagatgagttatacctgaacctgactgacagcccttcctataatagtcaagaaacctgtgtgatgactccttccccatgttctacaccaccagtcaagtcactggaggaggatccatggccaagggtgaattctaaggaccatatacctgccctggttcgtagcaatgccttctcagagaattttttagaggtttcagctgagatagctcgagagaatgtccaaggtgtagtcataccctcaaaagatccagaaccacttgaagaaaattgcgctaaagccctgactttaaggatacatgattctttgaataatagccttccaattggccttgtgcctactaattcaacaaacactgtcatggaccaaaaaaatttgaagatgtcaactcctggccaaatgaaagcccaagaaattgaaagaacccctccaacaaactttaaaaggacattagaagagtccaattctggccccctgatgaagaagcatagacgaaatggcttaagtcgaagtagtggtgctcagcctgcaagtctccccacaacctcacagcgaaagaactctgttaaactcaccatgcgacgcagacttaggggccagaagaaaattggaaatcctttacttcatcaacacaggaaaactgtttgtgtttgctgaaatgcatctgggaaatgaggtttttccaaacttaggatataagagggctttttaaatttggtgccgatgttgaactttttttaaggggagaaaattaaaagaaatatacagtttgactttttggaattcagcagttttatcctggccttgtacttgcttgtattgtaaatgtggattttgtagatgttagggtataagttgctgtaaaatttgtgtaaatttgtatccacacaaattcagtctctgaatacacagtattcagagtctctgatacacagtaattgtgacaatagggctaaatgtttaaagaaatcaaaagaatctattagattttagaaaaacatttaaactttttaaaatacttattaaaaaatttgtataagccacttgtcttgaaaactgtgcaactttttaaagtaaattattaagcagactggaaaagtgatgtattttcatagtgacctgtgtttcacttaatgtttcttagagccaagtgtcttttaaacattattttttatttctgatttcataattcagaactaaatttttcatagaagtgttgagccatgctacagttagtcttgtcccaattaaaatactatgcagtatctcttacatcagtagcatttttctaaaaccttagtcatcagatatgcttactaaatcttcagcatagaaggaagtgtgtttgcctaaaacaatctaaaacaattcccttctttttcatcccagaccaatggcattattaggtcttaaagtagttactcccttctcgtgtttgcttaaaatatgtgaagttttccttgctatttcaataacagatggtgctgctaattcccaacatttcttaaattattttatatcatacagttttcattgattatatgggtatatattcatctaataaatcagtgaactgttcctcatgttgctg

SEQ ID NO: 37731 - DNA, 340 bp, Homo sapiens
tcttatttgttttaccttcttatttttcagtcactggaggaggatccatggccaagggtgaattctaaggaccatatacctgccctggttcgtagcaatgccttctcagagaattttttagaggtttcagctgagatagctcgagagaatgtccaaggtgtagtcataccctcaaaagatccagaaccacttgaagaaaattgcgctaaagccctgactttaaggatacatgattctttgaataatagccttccaattggccttgtgcctactaattcaacaaacactgtcatggaccaaaaaaatttgaagatgtcaactcctggccaaatgaaagccc

SEQ ID NO: 37732 - DNA, 2989 bp, Homo sapiens
ggtggggggaagcgcagtgcgcaggcgcaactgcctggctctgctcgctccggcgctccggcccagctctcgcggacaagtccagacatcgcgcgcccccccttctccgggtccgccccctcccccttctcggcgtcgtcgaagataaacaatagttggccggcgagcgcctagtgtgtctcccgccgccggattcggcgggctgcgtgggaccggcgggatcccggccagccggccatggcggggctgtactcgctgggagtgagcgtcttctccgaccagggcgggaggaagtacatggaggacgttactcaaatcgttgtggagcccgaaccgacggctgaagaaaagccctcgccgcggcggtcgctgtctcagccgttgcctccgcggccgtcgccggccgcccttcccggcggcgaagtctcggggaaaggcccagcggtggcagcccgagaggctcgcgaccctctcccggacgccggggcctcgccggcacctagccgctgctgccgccgccgttcctccgtggcctttttcgccgtgtgcgacgggcacggcgggcgggaggcggcacagtttgcccgggagcacttgtggggtttcatcaagaagcagaagggtttcacctcgtccgagccggctaaggtttgcgctgccatccgcaaaggctttctcgcttgtcaccttgccatgtggaagaaactggcggaatggccaaagactatgacgggtcttcctagcacatcagggacaactgccagtgtggtcatcattcggggcatgaagatgtatgtagctcacgtaggtgactcaggggtggttcttggaattcaggatgacccgaaggatgactttgtcagagctgtggaggtgacacaggaccataagccagaacttcccaaggaaagagaacgaatcgaaggacttggtgggagtgtaatgaacaagtctggggtgaatcgtgtagtttggaaacgacctcgactcactcacaatggacctgttagaaggagcacagttattgaccagattccttttctggcagtagcaagagcacttggtgatttgtggagctatgatttcttcagtggtgaatttgtggtgtcacctgaaccagacacaagtgtccacactcttgaccctcagaagcacaagtatattatattggggagtgatggactttggaatatgattccaccacaagatgccatctcaatgtgccaggaccaagaggagaaaaaatacctgatgggtgagcatggacaatcttgtgccaaaatgcttgtgaatcgagcattgggccgctggaggcagcgtatgctccgagcagataacactagtgccatagtaatctgcatctctccagaagtggacaatcagggaaactttaccaatgaagatgagttatacctgaacctgactgacagcccttcctataatagtcaagaaacctgtgtgatgactccttccccatgttctacaccaccagtcaagtcactggaggaggatccatggccaagggtgaattctaaggaccatatacctgccctggttcgtagcaatgccttctcagagaattttttagaggtttcagctgagatagctcgagagaatgtccaaggtgtagtcataccctcaaaagatccagaaccacttgaagaaaattgcgctaaagccctgactttaaggatacatgattctttgaataatagccttccaattggccttgtgcctactaattcaacaaacactgtcatggaccaaaaaaatttgaagatgtcaactcctggccaaatgaaagcccaagaaattgaaagaacccctccaacaaactttaaaaggacattagaagagtccaattctggccccctgatgaagaagcatagacgaaatggcttaagtcgaagtagtggtgctcagcctgcaagtctccccacaacctcacagcgaaagaactctgttaaactcaccatgcgacgcagacttaggggccagaagaaaattggaaatcctttacttcatcaacacaggaaaactgtttgtgtttgctgaaatgcatctgggaaatgaggtttttccaaacttaggatataagagggctttttaaatttggtgccgatgttgaactttttttaaggggagaaaattaaaagaaatatacagtttgactttttggaattcagcagttttatcctggccttgtacttgcttgtattgtaaatgtggattttgtagatgttagggtataagttgctgtaaaatttgtgtaaatttgtatccacacaaattcagtctctgaatacacagtattcagagtctctgatacacagtaattgtgacaatagggctaaatgtttaaagaaatcaaaagaatctattagattttagaaaaacatttaaactttttaaaatacttattaaaaaatttgtataagccacttgtcttgaaaactgtgcaactttttaaagtaaattattaagcagactggaaaagtgatgtattttcatagtgacctgtgtttcacttaatgtttcttagagccaagtgtcttttaaacattattttttatttctgatttcataattcagaactaaatttttcatagaagtgttgagccatgctacagttagtcttgtcccaattaaaatactatgcagtatctcttacatcagtagcatttttctaaaaccttagtcatcagatatgcttactaaatcttcagcatagaaggaagtgtgtttgcctaaaacaatctaaaacaattcccttctttttcatcccagaccaatggcattattaggtcttaaagtagttactcccttctcgtgtttgcttaaaatatgtgaagttttccttgctatttcaataacagatggtgctgctaattcccaacatttcttaaattattttatatcatacagttttcattgattatatgggtatatattcatctaataaatcagtgaactgttcctcatgttgctg

SEQ ID NO: 37733 - DNA, 2651 bp, Homo sapiens
ggtggggggaagcgcagtgcgcaggcgcaactgcctggctctgctcgctccggcgctccggcccagctctcgcggacaagtccagacatcgcgcgcccccccttctccgggtccgccccctcccccttctcggcgtcgtcgaagataaacaatagttggccggcgagcgcctagtgtgtctcccgccgccggattcggcgggctgcgtgggaccggcgggatcccggccagccggccatggcggggctgtactcgctgggagtgagcgtcttctccgaccagggcgggaggaagtacatggaggacgttactcaaatcgttgtggagcccgaaccgacggctgaagaaaagccctcgccgcggcggtcgctgtctcagccgttgcctccgcggccgtcgccggccgcccttcccggcggcgaagtctcggggaaaggcccagcggtggcagcccgagaggctcgcgaccctctcccggacgccggggcctcgccggcacctagccgctgctgccgccgccgttcctccgtggcctttttcgccgtgtgcgacgggcacggcgggcgggaggcggcacagtttgcccgggagcacttgtggggtttcatcaagaagcagaagggtttcacctcgtccgagccggctaaggtttgcgctgccatccgcaaaggctttctcgcttgtcaccttgccatgtggaagaaactggcggaatggccaaagactatgacgggtcttcctagcacatcagggacaactgccagtgtggtcatcattcggggcatgaagatgtatgtagctcacgtaggtgactcaggggtggttcttggaattcaggatgacccgaaggatgactttgtcagagctgtggaggtgacacaggaccataagccagaacttcccaaggaaagagaacgaatcgaaggacttggtgggagtgtaatgaacaagtctggggtgaatcgtgtagtttggaaacgacctcgactcactcacaatggacctgttagaaggagcacagttattgaccagattccttttctggcagtagcaagagcacttggtgatttgtggagctatgatttcttcagtggtgaatttgtggtgtcacctgaaccagacacaagtgtccacactcttgaccctcagaagcacaagtatattatattggggagtgatggactttggaatatgattccaccacaagatgccatctcaatgtgccaggaccaagaggagaaaaaatacctgatgggtgagcatggacaatcttgtgccaaaatgcttgtgaatcgagcattgggccgctggaggcagcgtatgctccgagcagataacactagtgccatagtaatctgcatctctccagaagtggacaatcagggaaactttaccaatgaagatgagttatacctgaacctgactgacagcccttcctataatagtcaagaaacctgtgtgatgactccttccccatgttctacaccaccagtcaagtcactggaggaggatccatggccaagggtgaattctaaggaccatatacctgccctggttcgtagcaatgccttctcagagaattttttagaggtttcagctgagatagctcgagagaatgtccaaggtgtagtcataccctcaaaagatccagaaccacttgaagaaaattggaaatcctttacttcatcaacacaggaaaactgtttgtgtttgctgaaatgcatctgggaaatgaggtttttccaaacttaggatataagagggctttttaaatttggtgccgatgttgaactttttttaaggggagaaaattaaaagaaatatacagtttgactttttggaattcagcagttttatcctggccttgtacttgcttgtattgtaaatgtggattttgtagatgttagggtataagttgctgtaaaatttgtgtaaatttgtatccacacaaattcagtctctgaatacacagtattcagagtctctgatacacagtaattgtgacaatagggctaaatgtttaaagaaatcaaaagaatctattagattttagaaaaacatttaaactttttaaaatacttattaaaaaatttgtataagccacttgtcttgaaaactgtgcaactttttaaagtaaattattaagcagactggaaaagtgatgtattttcatagtgacctgtgtttcacttaatgtttcttagagccaagtgtcttttaaacattattttttatttctgatttcataattcagaactaaatttttcatagaagtgttgagccatgctacagttagtcttgtcccaattaaaatactatgcagtatctcttacatcagtagcatttttctaaaaccttagtcatcagatatgcttactaaatcttcagcatagaaggaagtgtgtttgcctaaaacaatctaaaacaattcccttctttttcatcccagaccaatggcattattaggtcttaaagtagttactcccttctcgtgtttgcttaaaatatgtgaagttttccttgctatttcaataacagatggtgctgctaattcccaacatttcttaaattattttatatcatacagttttcattgattatatgggtatatattcatctaataaatcagtgaactgttcctcatgttgctg

SEQ ID NO: 37734 - DNA, 1577 bp, Homo sapiens
cgcttaacgttgtgacagctatactataaagtgatgtaactgtgtgatgagtccttacccctatgtactagaccaacagttaatgtcactggaggaggatccatggccaagggtgaattctaaggaccatatacctgccctggttcgtagcaatgccttctcagagaattttttagaggtttcagctgagatagctcgagagaatgtccaaggtgtagtcataccctcaaaagatccagaaccacttgaagaaaattgcgctaaagccctgactttaaggatacatgattctttgaataatagccttccaattggccttgtgcctactaattcaacaaacactgtcatggaccaaaaaaatttgaagatgtcaactcctggccaaatgaaagcccaagaaattgaaagaacccctccaacaaactttaaaaggacattagaagagtccaattctggccccctgatgaagaagcatagacgaaatggcttaagtcgaagtagtggtgctcagcctgcaagtctccccacaacctcacagcgaaagaactctgttaaactcaccatgcgacgcagacttaggggccagaagaaaattggaaatcctttacttcatcaacacaggaaaactgtttgtgtttgctgaaatgcatctgggaaatgaggtttttccaaacttaggatataagagggctttttaaatttggtgccgatgttgaactttttttaaggggagaaaattaaaagaaatatacagtttgactttttggaattcagcagttttatcctggccttgtacttgcttgtattgtaaatgtggattttgtagatgttagggtataagttgctgtaaaatttgtgtaaatttgtatccacacaaattcagtctctgaatacacagtattcagagtctctgatacacagtaattgtgacaatagggctaaatgtttaaagaaatcaaaagaatctattagattttagaaaaacatttaaactttttaaaatacttattaaaaaatttgtataagccacttgtcttgaaaactgtgcaactttttaaagtaaattattaagcagactggaaaagtgatgtattttcatagtgacctgtgtttcacttaatgtttcttagagccaagtgtcttttaaacattattttttatttctgatttcataattcagaactaaatttttcatagaagtgttgagccatgctacagttagtcttgtcccaattaaaatactatgcagtatctcttacatcagtagcatttttctaaaaccttagtcatcagatatgcttactaaatcttcagcatagaaggaagtgtgtttgcctaaaacaatctaaaacaattcccttctttttcatcccagaccaatggcattattaggtcttaaagtagttactcccttctcgtgtttgcttaaaatatgtgaagttttccttgctatttcaataacagatggtgctgctaattcccaacatttcttaaattattttatatcatacagttttcattgattatatgggtatatattcatctaataaatcagtgaactgttcctcatgttgctg

SEQ ID NO: 37735 - DNA, 1685 bp, Homo sapiens
ggtggggggaagcgcagtgcgcaggcgcaactgcctggctctgctcgctccggcgctccggcccagctctcgcggacaagtccagacatcgcgcgcccccccttctccgggtccgccccctcccccttctcggcgtcgtcgaagataaacaatagttggccggcgagcgcctagtgtgtctcccgccgccggattcggcgggctgcgtgggaccggcgggatcccggccagccggccatggcggggctgtactcgctgggagtgagcgtcttctccgaccagggcgggaggaagtacatggaggacgttactcaaatcgttgtggagcccgaaccgacggctgaagaaaagccctcgccgcggcggtcgctgtctcagccgttgcctccgcggccgtcgccggccgcccttcccggcggcgaagtctcggggaaaggcccagcggtggcagcccgagaggctcgcgaccctctcccggacgccggggcctcgccggcacctagccgctgctgccgccgccgttcctccgtggcctttttcgccgtgtgcgacgggcacggcgggcgggaggcggcacagtttgcccgggagcacttgtggggtttcatcaagaagcagaagggtttcacctcgtccgagccggctaaggtttgcgctgccatccgcaaaggctttctcgcttgtcaccttgccatgtggaagaaactggcggaatggccaaagactatgacgggtcttcctagcacatcagggacaactgccagtgtggtcatcattcggggcatgaagatgtatgtagctcacgtaggtgactcaggggtggttcttggaattcaggatgacccgaaggatgactttgtcagagctgtggaggtgacacaggaccataagccagaacttcccaaggaaagagaacgaatcgaaggacttggtgggagtgtaatgaacaagtctggggtgaatcgtgtagtttggaaacgacctcgactcactcacaatggacctgttagaaggagcacagttattgaccagattccttttctggcagtagcaagagcacttggtgatttgtggagctatgatttcttcagtggtgaatttgtggtgtcacctgaaccagacacaagtgtccacactcttgaccctcagaagcacaagtatattatattggggagtgatggactttggaatatgattccaccacaagatgccatctcaatgtgccaggaccaagaggagaaaaaatacctgatgggtgagcatggacaatcttgtgccaaaatgcttgtgaatcgagcattgggccgctggaggcagcgtatgctccgagcagataacactagtgccatagtaatctgcatctctccagaagtggacaatcagggaaactttaccaatgaagatgagttatacctgaacctgactgacagcccttcctataatagtcaagaaacctgtgtgatgactccttccccatgttctacaccaccagtcaagtcactggaggaggatccatggccaagggtgaattctaaggaccatatacctgccctggttcgtagcaatgccttctcagagaattttttagaggtttcagctgagatagctcgagagaatgtccaaggtgtagtcataccctcaaaagatccagaaccacttaacatcgcacttgacaggaccggccg

SEQ ID NO: 37736 - DNA, 319 bp, Homo sapiens
ggaagttttggaacacccttccacagacagggaatctagggccccagctccgccttgctgcagactcttggggccatgctgggacagctactagaaaaatccttacagaacttctcttggcctcttgtgttttctttatctctatttctttctgtacttacccagctctttgtgcttctacattaatcacatgagactgcccaggtgtgactgttaagtgactgatttccttattctgtgttctgtgatcaactctcctgcacctgcgggagaagagccacgccgcaggccgtgttccccaaccttgctggcaccaggg

SEQ ID NO: 37737 - DNA, 587 bp, Homo sapiens
attggccattcaagtttcctcctttatgaaatggttgttcatgtcatttgctcatttttatattagattgtttttcttttttccagctgacttgtaggaactctacatcttatcaatattaatcatttatcgaaaactatttgggtgccattatcttctcctagtcaatgttttttgtttgtgatatcttttataatatataagtttttaatgttggcagaagtaaagttaatctttttggctgtgttgtgtgtcttgtttgatgtaaagatagtttctgtaatagttttgcagtttgattgttcatctttaggtcttcaattacaacctgcacatccatcccctctatcctctttcttactctgtttttctccatagcacttatcatccaataatatgtcatgcactttatttatctgttttgcatatatattttgtctgttacctgtttccttccactagaatgtaagtcccatgagggcagggacttgcatctattttgtttgtggttgtatctctaacacctgggatagtcactggcaaatgatagttgctcaataaatatttgttggacaaataaagatcca

SEQ ID NO: 37738 - DNA, 305 bp, Homo sapiens
cgccaccacacccagctaatttttgcatttttagtagagacagggtttcgccatgttggtctcgaactcctgacctcaggtgatccaccaaacttggcctcccaaagtgctgggattacaggtgcgagccaccgcacccggacgagggtttatgtcttttatcagatggtacactcttaccatctgagtggtaatcccatttttgtaaccccaacattcagcacactgcctaaggttcagtaattatccaatagtcactcaatagagtttatcttcatgggaataaaattgcttaaaaaaactgg

SEQ ID NO: 37739 - DNA, 422 bp, Homo sapiens
aattctctcatgagtcattatacatattacaaggaagaaagcaactctagctttattcccccggatcaaacatggatcctgttgagaagaggtctcttatgagagcgtactgtgtcccagactttgtatgtggaagcccaaacccccagtacctcacaatgtgactgtgtttggagacagagccttttaagagacagttcaggtaaaataaagtcattatatggtggaccctaatccaatatgaccagtgccctcacaagaagaggccataaggatgcaaacgcacacagagggaagaccatgtgaagacagagaagatggtcatctccaagccagggacaatggtacagagagaaaccaaccctgctgacaccttgatctaggactcccaacctccagaactgtgaggaactacattcctg

SEQ ID NO: 37740 - DNA, 857 bp, Homo sapiens
atgcgtttctggccctgacataagctgtctggcctctctgtgacatgatgaaattgaaatcaatccacagtccatgaaattgtgacactccaccagattaagttagggcataacattaacttggaaatggccatgtcatcacccctgcggctgtcctatagctgagatgcgtgggtcgcaggggaggtgatttctaggcatattgctgtcccttttgtgtatctgtcatccggatgcttcggaccccacgcctctgcaagtgggagagacccgagcatcctccccacccccatagctccagtgcacgccacccccgtcttgcctgggtcggggcctgcggccagcaccatttcacacacactccttgtagatgggagccagaggaaacctgaacgtgggtggagcgttccactgagtctacttcaggagacagaaggcccatgctgatgggggaggaggagggacgtgggcattttggacaccaggggaaatggaaatgctgctttcaaaacttagtttcctttccatttcttcctagtctggcctttgacacaaatctggtagaaagaagcctgataaattgagggcacttgtaccctccctgtgcccccagaaggttcttggagagaagtgcaagaatttgtgaacacggcggtggagggcgggtggatggccatgggctgggcctccgtatcaggcctgctcaccttgctgggagctttattctgatctcattttgaatgttccagagggagcatcataagagcccagagctccgatttccaaagagtgatattgacatttatggagattggtgttgtaacatattttgataaatactaacttattttgttggg

SEQ ID NO: 37741 - DNA, 468 bp, Homo sapiens
  misc_feature (431)..(431): n is a, c, g, or t
gccggacgaactcagagtgtcttcctcctccacaaacaatcctgcttatctcctcaggagagaagcaggatggaaagatgcattcagactgttaatttattaacaaggcaaatgattttgtgtttcttgatgacagactattaagtttgggacttattttcccatttgagaagttataatatatatttaagatgataagtttcctgcttaagttgtgcctttcagcttcaatgagtttaaggagcactaagggtaatgataccaatgagggttggtttattatcaaacctgaatagctgtggtttctccagtaaatattttcttctactgaacatggagccattattaagagttgtgtgttttttattatgtacatttgtatatttttttgcttttgttttttaaataacgtacttctacctgagtttccnaggttttattatatctaacgcaagtcctgctatctgg

SEQ ID NO: 37742 - DNA, 4040 bp, Homo sapiens
  misc_feature (3047)..(3047): n is a, c, g, or t
atgcgtttctggccctgacataagctgtctggcctctctgtgacatgatgaaattgaaatcaatccacagtccatgaaattgtgacactccaccagattaagttagggcataacattaacttggaaatggccatgtcatcacccctgcggctgtcctatagctgagatgcgtgggtcgcaggggaggtgatttctaggcatattgctgtcccttttgtgtatctgtcatccggatgcttcggaccccacgcctctgcaagtgggagagacccgagcatcctccccacccccatagctccagtgcacgccacccccgtcttgcctgggtcggggcctgcggccagcaccatttcacacacactccttgtagatgggagccagaggaaacctgaacgtgggtggagcgttccactgagtctacttcaggagacagaaggcccatgctgatgggggaggaggagggacgtgggcattttggacaccaggggaaatggaaatgctgctttcaaaacttagtttcctttccatttcttcctagtctggcctttgacacaaatctggtagaaagaagcctgataaattgagggcacttgtaccctccctgtgcccccagaaggttcttggagagaagtgcaagaatttgtgaacacggcggtggagggcgggtggatggccatgggctgggcctccgtatcaggcctgctcaccttgctgggagctttattctgatctcattttgaatgttccagagggagcatcataagagcccagagctccgatttccaaagagtgatattgacatttatggagattggtgttgtaacatattttgataaatactaacttattttgttggggtttggttgtctcttgtcttaggacctggtagttatttgcttgatttttttttccgttattttctacataggcaaagagaattcgagggatagacagtctccaagaaaagtgaagtggtgggagagaattgcttttttcttttttttcttttctctagtttttctttctggctgagatttccgtgcaagacagcacccaatagactatttagagttgacatttgacattttaatgggcgccatggctcattttgtagattgagaaggtgcgtctcccctgctccaagtctcatcatgacagcgtgctgacagctgggagtctgtggccttcctcacgcagaggccttaaagctggacacagaagcacgcctaggctgggcagggatgggacccatgccccctccttagaggacgggcttcctggttaggaaaggacacgtgggggtgccttgcataatagttcactggtcaccgtgcttttatgagtagtgtttttgtgcacttgccaggggttttctctctgtgtgcgaggggagtgatttaagcaatggtgtctggagtaagccttacaattttaatagactttttcttatcatatccctcatttctttccctgaaataaaaatacacacaagcaaaaaaaaaatgatagtttcacatctcttagttcccttgcccaaacaagaatattcttagttccactggccaggattttcctacatagtcagaacttacacattactagaggcacacccaccaaggagtattgtgtctacttttatctgtgcaccagccacaaatacccacattggaaagacccatttgtgatgggtaaacatcccttcctgtctcccacaacccctgtgactgccctgcatgtgttcatgacctccgaaggccctaattcatgaagcagcaaacccagcagatctccacccccctgcctcaggacctctgctgaagagggggatgaagtgggtctccagggaggcagtgggggccttgttggcagctggctcgggagccggcttacaggagggcagctctgcagttgggaggggcaccgtccggaggagaccaggcctctacacaccccccactctacttatcatccctgctcacacacccttgtccaaggctttatgcatcggatttatttttccaaatcaagaggacagtgatagatgcattttccccaggctgtctcagaaaggtcgctaaatgtatactgttgtcagaattgctgagatctccccccacttttggtttttgcagcagtaaaaactctttccactgtgacttattttctctctcaggcagccagccacctggtcccttgtgctgactctagcacagtggccaggatccaatacgagtccaggggtgaccgcaggatggtgggggcagcgggcttctccacctaccccagccaccaaggccctgacgcactgcctcctgcaccttcagcacatccctgtgcacagctggaagggtgcatggcccgctcacctttgttcagatgggtggaaacgctgatgataccagctcctccctgccgtgcccctgccacggagcaggcattgtgaactggctggtgtttgcagtcccacgtggcatggcctccagcccaacccacagtggagactggagacagggcaatgagtctggtcgggggcacgtggacatgccccataggggccccacccagacttaacaggcaaggtcctgggcattgcgcgacgcaggactcaatgctaaagcaagcctgcctggctctgtgccagggcccctcttctgatttacacatcccatttttacacagacccttccttcttaataaaggctgacagttctgttggcagccaagaacccacaccatgaagacagggagtgaggggcctttgtgcccaactccagcacagctgcgttctggggtgtgtgagaggcatgttcgtgtctgtgcgctggtggtctcgtgagacagttccgaggacggggaaattgcagggtggtgggggcgtgaggcttatatgtggaactgatgcagagttcgcctgcagacggatctggatatacactatgtataattgttacgtgtaatttaaaatatatctgtttgccatcgtcatgagaagattatatgtaaggctctgaagggagagggagatgtacattctgccaggctcctgnggaccttatccgagtcatgaaattgatgactgttgatccagtggtgcaagaagctacactccatgtgtcatcacgcttatgactcctaatgtatttttaaggcaaaaaatgtcagccgactccatcttcacccctcgattcctcgagtccagcctttctgtgccagtgcttcactgagccacaacgctctcgccatcgggacccggctgggcctggagtctcggggcacagttgccatggagccctcctgggtcattctacaaatgtgctgagtgccagctgaaaaccccacaggagatggagtaccttggccaagcttaaagagaagattttctcagggtatttattagtgtgtccagcagggtcaggaagcaggatggaaagatgcattcagactgttaatttattaacaaggcaaatgattttgtgtttcttgatgacagactattaagtttgggacttattttcccatttgagaagttataatatatatttaagatgataagtttcctgcttaagttgtgcctttcagcttcaatgagtttaaggagcactaagggtaatgataccaatgagggttggtttattatcaaacctgaatagctgtggtttctccagtaaatattttcttctactgaacatggagccattattaagagttgtgtgttttttattatgtacatttgtatatttttttgcttgtttgatgttctatttttctaatagttttcttttagtttcttaaagttgtgatactagatttagattctgatgctaactgcaaatcaggttggtctctgctgggtctctcctgcttttattttactttaaggacaagtgtagttgtcgtccaccacctttcaaaaaatgtgaaactgccctgcctcccctttttgctgacaacactgtgtacattgaccacttcctaccatactttatgttgtaaaatcaaactcttttgtggtacattatctcatgcttctgcaaattcga

SEQ ID NO: 37743 - DNA, 3125 bp, Homo sapiens
  misc_feature (2132)..(2132): n is a, c, g, or t
ccctccacaaacgtaaacacaattcttcgcgatccacgctctccgttaaatttgaagtggtgggagagaattgcttttttcttttttttcttttctctagtttttctttctggctgagatttccgtgcaagacagcacccaatagactatttagagttgacatttgacattttaatgggcgccatggctcattttgtagattgagaaggtgcgtctcccctgctccaagtctcatcatgacagcgtgctgacagctgggagtctgtggccttcctcacgcagaggccttaaagctggacacagaagcacgcctaggctgggcagggatgggacccatgccccctccttagaggacgggcttcctggttaggaaaggacacgtgggggtgccttgcataatagttcactggtcaccgtgcttttatgagtagtgtttttgtgcacttgccaggggttttctctctgtgtgcgaggggagtgatttaagcaatggtgtctggagtaagccttacaattttaatagactttttcttatcatatccctcatttctttccctgaaataaaaatacacacaagcaaaaaaaaaatgatagtttcacatctcttagttcccttgcccaaacaagaatattcttagttccactggccaggattttcctacatagtcagaacttacacattactagaggcacacccaccaaggagtattgtgtctacttttatctgtgcaccagccacaaatacccacattggaaagacccatttgtgatgggtaaacatcccttcctgtctcccacaacccctgtgactgccctgcatgtgttcatgacctccgaaggccctaattcatgaagcagcaaacccagcagatctccacccccctgcctcaggacctctgctgaagagggggatgaagtgggtctccagggaggcagtgggggccttgttggcagctggctcgggagccggcttacaggagggcagctctgcagttgggaggggcaccgtccggaggagaccaggcctctacacaccccccactctacttatcatccctgctcacacacccttgtccaaggctttatgcatcggatttatttttccaaatcaagaggacagtgatagatgcattttccccaggctgtctcagaaaggtcgctaaatgtatactgttgtcagaattgctgagatctccccccacttttggtttttgcagcagtaaaaactctttccactgtgacttattttctctctcaggcagccagccacctggtcccttgtgctgactctagcacagtggccaggatccaatacgagtccaggggtgaccgcaggatggtgggggcagcgggcttctccacctaccccagccaccaaggccctgacgcactgcctcctgcaccttcagcacatccctgtgcacagctggaagggtgcatggcccgctcacctttgttcagatgggtggaaacgctgatgataccagctcctccctgccgtgcccctgccacggagcaggcattgtgaactggctggtgtttgcagtcccacgtggcatggcctccagcccaacccacagtggagactggagacagggcaatgagtctggtcgggggcacgtggacatgccccataggggccccacccagacttaacaggcaaggtcctgggcattgcgcgacgcaggactcaatgctaaagcaagcctgcctggctctgtgccagggcccctcttctgatttacacatcccatttttacacagacccttccttcttaataaaggctgacagttctgttggcagccaagaacccacaccatgaagacagggagtgaggggcctttgtgcccaactccagcacagctgcgttctggggtgtgtgagaggcatgttcgtgtctgtgcgctggtggtctcgtgagacagttccgaggacggggaaattgcagggtggtgggggcgtgaggcttatatgtggaactgatgcagagttcgcctgcagacggatctggatatacactatgtataattgttacgtgtaatttaaaatatatctgtttgccatcgtcatgagaagattatatgtaaggctctgaagggagagggagatgtacattctgccaggctcctgnggaccttatccgagtcatgaaattgatgactgttgatccagtggtgcaagaagctacactccatgtgtcatcacgcttatgactcctaatgtatttttaaggcaaaaaatgtcagccgactccatcttcacccctcgattcctcgagtccagcctttctgtgccagtgcttcactgagccacaacgctctcgccatcgggacccggctgggcctggagtctcggggcacagttgccatggagccctcctgggtcattctacaaatgtgctgagtgccagctgaaaaccccacaggagatggagtaccttggccaagcttaaagagaagattttctcagggtatttattagtgtgtccagcagggtcaggaagcaggatggaaagatgcattcagactgttaatttattaacaaggcaaatgattttgtgtttcttgatgacagactattaagtttgggacttattttcccatttgagaagttataatatatatttaagatgataagtttcctgcttaagttgtgcctttcagcttcaatgagtttaaggagcactaagggtaatgataccaatgagggttggtttattatcaaacctgaatagctgtggtttctccagtaaatattttcttctactgaacatggagccattattaagagttgtgtgttttttattatgtacatttgtatatttttttgcttgtttgatgttctatttttctaatagttttcttttagtttcttaaagttgtgatactagatttagattctgatgctaactgcaaatcaggttggtctctgctgggtctctcctgcttttattttactttaaggacaagtgtagttgtcgtccaccacctttcaaaaaatgtgaaactgccctgcctcccctttttgctgacaacactgtgtacattgaccacttcctaccatactttatgttgtaaaatcaaactcttttgtggtacattatctcatgcttctgcaaattcga

SEQ ID NO: 37744 - DNA, 3692 bp, Homo sapiens
  misc_feature (3047)..(3047): n is a, c, g, or t
atgcgtttctggccctgacataagctgtctggcctctctgtgacatgatgaaattgaaatcaatccacagtccatgaaattgtgacactccaccagattaagttagggcataacattaacttggaaatggccatgtcatcacccctgcggctgtcctatagctgagatgcgtgggtcgcaggggaggtgatttctaggcatattgctgtcccttttgtgtatctgtcatccggatgcttcggaccccacgcctctgcaagtgggagagacccgagcatcctccccacccccatagctccagtgcacgccacccccgtcttgcctgggtcggggcctgcggccagcaccatttcacacacactccttgtagatgggagccagaggaaacctgaacgtgggtggagcgttccactgagtctacttcaggagacagaaggcccatgctgatgggggaggaggagggacgtgggcattttggacaccaggggaaatggaaatgctgctttcaaaacttagtttcctttccatttcttcctagtctggcctttgacacaaatctggtagaaagaagcctgataaattgagggcacttgtaccctccctgtgcccccagaaggttcttggagagaagtgcaagaatttgtgaacacggcggtggagggcgggtggatggccatgggctgggcctccgtatcaggcctgctcaccttgctgggagctttattctgatctcattttgaatgttccagagggagcatcataagagcccagagctccgatttccaaagagtgatattgacatttatggagattggtgttgtaacatattttgataaatactaacttattttgttggggtttggttgtctcttgtcttaggacctggtagttatttgcttgatttttttttccgttattttctacataggcaaagagaattcgagggatagacagtctccaagaaaagtgaagtggtgggagagaattgcttttttcttttttttcttttctctagtttttctttctggctgagatttccgtgcaagacagcacccaatagactatttagagttgacatttgacattttaatgggcgccatggctcattttgtagattgagaaggtgcgtctcccctgctccaagtctcatcatgacagcgtgctgacagctgggagtctgtggccttcctcacgcagaggccttaaagctggacacagaagcacgcctaggctgggcagggatgggacccatgccccctccttagaggacgggcttcctggttaggaaaggacacgtgggggtgccttgcataatagttcactggtcaccgtgcttttatgagtagtgtttttgtgcacttgccaggggttttctctctgtgtgcgaggggagtgatttaagcaatggtgtctggagtaagccttacaattttaatagactttttcttatcatatccctcatttctttccctgaaataaaaatacacacaagcaaaaaaaaaatgatagtttcacatctcttagttcccttgcccaaacaagaatattcttagttccactggccaggattttcctacatagtcagaacttacacattactagaggcacacccaccaaggagtattgtgtctacttttatctgtgcaccagccacaaatacccacattggaaagacccatttgtgatgggtaaacatcccttcctgtctcccacaacccctgtgactgccctgcatgtgttcatgacctccgaaggccctaattcatgaagcagcaaacccagcagatctccacccccctgcctcaggacctctgctgaagagggggatgaagtgggtctccagggaggcagtgggggccttgttggcagctggctcgggagccggcttacaggagggcagctctgcagttgggaggggcaccgtccggaggagaccaggcctctacacaccccccactctacttatcatccctgctcacacacccttgtccaaggctttatgcatcggatttatttttccaaatcaagaggacagtgatagatgcattttccccaggctgtctcagaaaggtcgctaaatgtatactgttgtcagaattgctgagatctccccccacttttggtttttgcagcagtaaaaactctttccactgtgacttattttctctctcaggcagccagccacctggtcccttgtgctgactctagcacagtggccaggatccaatacgagtccaggggtgaccgcaggatggtgggggcagcgggcttctccacctaccccagccaccaaggccctgacgcactgcctcctgcaccttcagcacatccctgtgcacagctggaagggtgcatggcccgctcacctttgttcagatgggtggaaacgctgatgataccagctcctccctgccgtgcccctgccacggagcaggcattgtgaactggctggtgtttgcagtcccacgtggcatggcctccagcccaacccacagtggagactggagacagggcaatgagtctggtcgggggcacgtggacatgccccataggggccccacccagacttaacaggcaaggtcctgggcattgcgcgacgcaggactcaatgctaaagcaagcctgcctggctctgtgccagggcccctcttctgatttacacatcccatttttacacagacccttccttcttaataaaggctgacagttctgttggcagccaagaacccacaccatgaagacagggagtgaggggcctttgtgcccaactccagcacagctgcgttctggggtgtgtgagaggcatgttcgtgtctgtgcgctggtggtctcgtgagacagttccgaggacggggaaattgcagggtggtgggggcgtgaggcttatatgtggaactgatgcagagttcgcctgcagacggatctggatatacactatgtataattgttacgtgtaatttaaaatatatctgtttgccatcgtcatgagaagattatatgtaaggctctgaagggagagggagatgtacattctgccaggctcctgnggaccttatccgagtcatgaaattgatgactgttgatccagtggtgcaagaagctacactccatgtgtcatcacgcttatgactcctaatgtatttttaaggcaaaaaatgtcagccgactccatcttcacccctcgattcctcgagtccagcctttctgtgccagtgcttcactgagccacaacgctctcgccatcgggacccggctgggcctggagtctcggggcacagttgccatggagccctcctgggtcattctacaaatgtgctgagtgccagctgaaaaccccacaggagatggagtaccttggccaagcttaaagagaagattttctcagggtatttattagtgtgtccagcagggtcaggaagcaggatggaaagatgcattcagactgttaatttattaacaaggcaaatgattttgtgtttcttgatgacagactattaagtttgggacttattttcccatttgagaagttataatatatatttaagatgataagtttcctgcttaagttgtgcctttcagcttcaatgagtttaaggagcactaagggtaatgataccaatgagggttggtttattatcaaacctgaatagctgtggtttctccagtaaatattttcttctactgaacatgga

SEQ ID NO: 37745 - DNA, 3657 bp, Homo sapiens
atgcgtttctggccctgacataagctgtctggcctctctgtgacatgatgaaattgaaatcaatccacagtccatgaaattgtgacactccaccagattaagttagggcataacattaacttggaaatggccatgtcatcacccctgcggctgtcctatagctgagatgcgtgggtcgcaggggaggtgatttctaggcatattgctgtcccttttgtgtatctgtcatccggatgcttcggaccccacgcctctgcaagtgggagagacccgagcatcctccccacccccatagctccagtgcacgccacccccgtcttgcctgggtcggggcctgcggccagcaccatttcacacacactccttgtagatgggagccagaggaaacctgaacgtgggtggagcgttccactgagtctacttcaggagacagaaggcccatgctgatgggggaggaggagggacgtgggcattttggacaccaggggaaatggaaatgctgctttcaaaacttagtttcctttccatttcttcctagtctggcctttgacacaaatctggtagaaagaagcctgataaattgagggcacttgtaccctccctgtgcccccagaaggttcttggagagaagtgcaagaatttgtgaacacggcggtggagggcgggtggatggccatgggctgggcctccgtatcaggcctgctcaccttgctgggagctttattctgatctcattttgaatgttccagagggagcatcataagagcccagagctccgatttccaaagagtgatattgacatttatggagattggtgttgtaacatattttgataaatactaacttattttgttggggtttggttgtctcttgtcttaggacctggtagttatttgcttgatttttttttccgttattttctacataggcaaagagaattcgagggatagacagtctccaagaaaagtgaagtggtgggagagaattgcttttttcttttttttcttttctctagtttttctttctggctgagatttccgtgcaagacagcacccaatagactatttagagttgacatttgacattttaatgggcgccatggctcattttgtagattgagaaggtgcgtctcccctgctccaagtctcatcatgacagcgtgctgacagctgggagtctgtggccttcctcacgcagaggccttaaagctggacacagaagcacgcctaggctgggcagggatgggacccatgccccctccttagaggacgggcttcctggttaggaaaggacacgtgggggtgccttgcataatagttcactggtcaccgtgcttttatgagtagtgtttttgtgcacttgccaggggttttctctctgtgtgcgaggggagtgatttaagcaatggtgtctggagtaagccttacaattttaatagactttttcttatcatatccctcatttctttccctgaaataaaaatacacacaagcaaaaaaaaaatgatagtttcacatctcttagttcccttgcccaaacaagaatattcttagttccactggccaggattttcctacatagtcagaacttacacattactagaggcacacccaccaaggagtattgtgtctacttttatctgtgcaccagccacaaatacccacattggaaagacccatttgtgatgggtaaacatcccttcctgtctcccacaacccctgtgactgccctgcatgtgttcatgacctccgaaggccctaattcatgaagcagcaaacccagcagatctccacccccctgcctcaggacctctgctgaagagggggatgaagtgggtctccagggaggcagtgggggccttgttggcagctggctcgggagccggcttacaggagggcagctctgcagttgggaggggcaccgtccggaggagaccaggcctctacacaccccccactctacttatcatccctgctcacacacccttgtccaaggctttatgcatcggatttatttttccaaatcaagaggacagtgatagatgcattttccccaggctgtctcagaaaggtcgctaaatgtatactgttgtcagaattgctgagatctccccccacttttggtttttgcagcagtaaaaactctttccactgtgacttattttctctctcaggcagccagccacctggtcccttgtgctgactctagcacagtggccaggatccaatacgagtccaggggtgaccgcaggatggtgggggcagcgggcttctccacctaccccagccaccaaggccctgacgcactgcctcctgcaccttcagcacatccctgtgcacagctggaagggtgcatggcccgctcacctttgttcagatgggtggaaacgctgatgataccagctcctccctgccgtgcccctgccacggagcaggcattgtgaactggctggtgtttgcagtcccacgtggcatggcctccagcccaacccacagtggagactggagacagggcaatgagtctggtcgggggcacgtggacatgccccataggggccccacccagacttaacaggcaaggtcctgggcattgcgcgacgcaggactcaatgctaaagcaagcctgcctggctctgtgccagggcccctcttctgatttacacatcccatttttacacagacccttccttcttaataaaggctgacagttctgttggcagccaagaacccacaccatgaagacagggagtgaggggcctttgtgcccaactccagcacagctgcgttctggggtgtgtgagaggcatgttcgtgtctgtgcgctggtggtctcgtgagacagttccgaggacggggaaattgcagggtggtgggggcgtgaggcttatatgtggaactgatgcagagttcgcctgcagacggatctggatatacactatgtataattgttacgtgtaatttaaaatatatctgtttgccatcgtcatgagaagattttctcagggtatttattagtgtgtccagcagggtcaggaagcaggatggaaagatgcattcagactgttaatttattaacaaggcaaatgattttgtgtttcttgatgacagactattaagtttgggacttattttcccatttgagaagttataatatatatttaagatgataagtttcctgcttaagttgtgcctttcagcttcaatgagtttaaggagcactaagggtaatgataccaatgagggttggtttattatcaaacctgaatagctgtggtttctccagtaaatattttcttctactgaacatggagccattattaagagttgtgtgttttttattatgtacatttgtatatttttttgcttgtttgatgttctatttttctaatagttttcttttagtttcttaaagttgtgatactagatttagattctgatgctaactgcaaatcaggttggtctctgctgggtctctcctgcttttattttactttaaggacaagtgtagttgtcgtccaccacctttcaaaaaatgtgaaactgccctgcctcccctttttgctgacaacactgtgtacattgaccacttcctaccatactttatgttgtaaaatcaaactcttttgtggtacattatctcatgcttctgcaaattcga

SEQ ID NO: 37746 - DNA, 1494 bp, Homo sapiens
atgcgtttctggccctgacataagctgtctggcctctctgtgacatgatgaaattgaaatcaatccacagtccatgaaattgtgacactccaccagattaagttagggcataacattaacttggaaatggccatgtcatcacccctgcggctgtcctatagctgagatgcgtgggtcgcaggggaggtgatttctaggcatattgctgtcccttttgtgtatctgtcatccggatgcttcggaccccacgcctctgcaagtgggagagacccgagcatcctccccacccccatagctccagtgcacgccacccccgtcttgcctgggtcggggcctgcggccagcaccatttcacacacactccttgtagatgggagccagaggaaacctgaacgtgggtggagcgttccactgagtctacttcaggagacagaaggcccatgctgatgggggaggaggagggacgtgggcattttggacaccaggggaaatggaaatgctgctttcaaaacttagtttcctttccatttcttcctagtctggcctttgacacaaatctggtagaaagaagcctgataaattgagggcacttgtaccctccctgtgcccccagaaggttcttggagagaagtgcaagaatttgtgaacacggcggtggagggcgggtggatggccatgggctgggcctccgtatcaggcctgctcaccttgctgggagctttattctgatctcattttgaatgttccagagggagcatcataagagcccagagctccgatttccaaagagtgatattgacatttatggagattggtgttgtaacatattttgataaatactaacttattttgttggggtttggttgtctcttgtcttaggacctggtagttatttgcttgatttttttttccgttattttctacataggcaaagagaattcgagggatagacagtctccaagaaaagtgaagtggtgggagagaattgcttttttcttttttttcttttctctagtttttctttctggctgagatttccgtgcaagacagcacccaatagactatttagagttgacatttgacattttaatgggcgccatggctcattttgtagattgagaaggtgcgtctcccctgctccaagtctcatcatgacagcgtgctgacagctgggagtctgtggccttcctcacgcagaggccttaaagctggacacagaagcacgcctaggctgggcagggatgggacccatgccccctccttagaggacgggcttcctggttaggaaaggacacgtgggggtgccttgcataatagttcactggtcaccgtgcttttatgagtagtgtttttgtgcacttgccaggggttttctctctgtgtgcgaggggagtgatttaagcaatggtgtctggagtaagccttacaattttaatagactttttcttatcatatccctcatttctttccctgaaataaaaatacacacaagca

SEQ ID NO: 37747 - DNA, 686 bp, Homo sapiens
gccggacgaactcagagtgtcttcctcctccacaaacaatcctgcttatctcctcaggagagaagcaggatggaaagatgcattcagactgttaatttattaacaaggcaaatgattttgtgtttcttgatgacagactattaagtttgggacttattttcccatttgagaagttataatatatatttaagatgataagtttcctgcttaagttgtgcctttcagcttcaatgagtttaaggagcactaagggtaatgataccaatgagggttggtttattatcaaacctgaatagctgtggtttctccagtaaatattttcttctactgaacatggagccattattaagagttgtgtgttttttattatgtacatttgtatatttttttgcttgtttgatgttctatttttctaatagttttcttttagtttcttaaagttgtgatactagatttagattctgatgctaactgcaaatcaggttggtctctgctgggtctctcctgcttttattttactttaaggacaagtgtagttgtcgtccaccacctttcaaaaaatgtgaaactgccctgcctcccctttttgctgacaacactgtgtacattgaccacttcctaccatactttatgttgtaaaatcaaactcttttgtggtacattatctcatgcttctgcaaattcga

SEQ ID NO: 37748 - DNA, 1058 bp, Homo sapiens
  misc_feature (3)..(3): n is a, c, g, or t
  misc_feature (906)..(906): n is a, c, g, or t
  misc_feature (1031)..(1031): n is a, c, g, or t
ganaattaggctaggtacgaggctgggtgttaatcggccgaggcaatgacatccgcgtgctggcacaggagagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagagatctcctgtgaggagcgggccgatctcctgttggggggcgnaagggggggtttgacccccgcggggtttttgggccccgtgtggagggtggtgtggctacacactgcgggcggggggtgcgccgcttatgagcggagatttgcccaccggcggcagggggcggcangggtgtctctcttctcgatgtataggc

SEQ ID NO: 37749 - DNA, 778 bp, Homo sapiens
gtggaaatgaccctgtttttatttccagaattacctctgggtttagagaagtggtttttaaacgagtgtgggtaaaaaaaattacctgaggtacttgtcagaatcgcagacttctaggtcccacccagctctcatcaatcagtttagtgagggtggtgcccaggactctgattttaaacatacccctagaaagattctgatacaggtagaggtgagaagccctggtttagaagcagctcggcctcccttcatggtgggaccagggccagcagggaatgtcagggccacccctgaccttcactgtgactctgctgcagagagggtggcctggaggagatggtggaggagctcaacagcgggaaggtgatgtacgccttctgcagagtgaaggaccccaactctggactgcccaaatttgtcctcatcaactgggtatgtggagcctgtttcatctaggtgtgacccaggaaaccccattgtcttctttcctgttttgacttgacttcaggaacaaagtgttttactggcatgacttagtagatcaatagaacagctctgagctggtgaatgagcagaatagttgacagattcattgtggcccaaagaataactgtggctttgctatgcagaattcaccttccaagcctagagttcttcctgcaaaatggattaaaagcagtcacagggagtccttgctccgtgctcttgagggtggttgttctgatggagtagagagcctgagggagtgtttaggagcctgggagtacagggacagggc

SEQ ID NO: 37750 - DNA, 2858 bp, Homo sapiens
taagggggccgggggggcccgggggcggggcgggcgggtcctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaacaaaaccaaaaatctccgcaggcaacccatataatgcagtacgaggacacaaacaggcacagagaagagcgacaacatgggccacaaaagaggaacccaggaaccaaacatgaacagagaaaaccagagggacaaaacaagcagcagcacacacaaatagagaggaaccgaaacaacaagacacgaaatacacagccgcggatatacaccccgtagcaacaaacatggacttccccggagagagcattcacgcagtactatcgtcgctcgaacacagacatacagaagaatgcaacaaagacaagacaagacaagacgaagaccacgaaagcaaccaagaagctcagaacaagcccgcacagactccgacaacaccagagaacacaaaaacacaacacagagacataaacataaacagtgcaatgaaacaacaactagctatcacttatgcagcagagggaagggcagaggggagactgaaaaagaagagaggcaaagcaggcgggagaagcggtgcggcggtgggcgcagggagagggagagttggcagtggatatacgagaggagaagtgacgaagatagagagaggaagagggagagctagcagacaacacggagaggaaagaaagcgaagtgagaaagaggaaggagagagtcgcgaggaaggggtgaggggggaagagagagaggaccgggcaggcggcggaggcggcgagagagtgagagaa

SEQ ID NO: 37751 - DNA, 3043 bp, Homo sapiens
aggtttgtagcggtgtgatcgtcacttagcactcatttattcgtgtattcatacatttatgcatgtttctttcacagatcaaactgttgagggtccacaaacaggctgaagacctcgtctggagggagactgcagtgaacccaagatcgttcaaataagcgcatcgacataacaagatttagaaaagaataagcacggtgctgtgagagcagctagcgggggctggactgggtccctgcggccaggcttccaagtcgagctgccgtttgggtgggaccagaagacgggctagtctgcgccccaggatccctccctgaggacaaacagaaggccgggtcctcccttctcccgcttgtccttcggcattcgcgggacctgcatgctagaccagctggccggacagctcgctaggacccgcgggtgcggctggcccctgccatttccgcttcctgccgtggggcggggtttccggatgtcggaggcgaggcttgtcggctgtcaaaggggcggcccggccgggcccggaagctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggcctaaaaaaaaaaaaaaaaaaaaaaaaaaaaaaaaaaaaaaaagaaaaaaaaaaaaagaagaaaaaaaaaaaagaagaagaacaaaacaacagaaaaaacaacgaggcgcggcggcggcgcgcgcggccaacatacgatcctccgccacggaggcggcagcccaaagaacacgagcgccccacgccgaaagatatcaagacgacaagcagggagcccaccacacggaggacgggcggcgggggctagatgcaccagaacgacagacgagcggagcggcgggggcgtagccggaatacaaaccgacgggcacggacggaggacgggagaggcagacaaagaggacggcgacaacgagtgagtcgaggaaaaacacgaatgaggaggacaaacgagccacccacagtgcccgtgagggggggagggcggacggagacaacaaagagagcagcgcagggcgacgcccgaag

SEQ ID NO: 37752 - DNA, 3010 bp, Homo sapiens
gtggaaatgaccctgtttttatttccagaattacctctgggtttagagaagtggtttttaaacgagtgtgggtaaaaaaaattacctgaggtacttgtcagaatcgcagacttctaggtcccacccagctctcatcaatcagtttagtgagggtggtgcccaggactctgattttaaacatacccctagaaagattctgatacaggtagaggtgagaagccctggtttagaagcagctcggcctcccttcatggtgggaccagggccagcagggaatgtcagggccacccctgaccttcactgtgactctgctgcagagagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaacaaaaccaaaaatctccgcaggcaacccatataatgcagtacgaggacacaaacaggcacagagaagagcgacaacatgggccacaaaagaggaacccaggaaccaaacatgaacagagaaaaccagagggacaaaacaagcagcagcacacacaaatagagaggaaccgaaacaacaagacacgaaatacacagccgcggatatacaccccgtagcaacaaacatggacttccccggagagagcattcacgcagtactatcgtcgctcgaacacagacatacagaagaatgcaacaaagacaagacaagacaagacgaagaccacgaaagcaaccaagaagctcagaacaagcccgcacagactccgacaacaccagagaacacaaaaacacaacacagagacataaacataaacagtgcaatgaaacaacaactagctatcacttatgcagcagagggaagggcagaggggagactgaaaaagaagagaggcaaagcaggcgggagaagcggtgcggcggtgggcgcagggagagggagagttggcagtggatatacgagaggagaagtgacgaagatagagagaggaagagggagagctagcagacaacacggagaggaaagaaagcgaagtgagaaagaggaaggagagagtcgcgaggaaggggtgaggggggaagagagagaggaccgggcaggcggcggaggcggcgagagagtgagagaa

SEQ ID NO: 37753 - DNA, 3416 bp, Homo sapiens
aggtttgtagcggtgtgatcgtcacttagcactcatttattcgtgtattcatacatttatgcatgtttctttcacagatcaaactgttgagggtccacaaacaggctgaagacctcgtctggagggagactgcagtgaacccaagatcgttcaaataagcgcatcgacataacaagatttagaaaagaataagcacggtgctgtgagagcagctagcgggggctggactgggtccctgcggccaggcttccaagtcgagctgccgtttgggtgggaccagaagacgggctagtctgcgccccaggatccctccctgaggacaaacagaaggccgggtcctcccttctcccgcttgtccttcggcattcgcgggacctgcatgctagaccagctggccggacagctcgctaggacccgcgggtgcggctggcccctgccatttccgcttcctgccgtggggcggggtttccggatgtcggaggcgaggcttgtcggctgtcaaaggggcggcccggccgggcccggaagctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggggtcaacatgtgcttccctccaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaacaaaaccaaaaatctccgcaggcaacccatataatgcagtacgaggacacaaacaggcacagagaagagcgacaacatgggccacaaaagaggaacccaggaaccaaacatgaacagagaaaaccagagggacaaaacaagcagcagcacacacaaatagagaggaaccgaaacaacaagacacgaaatacacagccgcggatatacaccccgtagcaacaaacatggacttccccggagagagcattcacgcagtactatcgtcgctcgaacacagacatacagaagaatgcaacaaagacaagacaagacaagacgaagaccacgaaagcaaccaagaagctcagaacaagcccgcacagactccgacaacaccagagaacacaaaaacacaacacagagacataaacataaacagtgcaatgaaacaacaactagctatcacttatgcagcagagggaagggcagaggggagactgaaaaagaagagaggcaaagcaggcgggagaagcggtgcggcggtgggcgcagggagagggagagttggcagtggatatacgagaggagaagtgacgaagatagagagaggaagagggagagctagcagacaacacggagaggaaagaaagcgaagtgagaaagaggaaggagagagtcgcgaggaaggggtgaggggggaagagagagaggaccgggcaggcggcggaggcggcgagagagtgagagaa

SEQ ID NO: 37754 - DNA, 2398 bp, Homo sapiens
  misc_feature (2383)..(2383): n is a, c, g, or t
aggtttgtagcggtgtgatcgtcacttagcactcatttattcgtgtattcatacatttatgcatgtttctttcacagatcaaactgttgagggtccacaaacaggctgaagacctcgtctggagggagactgcagtgaacccaagatcgttcaaataagcgcatcgacataacaagatttagaaaagaataagcacggtgctgtgagagcagctagcgggggctggactgggtccctgcggccaggcttccaagtcgagctgccgtttgggtgggaccagaagacgggctagtctgcgccccaggatccctccctgaggacaaacagaaggccgggtcctcccttctcccgcttgtccttcggcattcgcgggacctgcatgctagaccagctggccggacagctcgctaggacccgcgggtgcggctggcccctgccatttccgcttcctgccgtggggcggggtttccggatgtcggaggcgaggcttgtcggctgtcaaaggggcggcccggccgggcccggaagctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttttgagtgaatgggatcctntagatcaccgcgcag

SEQ ID NO: 37755 - DNA, 2601 bp, Homo sapiens
ggctggtaccggccggaagtcttacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaacaaaaccaaaaatctccgcaggcaacccatataatgcagtacgaggacacaaacaggcacagagaagagcgacaacatgggccacaaaagaggaacccaggaaccaaacatgaacagagaaaaccagagggacaaaacaagcagcagcacacacaaatagagaggaaccgaaacaacaagacacgaaatacacagccgcggatatacaccccgtagcaacaaacatggacttccccggagagagcattcacgcagtactatcgtcgctcgaacacagacatacagaagaatgcaacaaagacaagacaagacaagacgaagaccacgaaagcaaccaagaagctcagaacaagcccgcacagactccgacaacaccagagaacacaaaaacacaacacagagacataaacataaacagtgcaatgaaacaacaactagctatcacttatgcagcagagggaagggcagaggggagactgaaaaagaagagaggcaaagcaggcgggagaagcggtgcggcggtgggcgcagggagagggagagttggcagtggatatacgagaggagaagtgacgaagatagagagaggaagagggagagctagcagacaacacggagaggaaagaaagcgaagtgagaaagaggaaggagagagtcgcgaggaaggggtgaggggggaagagagagaggaccgggcaggcggcggaggcggcgagagagtgagagaa

SEQ ID NO: 37756 - DNA, 3296 bp, Homo sapiens
aggtttgtagcggtgtgatcgtcacttagcactcatttattcgtgtattcatacatttatgcatgtttctttcacagatcaaactgttgagggtccacaaacaggctgaagacctcgtctggagggagactgcagtgaacccaagatcgttcaaataagcgcatcgacataacaagatttagaaaagaataagcacggtgctgtgagagcagctagcgggggctggactgggtccctgcggccaggcttccaagtcgagctgccgtttgggtgggaccagaagacgggctagtctgcgccccaggatccctccctgaggacaaacagaaggccgggtcctcccttctcccgcttgtccttcggcattcgcgggacctgcatgctagaccagctggccggacagctcgctaggacccgcgggtgcggctggcccctgccatttccgcttcctgccgtggggcggggtttccggatgtcggaggcgaggcttgtcggctgtcaaaggggcggcccggccgggcccggaagctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctgatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaacaaaaccaaaaatctccgcaggcaacccatataatgcagtacgaggacacaaacaggcacagagaagagcgacaacatgggccacaaaagaggaacccaggaaccaaacatgaacagagaaaaccagagggacaaaacaagcagcagcacacacaaatagagaggaaccgaaacaacaagacacgaaatacacagccgcggatatacaccccgtagcaacaaacatggacttccccggagagagcattcacgcagtactatcgtcgctcgaacacagacatacagaagaatgcaacaaagacaagacaagacaagacgaagaccacgaaagcaaccaagaagctcagaacaagcccgcacagactccgacaacaccagagaacacaaaaacacaacacagagacataaacataaacagtgcaatgaaacaacaactagctatcacttatgcagcagagggaagggcagaggggagactgaaaaagaagagaggcaaagcaggcgggagaagcggtgcggcggtgggcgcagggagagggagagttggcagtggatatacgagaggagaagtgacgaagatagagagaggaagagggagagctagcagacaacacggagaggaaagaaagcgaagtgagaaagaggaaggagagagtcgcgaggaaggggtgaggggggaagagagagaggaccgggcaggcggcggaggcggcgagagagtgagagaa

SEQ ID NO: 37757 - DNA, 2092 bp, Homo sapiens
aggtttgtagcggtgtgatcgtcacttagcactcatttattcgtgtattcatacatttatgcatgtttctttcacagatcaaactgttgagggtccacaaacaggctgaagacctcgtctggagggagactgcagtgaacccaagatcgttcaaataagcgcatcgacataacaagatttagaaaagaataagcacggtgctgtgagagcagctagcgggggctggactgggtccctgcggccaggcttccaagtcgagctgccgtttgggtgggaccagaagacgggctagtctgcgccccaggatccctccctgaggacaaacagaaggccgggtcctcccttctcccgcttgtccttcggcattcgcgggacctgcatgctagaccagctggccggacagctcgctaggacccgcgggtgcggctggcccctgccatttccgcttcctgccgtggggcggggtttccggatgtcggaggcgaggcttgtcggctgtcaaaggggcggcccggccgggcccggaagctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccaccaccccttagaagcagagaaaaagaaaaaggcaaataaatgcagaa

SEQ ID NO: 37758 - DNA, 2832 bp, Homo sapiens
  misc_feature (44)..(44): n is a, c, g, or t
  misc_feature (106)..(106): n is a, c, g, or t
  misc_feature (126)..(126): n is a, c, g, or t
  misc_feature (129)..(129): n is a, c, g, or t
  misc_feature (132)..(132): n is a, c, g, or t
  misc_feature (138)..(141): n is a, c, g, or t
  misc_feature (144)..(145): n is a, c, g, or t
  misc_feature (147)..(148): n is a, c, g, or t
  misc_feature (152)..(152): n is a, c, g, or t
  misc_feature (155)..(156): n is a, c, g, or t
  misc_feature (158)..(158): n is a, c, g, or t
  misc_feature (161)..(162): n is a, c, g, or t
  misc_feature (164)..(165): n is a, c, g, or t
  misc_feature (168)..(168): n is a, c, g, or t
  misc_feature (180)..(182): n is a, c, g, or t
  misc_feature (185)..(186): n is a, c, g, or t
  misc_feature (188)..(188): n is a, c, g, or t
  misc_feature (195)..(195): n is a, c, g, or t
  misc_feature (213)..(213): n is a, c, g, or t
  misc_feature (226)..(226): n is a, c, g, or t
  misc_feature (254)..(254): n is a, c, g, or t
  misc_feature (261)..(261): n is a, c, g, or t
  misc_feature (276)..(276): n is a, c, g, or t
  misc_feature (278)..(278): n is a, c, g, or t
  misc_feature (285)..(286): n is a, c, g, or t
  misc_feature (294)..(294): n is a, c, g, or t
  misc_feature (315)..(315): n is a, c, g, or t
  misc_feature (330)..(332): n is a, c, g, or t
  misc_feature (355)..(357): n is a, c, g, or t
  misc_feature (360)..(360): n is a, c, g, or t
  misc_feature (363)..(363): n is a, c, g, or t
  misc_feature (396)..(396): n is a, c, g, or t
  misc_feature (399)..(399): n is a, c, g, or t
  misc_feature (405)..(405): n is a, c, g, or t
  misc_feature (412)..(412): n is a, c, g, or t
  misc_feature (459)..(459): n is a, c, g, or t
  misc_feature (506)..(506): n is a, c, g, or t
ccatttcttctaaccttatccttaacttccatctcttcaatatncctacttatctttttttcaccgataattcccctacctacttttctctctttacctattaatncaacagcaattacatcctcnttnctngcacannnnatnntnncctntannanatnntnnatnagctcaacagcnnnaanntnatttacnccttcttcataattaagnaccccaactcttnacttcccaaatttttcctcatcaacttnacatgcnatggcttaaacaatntncggaatnnaacctttnccatccacgtcaacaccattnccatcttccttaagnnngcccattttaccatcaactcacnnnccnatnattatttttatccttaattcatcatttataaanttnccaatncttcatnttccaactacatctttcacaattatattttcctcttccattacattngaccccaaaccccatttttctctttttaccaaaaaaccaattccttntcttatattaaaattttttttaaaaacaacttctgggccaaatcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaacaaaaccaaaaatctccgcaggcaacccatataatgcagtacgaggacacaaacaggcacagagaagagcgacaacatgggccacaaaagaggaacccaggaaccaaacatgaacagagaaaaccagagggacaaaacaagcagcagcacacacaaatagagaggaaccgaaacaacaagacacgaaatacacagccgcggatatacaccccgtagcaacaaacatggacttccccggagagagcattcacgcagtactatcgtcgctcgaacacagacatacagaagaatgcaacaaagacaagacaagacaagacgaagaccacgaaagcaaccaagaagctcagaacaagcccgcacagactccgacaacaccagagaacacaaaaacacaacacagagacataaacataaacagtgcaatgaaacaacaactagctatcacttatgcagcagagggaagggcagaggggagactgaaaaagaagagaggcaaagcaggcgggagaagcggtgcggcggtgggcgcagggagagggagagttggcagtggatatacgagaggagaagtgacgaagatagagagaggaagagggagagctagcagacaacacggagaggaaagaaagcgaagtgagaaagaggaaggagagagtcgcgaggaaggggtgaggggggaagagagagaggaccgggcaggcggcggaggcggcgagagagtgagagaa

SEQ ID NO: 37759 - DNA, 2292 bp, Homo sapiens
ggctcccacttggttgcaagtgtagacaccgccttgctctggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaacaaaaccaaaaatctccgcaggcaacccatataatgcagtacgaggacacaaacaggcacagagaagagcgacaacatgggccacaaaagaggaacccaggaaccaaacatgaacagagaaaaccagagggacaaaacaagcagcagcacacacaaatagagaggaaccgaaacaacaagacacgaaatacacagccgcggatatacaccccgtagcaacaaacatggacttccccggagagagcattcacgcagtactatcgtcgctcgaacacagacatacagaagaatgcaacaaagacaagacaagacaagacgaagaccacgaaagcaaccaagaagctcagaacaagcccgcacagactccgacaacaccagagaacacaaaaacacaacacagagacataaacataaacagtgcaatgaaacaacaactagctatcacttatgcagcagagggaagggcagaggggagactgaaaaagaagagaggcaaagcaggcgggagaagcggtgcggcggtgggcgcagggagagggagagttggcagtggatatacgagaggagaagtgacgaagatagagagaggaagagggagagctagcagacaacacggagaggaaagaaagcgaagtgagaaagaggaaggagagagtcgcgaggaaggggtgaggggggaagagagagaggaccgggcaggcggcggaggcggcgagagagtgagagaa

SEQ ID NO: 37760 - DNA, 2375 bp, Homo sapiens
cggaccgcgtgggctttttatctgatctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggggtcaacatgtgcttccctccaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaacaaaaccaaaaatctccgcaggcaacccatataatgcagtacgaggacacaaacaggcacagagaagagcgacaacatgggccacaaaagaggaacccaggaaccaaacatgaacagagaaaaccagagggacaaaacaagcagcagcacacacaaatagagaggaaccgaaacaacaagacacgaaatacacagccgcggatatacaccccgtagcaacaaacatggacttccccggagagagcattcacgcagtactatcgtcgctcgaacacagacatacagaagaatgcaacaaagacaagacaagacaagacgaagaccacgaaagcaaccaagaagctcagaacaagcccgcacagactccgacaacaccagagaacacaaaaacacaacacagagacataaacataaacagtgcaatgaaacaacaactagctatcacttatgcagcagagggaagggcagaggggagactgaaaaagaagagaggcaaagcaggcgggagaagcggtgcggcggtgggcgcagggagagggagagttggcagtggatatacgagaggagaagtgacgaagatagagagaggaagagggagagctagcagacaacacggagaggaaagaaagcgaagtgagaaagaggaaggagagagtcgcgaggaaggggtgaggggggaagagagagaggaccgggcaggcggcggaggcggcgagagagtgagagaa

SEQ ID NO: 37761 - DNA, 1688 bp, Homo sapiens
  misc_feature (1536)..(1536): n is a, c, g, or t
  misc_feature (1661)..(1661): n is a, c, g, or t
aggtttgtagcggtgtgatcgtcacttagcactcatttattcgtgtattcatacatttatgcatgtttctttcacagatcaaactgttgagggtccacaaacaggctgaagacctcgtctggagggagactgcagtgaacccaagatcgttcaaataagcgcatcgacataacaagatttagaaaagaataagcacggtgctgtgagagcagctagcgggggctggactgggtccctgcggccaggcttccaagtcgagctgccgtttgggtgggaccagaagacgggctagtctgcgccccaggatccctccctgaggacaaacagaaggccgggtcctcccttctcccgcttgtccttcggcattcgcgggacctgcatgctagaccagctggccggacagctcgctaggacccgcgggtgcggctggcccctgccatttccgcttcctgccgtggggcggggtttccggatgtcggaggcgaggcttgtcggctgtcaaaggggcggcccggccgggcccggaagctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagagatctcctgtgaggagcgggccgatctcctgttggggggcgnaagggggggtttgacccccgcggggtttttgggccccgtgtggagggtggtgtggctacacactgcgggcggggggtgcgccgcttatgagcggagatttgcccaccggcggcagggggcggcangggtgtctctcttctcgatgtataggc

SEQ ID NO: 37762 - DNA, 1652 bp, Homo sapiens
atatgagtctagcaagccggagagagcctgaggcctcatcctcaccggggcagtttatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaacaaaaccaaaaatctccgcaggcaacccatataatgcagtacgaggacacaaacaggcacagagaagagcgacaacatgggccacaaaagaggaacccaggaaccaaacatgaacagagaaaaccagagggacaaaacaagcagcagcacacacaaatagagaggaaccgaaacaacaagacacgaaatacacagccgcggatatacaccccgtagcaacaaacatggacttccccggagagagcattcacgcagtactatcgtcgctcgaacacagacatacagaagaatgcaacaaagacaagacaagacaagacgaagaccacgaaagcaaccaagaagctcagaacaagcccgcacagactccgacaacaccagagaacacaaaaacacaacacagagacataaacataaacagtgcaatgaaacaacaactagctatcacttatgcagcagagggaagggcagaggggagactgaaaaagaagagaggcaaagcaggcgggagaagcggtgcggcggtgggcgcagggagagggagagttggcagtggatatacgagaggagaagtgacgaagatagagagaggaagagggagagctagcagacaacacggagaggaaagaaagcgaagtgagaaagaggaaggagagagtcgcgaggaaggggtgaggggggaagagagagaggaccgggcaggcggcggaggcggcgagagagtgagagaa

SEQ ID NO: 37763 - DNA, 1497 bp, Homo sapiens
actgcatcagaaaggccattgctgcatttggttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaacaaaaccaaaaatctccgcaggcaacccatataatgcagtacgaggacacaaacaggcacagagaagagcgacaacatgggccacaaaagaggaacccaggaaccaaacatgaacagagaaaaccagagggacaaaacaagcagcagcacacacaaatagagaggaaccgaaacaacaagacacgaaatacacagccgcggatatacaccccgtagcaacaaacatggacttccccggagagagcattcacgcagtactatcgtcgctcgaacacagacatacagaagaatgcaacaaagacaagacaagacaagacgaagaccacgaaagcaaccaagaagctcagaacaagcccgcacagactccgacaacaccagagaacacaaaaacacaacacagagacataaacataaacagtgcaatgaaacaacaactagctatcacttatgcagcagagggaagggcagaggggagactgaaaaagaagagaggcaaagcaggcgggagaagcggtgcggcggtgggcgcagggagagggagagttggcagtggatatacgagaggagaagtgacgaagatagagagaggaagagggagagctagcagacaacacggagaggaaagaaagcgaagtgagaaagaggaaggagagagtcgcgaggaaggggtgaggggggaagagagagaggaccgggcaggcggcggaggcggcgagagagtgagagaa

SEQ ID NO: 37764 - DNA, 1468 bp, Homo sapiens
gctggtaccgaccggagtgtaaggatccaggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaacaaaaccaaaaatctccgcaggcaacccatataatgcagtacgaggacacaaacaggcacagagaagagcgacaacatgggccacaaaagaggaacccaggaaccaaacatgaacagagaaaaccagagggacaaaacaagcagcagcacacacaaatagagaggaaccgaaacaacaagacacgaaatacacagccgcggatatacaccccgtagcaacaaacatggacttccccggagagagcattcacgcagtactatcgtcgctcgaacacagacatacagaagaatgcaacaaagacaagacaagacaagacgaagaccacgaaagcaaccaagaagctcagaacaagcccgcacagactccgacaacaccagagaacacaaaaacacaacacagagacataaacataaacagtgcaatgaaacaacaactagctatcacttatgcagcagagggaagggcagaggggagactgaaaaagaagagaggcaaagcaggcgggagaagcggtgcggcggtgggcgcagggagagggagagttggcagtggatatacgagaggagaagtgacgaagatagagagaggaagagggagagctagcagacaacacggagaggaaagaaagcgaagtgagaaagaggaaggagagagtcgcgaggaaggggtgaggggggaagagagagaggaccgggcaggcggcggaggcggcgagagagtgagagaa

SEQ ID NO: 37765 - DNA, 1162 bp, Homo sapiens
aggtttgtagcggtgtgatcgtcacttagcactcatttattcgtgtattcatacatttatgcatgtttctttcacagatcaaactgttgagggtccacaaacaggctgaagacctcgtctggagggagactgcagtgaacccaagatcgttcaaataagcgcatcgacataacaagatttagaaaagaataagcacggtgctgtgagagcagctagcgggggctggactgggtccctgcggccaggcttccaagtcgagctgccgtttgggtgggaccagaagacgggctagtctgcgccccaggatccctccctgaggacaaacagaaggccgggtcctcccttctcccgcttgtccttcggcattcgcgggacctgcatgctagaccagctggccggacagctcgctaggacccgcgggtgcggctggcccctgccatttccgcttcctgccgtggggcggggtttccggatgtcggaggcgaggcttgtcggctgtcaaaggggcggcccggccgggcccggaagctacagcagcggcgcggagactgcggggcgggccatggcggcgaacctgagccggaacgggccagcgctgcaagaggcctacgtgcgggtggtcaccgagaagtccccgaccgactgagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagatggtcacactgaggctcgggtaagttaagccacaaggctaatgatcgactggctctggtgcccgtctttggccatgtgcctaaaactcagtcctgggcagggg

SEQ ID NO: 37766 - DNA, 1514 bp, Homo sapiens
gtggaaatgaccctgtttttatttccagaattacctctgggtttagagaagtggtttttaaacgagtgtgggtaaaaaaaattacctgaggtacttgtcagaatcgcagacttctaggtcccacccagctctcatcaatcagtttagtgagggtggtgcccaggactctgattttaaacatacccctagaaagattctgatacaggtagaggtgagaagccctggtttagaagcagctcggcctcccttcatggtgggaccagggccagcagggaatgtcagggccacccctgaccttcactgtgactctgctgcagagagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaacaaaaccaaaaatctccgcaggcaacccatataatgcagtacgaggacacaaacaggcacagagaagagcgacaacatgggccacaaaagaggaacccaggaaccaaacatgaacagagaaaaccagagggacaaaacaagcagcagcacacacaaatagagaggaaccgaaacaacaagacacgaaatacacagccgcggatatacaccccgtagcaacaaacatggacttccccggagagagcattcacgcagtactatcgtcgctcgaacacagacatacagaagaatgcaacaaagacaagacaagacaagacgaagaccacgaaagcaaccaagaagctcagaacaagcccgcacagactccgacaacaccagagaacacaaaaacacaacacagagacataaacataaacagtgcaatgaaacaacaactagctatcacttatgcagcagagggaagggcagaggggagactgaaaaagaagagaggcaaagcaggcgggagaagcggtgcggcggtgggcgcagggagagggagagttggcagtggatatacgagaggagaagtgacgaagatagagagaggaagagggagagctagcagacaacacggagaggaaagaaagcgaagtgagaaagaggaaggagagagtcgcgaggaaggggtgaggggggaagagagagaggaccgggcaggcggcggaggcggcgagagagtgagagaa

SEQ ID NO: 37767 - DNA, 1205 bp, Homo sapiens
aggtttgtagcggtgtgatcgtcacttagcactcatttattcgtgtattcatacatttatgcatgtttctttcacagatcaaactgttgagggtccacaaacaggctgaagacctcgtctggagggagactgcagtgaacccaagatcgttcaaataagcgcatcgacataacaagatttagaaaagaataagcacggtgctgtgagagcagctagcgggggctggactgggtccctgcggccaggcttccaagtcgagctgccgtttgggtgggaccagaagacgggctagtctgcgccccaggatccctccctgaggacaaacagaaggccgggtcctcccttctcccgcttgtccttcggcattcgcgggacctgcatgctagaccagctggccggacagctcgctaggacccgcgggtgcggctggcccctgccatttccgcttcctgccgtggggcggggtttccggatgtcggaggcgaggcttgtcggctgtcaaaggggcggcccggccgggcccggaagctacagcagcggcgcggagactgcggggcgggccatggcggcgaacctgagccggaacgggccagcgctgcaagaggcctacgtgcgggtggtcaccgagaagtccccgaccgactggtgggcggcgagacgggccagggtcgggccagggctgcctcagggggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactgggtatgtggagcctgtttcatctaggtgtgacccaggaaaccccattgtcttctttcctgttttgacttgacttcaggaacaaagtgttttactggcatgacttagtagatcaatagaacagctctgagctggtgaatgagcagaatagttgacagattcattgtggcccaaagaataactgtggctttgctatgcagaattcaccttccaagcctagagttcttcctgcaaaatggattaaaagcagtcacagggagtccttgctccgtgctcttgagggtggttgttctgatggagtagagagcctgagggagtgtttaggagcctgggagtacagggacagggc

SEQ ID NO: 37768 - DNA, 337 bp, Homo sapiens
atgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaaattcccagtttggtctacacaggctcgcagctctcacctgtcctgctgtagcctgaatgctcccatgtgggaatagcaccccaccacctgcccagtgtctgcctctgctccgtgtctggggtgagcaccctcaccctgagactgtggctgatgatgatcagccaccaggaagaggctaaatgttaagatggga

SEQ ID NO: 37769 - DNA, 3392 bp, Homo sapiens
aggtttgtagcggtgtgatcgtcacttagcactcatttattcgtgtattcatacatttatgcatgtttctttcacagatcaaactgttgagggtccacaaacaggctgaagacctcgtctggagggagactgcagtgaacccaagatcgttcaaataagcgcatcgacataacaagatttagaaaagaataagcacggtgctgtgagagcagctagcgggggctggactgggtccctgcggccaggcttccaagtcgagctgccgtttgggtgggaccagaagacgggctagtctgcgccccaggatccctccctgaggacaaacagaaggccgggtcctcccttctcccgcttgtccttcggcattcgcgggacctgcatgctagaccagctggccggacagctcgctaggacccgcgggtgcggctggcccctgccatttccgcttcctgccgtggggcggggtttccggatgtcggaggcgaggcttgtcggctgtcaaaggggcggcccggccgggcccggaagctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaacaaaaccaaaaatctccgcaggcaacccatataatgcagtacgaggacacaaacaggcacagagaagagcgacaacatgggccacaaaagaggaacccaggaaccaaacatgaacagagaaaaccagagggacaaaacaagcagcagcacacacaaatagagaggaaccgaaacaacaagacacgaaatacacagccgcggatatacaccccgtagcaacaaacatggacttccccggagagagcattcacgcagtactatcgtcgctcgaacacagacatacagaagaatgcaacaaagacaagacaagacaagacgaagaccacgaaagcaaccaagaagctcagaacaagcccgcacagactccgacaacaccagagaacacaaaaacacaacacagagacataaacataaacagtgcaatgaaacaacaactagctatcacttatgcagcagagggaagggcagaggggagactgaaaaagaagagaggcaaagcaggcgggagaagcggtgcggcggtgggcgcagggagagggagagttggcagtggatatacgagaggagaagtgacgaagatagagagaggaagagggagagctagcagacaacacggagaggaaagaaagcgaagtgagaaagaggaaggagagagtcgcgaggaaggggtgaggggggaagagagagaggaccgggcaggcggcggaggcggcgagagagtgagagaa

SEQ ID NO: 37770 - DNA, 3120 bp, Homo sapiens
aggtttgtagcggtgtgatcgtcacttagcactcatttattcgtgtattcatacatttatgcatgtttctttcacagatcaaactgttgagggtccacaaacaggctgaagacctcgtctggagggagactgcagtgaacccaagatcgttcaaataagcgcatcgacataacaagatttagaaaagaataagcacggtgctgtgagagcagctagcgggggctggactgggtccctgcggccaggcttccaagtcgagctgccgtttgggtgggaccagaagacgggctagtctgcgccccaggatccctccctgaggacaaacagaaggccgggtcctcccttctcccgcttgtccttcggcattcgcgggacctgcatgctagaccagctggccggacagctcgctaggacccgcgggtgcggctggcccctgccatttccgcttcctgccgtggggcggggtttccggatgtcggaggcgaggcttgtcggctgtcaaaggggcggcccggccgggcccggaagctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaaaaaaaaaaaaaaaaaaaaaaaaaaaaaaaaagaaaaaaaaaaaaagaagaaaaaaaaaaaagaagaagaacaaaacaacagaaaaaacaacgaggcgcggcggcggcgcgcgcggccaacatacgatcctccgccacggaggcggcagcccaaagaacacgagcgccccacgccgaaagatatcaagacgacaagcagggagcccaccacacggaggacgggcggcgggggctagatgcaccagaacgacagacgagcggagcggcgggggcgtagccggaatacaaaccgacgggcacggacggaggacgggagaggcagacaaagaggacggcgacaacgagtgagtcgaggaaaaacacgaatgaggaggacaaacgagccacccacagtgcccgtgagggggggagggcggacggagacaacaaagagagcagcgcagggcgacgcccgaag

SEQ ID NO: 37771 - DNA, 3437 bp, Homo sapiens
aggtttgtagcggtgtgatcgtcacttagcactcatttattcgtgtattcatacatttatgcatgtttctttcacagatcaaactgttgagggtccacaaacaggctgaagacctcgtctggagggagactgcagtgaacccaagatcgttcaaataagcgcatcgacataacaagatttagaaaagaataagcacggtgctgtgagagcagctagcgggggctggactgggtccctgcggccaggcttccaagtcgagctgccgtttgggtgggaccagaagacgggctagtctgcgccccaggatccctccctgaggacaaacagaaggccgggtcctcccttctcccgcttgtccttcggcattcgcgggacctgcatgctagaccagctggccggacagctcgctaggacccgcgggtgcggctggcccctgccatttccgcttcctgccgtggggcggggtttccggatgtcggaggcgaggcttgtcggctgtcaaaggggcggcccggccgggcccggaagctacagcagcggcgcggagactgcggggcgggccatggcggcgaacctgagccggaacgggccagcgctgcaagaggcctacgtgcgggtggtcaccgagaagtccccgaccgactggtgggcggcgagacgggccagggtcgggccagggctgcctcagggggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaacaaaaccaaaaatctccgcaggcaacccatataatgcagtacgaggacacaaacaggcacagagaagagcgacaacatgggccacaaaagaggaacccaggaaccaaacatgaacagagaaaaccagagggacaaaacaagcagcagcacacacaaatagagaggaaccgaaacaacaagacacgaaatacacagccgcggatatacaccccgtagcaacaaacatggacttccccggagagagcattcacgcagtactatcgtcgctcgaacacagacatacagaagaatgcaacaaagacaagacaagacaagacgaagaccacgaaagcaaccaagaagctcagaacaagcccgcacagactccgacaacaccagagaacacaaaaacacaacacagagacataaacataaacagtgcaatgaaacaacaactagctatcacttatgcagcagagggaagggcagaggggagactgaaaaagaagagaggcaaagcaggcgggagaagcggtgcggcggtgggcgcagggagagggagagttggcagtggatatacgagaggagaagtgacgaagatagagagaggaagagggagagctagcagacaacacggagaggaaagaaagcgaagtgagaaagaggaaggagagagtcgcgaggaaggggtgaggggggaagagagagaggaccgggcaggcggcggaggcggcgagagagtgagagaa

SEQ ID NO: 37772 - DNA, 2722 bp, Homo sapiens
  misc_feature (3)..(3): n is a, c, g, or t
ganaattaggctaggtacgaggctgggtgttagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaacaaaaccaaaaatctccgcaggcaacccatataatgcagtacgaggacacaaacaggcacagagaagagcgacaacatgggccacaaaagaggaacccaggaaccaaacatgaacagagaaaaccagagggacaaaacaagcagcagcacacacaaatagagaggaaccgaaacaacaagacacgaaatacacagccgcggatatacaccccgtagcaacaaacatggacttccccggagagagcattcacgcagtactatcgtcgctcgaacacagacatacagaagaatgcaacaaagacaagacaagacaagacgaagaccacgaaagcaaccaagaagctcagaacaagcccgcacagactccgacaacaccagagaacacaaaaacacaacacagagacataaacataaacagtgcaatgaaacaacaactagctatcacttatgcagcagagggaagggcagaggggagactgaaaaagaagagaggcaaagcaggcgggagaagcggtgcggcggtgggcgcagggagagggagagttggcagtggatatacgagaggagaagtgacgaagatagagagaggaagagggagagctagcagacaacacggagaggaaagaaagcgaagtgagaaagaggaaggagagagtcgcgaggaaggggtgaggggggaagagagagaggaccgggcaggcggcggaggcggcgagagagtgagagaa

SEQ ID NO: 37773 - DNA, 3205 bp, Homo sapiens
aggtttgtagcggtgtgatcgtcacttagcactcatttattcgtgtattcatacatttatgcatgtttctttcacagatcaaactgttgagggtccacaaacaggctgaagacctcgtctggagggagactgcagtgaacccaagatcgttcaaataagcgcatcgacataacaagatttagaaaagaataagcacggtgctgtgagagcagctagcgggggctggactgggtccctgcggccaggcttccaagtcgagctgccgtttgggtgggaccagaagacgggctagtctgcgccccaggatccctccctgaggacaaacagaaggccgggtcctcccttctcccgcttgtccttcggcattcgcgggacctgcatgctagaccagctggccggacagctcgctaggacccgcgggtgcggctggcccctgccatttccgcttcctgccgtggggcggggtttccggatgtcggaggcgaggcttgtcggctgtcaaaggggcggcccggccgggcccggaagctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacaccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaacaaaaccaaaaatctccgcaggcaacccatataatgcagtacgaggacacaaacaggcacagagaagagcgacaacatgggccacaaaagaggaacccaggaaccaaacatgaacagagaaaaccagagggacaaaacaagcagcagcacacacaaatagagaggaaccgaaacaacaagacacgaaatacacagccgcggatatacaccccgtagcaacaaacatggacttccccggagagagcattcacgcagtactatcgtcgctcgaacacagacatacagaagaatgcaacaaagacaagacaagacaagacgaagaccacgaaagcaaccaagaagctcagaacaagcccgcacagactccgacaacaccagagaacacaaaaacacaacacagagacataaacataaacagtgcaatgaaacaacaactagctatcacttatgcagcagagggaagggcagaggggagactgaaaaagaagagaggcaaagcaggcgggagaagcggtgcggcggtgggcgcagggagagggagagttggcagtggatatacgagaggagaagtgacgaagatagagagaggaagagggagagctagcagacaacacggagaggaaagaaagcgaagtgagaaagaggaaggagagagtcgcgaggaaggggtgaggggggaagagagagaggaccgggcaggcggcggaggcggcgagagagtgagagaa

SEQ ID NO: 37774 - DNA, 2557 bp, Homo sapiens
ctaagtacaggccggtgttaatcggccgaagggcaccatcgcagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaacaaaaccaaaaatctccgcaggcaacccatataatgcagtacgaggacacaaacaggcacagagaagagcgacaacatgggccacaaaagaggaacccaggaaccaaacatgaacagagaaaaccagagggacaaaacaagcagcagcacacacaaatagagaggaaccgaaacaacaagacacgaaatacacagccgcggatatacaccccgtagcaacaaacatggacttccccggagagagcattcacgcagtactatcgtcgctcgaacacagacatacagaagaatgcaacaaagacaagacaagacaagacgaagaccacgaaagcaaccaagaagctcagaacaagcccgcacagactccgacaacaccagagaacacaaaaacacaacacagagacataaacataaacagtgcaatgaaacaacaactagctatcacttatgcagcagagggaagggcagaggggagactgaaaaagaagagaggcaaagcaggcgggagaagcggtgcggcggtgggcgcagggagagggagagttggcagtggatatacgagaggagaagtgacgaagatagagagaggaagagggagagctagcagacaacacggagaggaaagaaagcgaagtgagaaagaggaaggagagagtcgcgaggaaggggtgaggggggaagagagagaggaccgggcaggcggcggaggcggcgagagagtgagagaa

SEQ ID NO: 37775 - DNA, 2422 bp, Homo sapiens
aggtttgtagcggtgtgatcgtcacttagcactcatttattcgtgtattcatacatttatgcatgtttctttcacagatcaaactgttgagggtccacaaacaggctgaagacctcgtctggagggagactgcagtgaacccaagatcgttcaaataagcgcatcgacataacaagatttagaaaagaataagcacggtgctgtgagagcagctagcgggggctggactgggtccctgcggccaggcttccaagtcgagctgccgtttgggtgggaccagaagacgggctagtctgcgccccaggatccctccctgaggacaaacagaaggccgggtcctcccttctcccgcttgtccttcggcattcgcgggacctgcatgctagaccagctggccggacagctcgctaggacccgcgggtgcggctggcccctgccatttccgcttcctgccgtggggcggggtttccggatgtcggaggcgaggcttgtcggctgtcaaaggggcggcccggccgggcccggaagctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccctgttatattgccctgggaccgtggcgtgcgattggttgacgaggtggccagcgcggtgctacggggtggcggggattgtggggggggtgggccccccctttttctcgggtggtggtgagggaccccctgttcgggacgtgtccggaaaagggcgatcgggggggt

SEQ ID NO: 37776 - DNA, 2448 bp, Homo sapiens
tagctagtacgaggctgcgtgttgaatctggccgaggcagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaacaaaaccaaaaatctccgcaggcaacccatataatgcagtacgaggacacaaacaggcacagagaagagcgacaacatgggccacaaaagaggaacccaggaaccaaacatgaacagagaaaaccagagggacaaaacaagcagcagcacacacaaatagagaggaaccgaaacaacaagacacgaaatacacagccgcggatatacaccccgtagcaacaaacatggacttccccggagagagcattcacgcagtactatcgtcgctcgaacacagacatacagaagaatgcaacaaagacaagacaagacaagacgaagaccacgaaagcaaccaagaagctcagaacaagcccgcacagactccgacaacaccagagaacacaaaaacacaacacagagacataaacataaacagtgcaatgaaacaacaactagctatcacttatgcagcagagggaagggcagaggggagactgaaaaagaagagaggcaaagcaggcgggagaagcggtgcggcggtgggcgcagggagagggagagttggcagtggatatacgagaggagaagtgacgaagatagagagaggaagagggagagctagcagacaacacggagaggaaagaaagcgaagtgagaaagaggaaggagagagtcgcgaggaaggggtgaggggggaagagagagaggaccgggcaggcggcggaggcggcgagagagtgagagaa

SEQ ID NO: 37777 - DNA, 2390 bp, Homo sapiens
  misc_feature (101)..(102): n is a, c, g, or t
actaaggatcccgaggatgctgcacaggacgtggaccaggccagtggctctgtgacaaagacaatgccggttgagataaaagggtggaaagacagttctgnncaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggacgtgggagcagcagcaagaagtggtttcaaggaaccgaaatgagcaggagtctgccgtgcacccgagggagattttcaagcagaaggagagggccatgtccaccacctccatctccagtcctcagcctggcaagctgaggagccccttcctgcagaagcagctcacccaaccagagacccactttggcagagagccagctgctgccatctcaaggcccagggcagatctccctgctgaggagccggcgcccagcactcctccatgtctggtgcaggcagaagaggaggctgtgtatgaggaacctccagagcaggagaccttctacgagcagcccccactggtgcagcagcaaggtgctggctctgagcacattgaccaccacattcagggccaggggctcagtgggcaagggctctgtgcccgtgccctgtacgactaccaggcagccgacgacacagagatctcctttgaccccgagaacctcatcacgggcatcgaggtgatcgacgaaggctggtggcgtggctatgggccggatggccattttggcatgttccctgccaactacgtggagctcattgagtgaggctgagggcacatcttgcccttcccctctcagacatggcttccttattgctggaagaggaggcctgggagttgacattcagcactcttccaggaataggacccccagtgaggatgaggcctcagggctccctccggcttggcagactcagcctgtcaccccaaatgcagcaatggcctggtgattcccacacatccttcctgcatcccccgaccctcccagacagcttggctcttgcccctgacaggatactgagccaagccctgcctgtggccaagccctgagtggccactgccaagctgcggggaagggtcctgagcaggggcatctgggaggctctggctgccttctgcatttatttgccttttttctttttctcttgcttctaaggggtggtggccaccactgtttagaatgacccttgggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaacaaaaccaaaaatctccgcaggcaacccatataatgcagtacgaggacacaaacaggcacagagaagagcgacaacatgggccacaaaagaggaacccaggaaccaaacatgaacagagaaaaccagagggacaaaacaagcagcagcacacacaaatagagaggaaccgaaacaacaagacacgaaatacacagccgcggatatacaccccgtagcaacaaacatggacttccccggagagagcattcacgcagtactatcgtcgctcgaacacagacatacagaagaatgcaacaaagacaagacaagacaagacgaagaccacgaaagcaaccaagaagctcagaacaagcccgcacagactccgacaacaccagagaacacaaaaacacaacacagagacataaacataaacagtgcaatgaaacaacaactagctatcacttatgcagcagagggaagggcagaggggagactgaaaaagaagagaggcaaagcaggcgggagaagcggtgcggcggtgggcgcagggagagggagagttggcagtggatatacgagaggagaagtgacgaagatagagagaggaagagggagagctagcagacaacacggagaggaaagaaagcgaagtgagaaagaggaaggagagagtcgcgaggaaggggtgaggggggaagagagagaggaccgggcaggcggcggaggcggcgagagagtgagagaa

SEQ ID NO: 37778 - DNA, 2380 bp, Homo sapiens
aggtttgtagcggtgtgatcgtcacttagcactcatttattcgtgtattcatacatttatgcatgtttctttcacagatcaaactgttgagggtccacaaacaggctgaagacctcgtctggagggagactgcagtgaacccaagatcgttcaaataagcgcatcgacataacaagatttagaaaagaataagcacggtgctgtgagagcagctagcgggggctggactgggtccctgcggccaggcttccaagtcgagctgccgtttgggtgggaccagaagacgggctagtctgcgccccaggatccctccctgaggacaaacagaaggccgggtcctcccttctcccgcttgtccttcggcattcgcgggacctgcatgctagaccagctggccggacagctcgctaggacccgcgggtgcggctggcccctgccatttccgcttcctgccgtggggcggggtttccggatgtcggaggcgaggcttgtcggctgtcaaaggggcggcccggccgggcccggaagctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagagaaggaggaggagaaccgtcggctggaggaaaagcggcgggccgaggaggcacagcggcagctggagcaggagcgccgggagcgtgagctgcgtgaggctgcacgccgggagcagcgctatcaggagcagggtggcgaggccagcccccagaggggaacagtgaacgtagagaattgtttttagcagagtttgtgaccaaagtcagagtggatcatggtggtttggcagcagggaatttgtcttgttggagcctgctctgtgctccccactccatttctctgtccctctgcctgggctatgggaagtggggatgcagatggccaagctcccaccctgggtattcaaaaacggcagacacaacatgttcctccacgcggctcactcgatgcctgcaggccccagtgtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaacaaaaccaaaaatctccgcaggcaacccatataatgcagtacgaggacacaaacaggcacagagaagagcgacaacatgggccacaaaagaggaacccaggaaccaaacatgaacagagaaaaccagagggacaaaacaagcagcagcacacacaaatagagaggaaccgaaacaacaagacacgaaatacacagccgcggatatacaccccgtagcaacaaacatggacttccccggagagagcattcacgcagtactatcgtcgctcgaacacagacatacagaagaatgcaacaaagacaagacaagacaagacgaagaccacgaaagcaaccaagaagctcagaacaagcccgcacagactccgacaacaccagagaacacaaaaacacaacacagagacataaacataaacagtgcaatgaaacaacaactagctatcacttatgcagcagagggaagggcagaggggagactgaaaaagaagagaggcaaagcaggcgggagaagcggtgcggcggtgggcgcagggagagggagagttggcagtggatatacgagaggagaagtgacgaagatagagagaggaagagggagagctagcagacaacacggagaggaaagaaagcgaagtgagaaagaggaaggagagagtcgcgaggaaggggtgaggggggaagagagagaggaccgggcaggcggcggaggcggcgagagagtgagagaa

SEQ ID NO: 37779 - DNA, 1331 bp, Homo sapiens
aggtttgtagcggtgtgatcgtcacttagcactcatttattcgtgtattcatacatttatgcatgtttctttcacagatcaaactgttgagggtccacaaacaggctgaagacctcgtctggagggagactgcagtgaacccaagatcgttcaaataagcgcatcgacataacaagatttagaaaagaataagcacggtgctgtgagagcagctagcgggggctggactgggtccctgcggccaggcttccaagtcgagctgccgtttgggtgggaccagaagacgggctagtctgcgccccaggatccctccctgaggacaaacagaaggccgggtcctcccttctcccgcttgtccttcggcattcgcgggacctgcatgctagaccagctggccggacagctcgctaggacccgcgggtgcggctggcccctgccatttccgcttcctgccgtggggcggggtttccggatgtcggaggcgaggcttgtcggctgtcaaaggggcggcccggccgggcccggaagctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgggctctgtgtaccagaagaccaatgccgtgtctgagattaaaagggttggtaaagacagcttctgggccaaagcagaggtgagtgctgccccggggcatgctgggcacgtgggagtgttctgcttgctgtggctcatctttcctcacaagtgagctcatgcagcatccactctccttggtgcccattacagatggtcacactgaggctcgggtaagttaagccacaaggctaatgatcgactggctctggtgcccgtctttggccatgtgcctaaaactcagtcctgggcagggg

SEQ ID NO: 37780 - DNA, 1896 bp, Homo sapiens
aggtttgtagcggtgtgatcgtcacttagcactcatttattcgtgtattcatacatttatgcatgtttctttcacagatcaaactgttgagggtccacaaacaggctgaagacctcgtctggagggagactgcagtgaacccaagatcgttcaaataagcgcatcgacataacaagatttagaaaagaataagcacggtgctgtgagagcagctagcgggggctggactgggtccctgcggccaggcttccaagtcgagctgccgtttgggtgggaccagaagacgggctagtctgcgccccaggatccctccctgaggacaaacagaaggccgggtcctcccttctcccgcttgtccttcggcattcgcgggacctgcatgctagaccagctggccggacagctcgctaggacccgcgggtgcggctggcccctgccatttccgcttcctgccgtggggcggggtttccggatgtcggaggcgaggcttgtcggctgtcaaaggggcggcccggccgggcccggaagctacagcagcggcgcggagactgcggggcgggccatggcggcgaacctgagccggaacgggccagcgctgcaagaggcctacgtgcgggtggtcaccgagaagtccccgaccgactgggctctctttacctatgaaggcaacagcaatgacatccgcgtggctggcacaggggagggtggcctggaggagatggtggaggagctcaacagcgggaaggtgatgtacgccttctgcagagtgaaggaccccaactctggactgcccaaatttgtcctcatcaactggacaggcgagggcgtgaacgatgtgcggaagggagcctgtgccagccacgtcagcaccatggccagcttcctgaagggggcccatgtgaccatcaacgcacgggccgaggaggatgtggagcctgagtgcatcatggagaaggtggccaaggcttcaggtgccaactacagctttcacaaggagagtggccgcttccaggacgtgggaccccaggccccagtgtgcctcaactgattctgacttcaggaaaagtaacacagagtggccttggcctgttgtcttcccctattttctgtcccagctcatccgtgtctctgaagaacaaatatgcttttggaccacgaaaaaaaaaaacaaaaccaaaaatctccgcaggcaacccatataatgcagtacgaggacacaaacaggcacagagaagagcgacaacatgggccacaaaagaggaacccaggaaccaaacatgaacagagaaaaccagagggacaaaacaagcagcagcacacacaaatagagaggaaccgaaacaacaagacacgaaatacacagccgcggatatacaccccgtagcaacaaacatggacttccccggagagagcattcacgcagtactatcgtcgctcgaacacagacatacagaagaatgcaacaaagacaagacaagacaagacgaagaccacgaaagcaaccaagaagctcagaacaagcccgcacagactccgacaacaccagagaacacaaaaacacaacacagagacataaacataaacagtgcaatgaaacaacaactagctatcacttatgcagcagagggaagggcagaggggagactgaaaaagaagagaggcaaagcaggcgggagaagcggtgcggcggtgggcgcagggagagggagagttggcagtggatatacgagaggagaagtgacgaagatagagagaggaagagggagagctagcagacaacacggagaggaaagaaagcgaagtgagaaagaggaaggagagagtcgcgaggaaggggtgaggggggaagagagagaggaccgggcaggcggcggaggcggcgagagagtgagagaa

SEQ ID NO: 37781 - DNA, 1049 bp, Homo sapiens
aggtttgtagcggtgtgatcgtcacttagcactcatttattcgtgtattcatacatttatgcatgtttctttcacagatcaaactgttgagggtccacaaacaggctgaagacctcgtctggagggagactgcagtgaacccaagatcgttcaaataagcgcatcgacataacaagatttagaaaagaataagcacggtgctgtgagagcagctagcgggggctggactgggtccctgcggccaggcttccaagtcgagctgccgtttgggtgggaccagaagacgggctagtctgcgccccaggatccctccctgaggacaaacagaaggccgggtcctcccttctcccgcttgtccttcggcattcgcgggacctgcatgctagaccagctggccggacagctcgctaggacccgcgggtgcggctggcccctgccatttccgcttcctgccgtggggcggggtttccggatgtcggaggcgaggcttgtcggctgtcaaaggggcggcccggccgggcccggaagctacagcagcggcgcggagactgcggggcgggccatggcggcgaacctgagccggaacgggccagcgctgcaagaggcctacgtgcgggtggtcaccgagaagtccccgaccgactggtgggcggcgagacgggccagggtcgggccagggctgcctcaggggtgggtctgtctggggcgagcgggggactcggggggagcgggacgcgaggcggagcggtgcccaggcaggtggcctggggcttacctgtctgcccctccacaccgcagcaggagtgctgtctcaccctcgtgaccccttgccccgccgatcgtggacaggttaaacccggcttggggggacccagtgagtccccgcccctccccctgtcgctcgccacccactgtgggcttcgcgggcttccatgttggatcctcggcctggtcgtgcttgctagcttcgccaggttcttctttccagtcctgggacttccctggagaaggggttcctgcacagccctctctgagaaggcggacagcgc

SEQ ID NO: 37782 - DNA, 540 bp, Homo sapiens
tcctttggtgcctgtgggctggccttccacctgggtccaggtctctaatgagtgctgtcccctacagggctctgtgtaccagaagaccaatgccgtgtctgagattaaaagggttggtaaagacagcttctgggccaaagcagaggtgagtgctgccccggggcatgctgggcacgtgggagtgttctgcttgctgtggctcatctttcctcacaagtgagctcatgcagcatccactctccttggtgcccattacagatggtcacactgaggctcgggtaagttaagccacaaggctaatgatcgactggctctggtgcccgtctttggccatgtgcctaaaactcagtcctgggcaggggattaggctgaagtggcagcatagggctgagcgggcagtggctctccctgcagaaggaggaggagaaccgtcggctggaggaaaagcggcgggccgaggaggcacagcggcagctggagcaggagcgccgggagcgtgagctgcgtgaggctgcacgccgggagcagcgctatcaggag

SEQ ID NO: 37783 - DNA, 326 bp, Homo sapiens
ttcaggtatgccacaacacatcttggaatttcctctccctcttcagacatgaatctacagggaacgctgtacttgtttatactgatacttatttgacaagtgtcattcacatattagaaaatcatagaattctaggattgcaaagctctttaaatgccatttggttctgcattcttttaatgtttgtgtgctttataaaatagtgctatataaaatgaacttataagtctaaataagactattctttatcaacaaagaatgtcatctttgccaaactacctgaccagcatgaaataaagaacatgtgctaccatgctcccctgaaa

SEQ ID NO: 37784 - DNA, 483 bp, Homo sapiens
cctcccacctcagcctcccaagtaactgggactacaggcacgtgccaccatgccaggctaattttttttttttctgggctcaaggtatcctcccacctcagtttcccaaagtgctgggattacaggcgtgagccactgcatgtggcccagatacttcatttgtattgccttcaggtgacttggcgatgagtccagaaatagaagcatagcttcaggaaaacaacaagtagaacttttaacgtttctgtccaaagtcagccatgtagaggtaaataaaaacaaacccatagggaaggggtgaagtggcttacaaaagaaaaaaaatattttaataggcccatcaaggaaaagaactatgaaggaaggtaaaatataaacttattcatacaaacaaatgccaaataaagtcagttgccagcataactgcactacaaaaaatgtgaaagggaccaggcacagtggttcacccctgtaatcccagca

SEQ ID NO: 37785 - DNA, 1176 bp, Homo sapiens
cggggccgcgcggctgcctgggaggctccgggccagccgcggtccagagcgcgcgaggttcggggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtccccca

SEQ ID NO: 37786 - DNA, 324 bp, Homo sapiens
  misc_feature (24)..(24): n is a, c, g, or t
aattcggcacgaggagggcagctngccccacttggggcagaggcaggggctggggcagtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtccccca

SEQ ID NO: 37787 - DNA, 287 bp, Homo sapiens
gcggccgcctactactactactactactgctcgaattcaagcttctaacgatgtacggggacatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtccccca

SEQ ID NO: 37788 - DNA, 1159 bp, Homo sapiens
  misc_feature (6)..(6): n is a, c, g, or t
  misc_feature (24)..(24): n is a, c, g, or t
cagcanctactggtatgcatcgcnctctgtaacgcgcgaggttcggggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtccccca

SEQ ID NO: 37789 - DNA, 1294 bp, Homo sapiens
  misc_feature (1188)..(1188): n is a, c, g, or t
cggggccgcgcggctgcctgggaggctccgggccagccgcggtccagagcgcgcgaggttcggggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtcccccaaaaaaaaaaaanaaaccggggcatattcggggggcacaagagttaaaggggccggccatagttccggcaccattctgcaagggaatcggcccaatgggaaatgaacgacgaaaaaaag

SEQ ID NO: 37790 - DNA, 2017 bp, Homo sapiens
cggggccgcgcggctgcctgggaggctccgggccagccgcggtccagagcgcgcgaggttcggggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtcccccagcttcctgctctgagtgtggctgccccttgcggggagaggcagagcaccccaggtttggagggtcctggggtcttctgtggtatggcccaggggggtggtgggggaggaggagtctcgtcccctgagccacagccagctgcttgcctgacctcagagggagcccctccccagtgctctgccctttcttctgccccaggttcagcaggtcaagtgagttcctcctcccacagcggaagcaggtgttggggggcatggaggaaagaaagcgggtgcaagaaggagcacgctcaggctggggcagcacccagggccgtaggacttgggaatggagggtgtctgtctggacccgctggtgcagagggtacaaaagctgggctggggcaggacagacgggccggagtgtagtgagtggcctgtgggaggggcagggggctcccacgcagaagctctgggcagcagccctgacccatccgtgcctggactgcagcgctgcccgcttcacccctggcaaacaggtggcagcctcctgacagaggaacgccggcccaggccgccgtgtctgcagttgggtgctgtgcgctgcccagagggctctttgggctggagagagaaaacaagaacagacacccagtggaggtggctttgctggagggacagacagttgatcatagtggagctggtgagaggaagctgcacccaaaagccatggccgggaacctggatctgactgcagggaaacagaagcgtggtgggcgctgggcgatgatggaatttctaacaaatgctttgtttctgctaaaaaaaaaaaaaaagaaaaaaaaaaaaacaaaaaaaaaaaaa

SEQ ID NO: 37791 - DNA, 1300 bp, Homo sapiens
cggggccgcgcggctgcctgggaggctccgggccagccgcggtccagagcgcgcgaggttcggggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcgtggcagcgctgcccacgaagtggcatatggacacccccagtgctgccggcctcgcttccggtacaaaagtctcagcaggaaaccaaccttaatggcttgttggtggataagacggcatcaacttgtacatttgcccattgagagaactcccaggagcaactgtcctctctccagtacacgcggcacgttgctaagaaggcagatttcaggatattcacattcatgcattacgtatctcacacttcgtgggcagcgggta

SEQ ID NO: 37792 - DNA, 1128 bp, Homo sapiens
cggggccgcgcggctgcctgggaggctccgggccagccgcggtccagagcgcgcgaggttcggggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcacttcgtgggcagcacgaagtggctgcccaaagtgctgggattacaggcgtgagccaccacacccagcctccccccagctcctatcca

SEQ ID NO: 37793 - DNA, 1159 bp, Homo sapiens
  misc_feature (9)..(10): n is a, c, g, or t
  misc_feature (27)..(27): n is a, c, g, or t
aataaggcnnggtacgaggctgggtgntgatcggccgagggggagctcggccaggctgctggtacctgcgtccgcccggcgagcagagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtccccca

SEQ ID NO: 37794 - DNA, 1119 bp, Homo sapiens
ctggaacccgcccccgcttcttgtttaggcactggtggtgcttgcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtccccca

SEQ ID NO: 37795 - DNA, 1051 bp, Homo sapiens
  misc_feature (9)..(10): n is a, c, g, or t
  misc_feature (27)..(27): n is a, c, g, or t
aataaggcnnggtacgaggctgggtgntgatcggccgagggatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtccccca

SEQ ID NO: 37796 - DNA, 1141 bp, Homo sapiens
cggggccgcgcggctgcctgggaggctccgggccagccgcggtccagagcgcgcgaggttcggggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtccccca

SEQ ID NO: 37797 - DNA, 1146 bp, Homo sapiens
cggggccgcgcggctgcctgggaggctccgggccagccgcggtccagagcgcgcgaggttcggggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtccccccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtccccca

SEQ ID NO: 37798 - DNA, 748 bp, Homo sapiens
cggggccgcgcggctgcctgggaggctccgggccagccgcggtccagagcgcgcgaggttcggggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccccccacattggagccctcctgctgctttggtgcctcaaataaatacagatgtccccca

SEQ ID NO: 37799 - DNA, 1075 bp, Homo sapiens
  misc_feature (9)..(10): n is a, c, g, or t
  misc_feature (27)..(27): n is a, c, g, or t
  misc_feature (894)..(894): n is a, c, g, or t
aataaggcnnggtacgaggctgggtgntgatcggccgagggggagctcggccaggctgctggtacctgcgtccgcccggcgagcagagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggngccttaagccgtggggtctggggcactgggagcagggtcacaacctgaagctaatcgtacctgcggaaaggtggctaggcactggggtggttgctccgtggcgccaaaagtgcgccctggcgggggggataaatccaaaaaaaaaagttgggggtgcgcacggctacaacgagccattcga

SEQ ID NO: 37800 - DNA, 587 bp, Homo sapiens
  misc_feature (43)..(43): n is a, c, g, or t
aggccggtccgtctgtcagctcagagcaggaccggcttcaggncctgactcggtctcctcttgacccgccccggaggcttgtggtgggctctgtgtttgcagctctcctgaacagagctagatgagggtgggaggccacttcgtgggcagcctgcccacgaagtggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtccccca

SEQ ID NO: 37801 - DNA, 1474 bp, Homo sapiens
cggggccgcgcggctgcctgggaggctccgggccagccgcggtccagagcgcgcgaggttcggggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtccccccccacattggagccctcctgctgctttggtgcctcaaataaatacagatgtcccccagcttcctgctctgagtgtggctgccccttgcggggagaggcagagcaccccaggtttggagggtcctggggtcttctgtggtatggcccaggggggtggtgggggaggaggagtctcgtcccctgagccacagccagctgcttgcctgacctcagagggagcccctccccagtgctctgccctttcttctgccccaggttcagcaggtcaagtgagttcctcctcccacagcggaagcaggtgttggggggcatggaggaaagaaagcgggtgcaagaaggagcacgctcaggctggggcagcacccagggccgtaggacttgggaatggagggtgtctgtctggacccgctggtgcagagggtacaaaagctgggctggggcaggacagacgggccggagtgtagtgagtggcctgtgggaggggcagggggctcccacgcagaagctctgggcagcagccctgacccatccgtgcctggactgcagcgctgcccgcttcacccctggcaaacaggtggcagcctcctgacagaggaacgccggcccaggccgccgtgtctgcagttgggtgctgtgcgctgcccagagggctctttgggctggagagagaaaacaagaacagacacccagtggaggtggctttgctggagggacagacagttgatcatagtggagctggtgagaggaagctgcacccaaaagccatggccgggaacctggatctgactgcagggaaacagaagcgtggtgggcgctgggcgatgatggaatttctaacaaatgctttgtttctgctaaaaaaaaaaaaaaagaaaaaaaaaaaaacaaaaaaaaaaaaa

SEQ ID NO: 37802 - DNA, 732 bp, Homo sapiens
cggggccgcgcggctgcctgggaggctccgggccagccgcggtccagagcgcgcgaggttcggggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccctggcagcagctgatgcccatggaagccacaccaacattgacgccttctgggatggggcaggccggggaacaggtcttgctcaggctgtggccaaatgtcacgagattcccaatgccggcactagcagacacagtcaccacttcacccaggggatcct

SEQ ID NO: 37803 - DNA, 947 bp, Homo sapiens
cggggccgcgcggctgcctgggaggctccgggccagccgcggtccagagcgcgcgaggttcggggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagtcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacaggcacccaattgagctctgtgattgggctaatatacagatgccc

SEQ ID NO: 37804 - DNA, 373 bp, Homo sapiens
cgtactagaggatccatggaccaggcaggacaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtccccca

SEQ ID NO: 37805 - DNA, 536 bp, Homo sapiens
cggggccgcgcggctgcctgggaggctccgggccagccgcggtccagagcgcgcgaggttcggggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattggtggctttgctggagggacagacagttgatcatagtggagctggtgagaggaagctgcacccaaaagccatggccgggaacctggatctgactgcagggaaacagaagcgtggtgggcgctgggcgatgatggaatttctaacaaatgctttgtttctgctaaaaaaaaaaaaaaagaaaaaaaaaaaaacaaaaaaaaaaaaa

SEQ ID NO: 37806 - DNA, 518 bp, Homo sapiens
  misc_feature (43)..(43): n is a, c, g, or t
aggccggtccgtctgtcagctcagagcaggaccggcttcaggncctgactcggtctcctcttgacccgccccggaggcttgtggtgggctctgtgtttgcagctctcctgaacagagctagatgagggtgggaggccacttcgtgggcagcctgcccacgaagtggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcgtggcagcgctgcccacgaagtggccgaatcttccttcaggatatcaagaaaccagactgtgatgac

SEQ ID NO: 37807 - DNA, 1216 bp, Homo sapiens
cggggccgcgcggctgcctgggaggctccgggccagccgcggtccagagcgcgcgaggttcggggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtcccccaaaaaaaaaaaaagaaaaaaaaaaaaacaaaaaaaaaaaaa

SEQ ID NO: 37808 - DNA, 1153 bp, Homo sapiens
cggggccgcgcggctgcctgggaggctccgggccagccgcggtccagagcgcgcgaggttcggggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacagagagagcgtcccccacagagagagcgt

SEQ ID NO: 37809 - DNA, 1275 bp, Homo sapiens
  misc_feature (6)..(6): n is a, c, g, or t
  misc_feature (24)..(24): n is a, c, g, or t
cagcanctactggtatgcatcgcnctctgtaacgcgcgaggttcggggagctcggccaggctgctggtacctgcgtccgcccggcgggtctcactctgttgcccaggctgcagtgcagtggcatgatcatagttcacttcagtcttgaactccctggctcaagagatcctcccacctcagcctcccaagtagctgaccacagagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtccccca

SEQ ID NO: 37810 - DNA, 995 bp, Homo sapiens
ctctctagggacgactggagtgagcactggcctgggagtctgaagattgtgtcttcatacatagatcatcactttctatatggcgactttggtcagtcatgtagtgtttacgggccttatgtccctaatgtgtgagtaattgaaggcaattggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtcccccgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtccccca

SEQ ID NO: 37811 - DNA, 1042 bp, Homo sapiens
gggtcgggagcccgcaggctgctggtactgcgtcgccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctggcgatcccccagctcaggaaggaaagcccagccctttctggatcccacagtgtatgggagcccctgactcctcacgtgcctgatctgtgcccttggtcccaggtcaggcccaccccctgcacctccacctgccccagcccctgcctctgccccaagtggggccagctgccctcacttctggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcagcctttgggggttggggtttctgccacttccgggtctaggccctgccccaaatccagccagtcctgccccagcccacccccacattggagccctcctgctgctttggtgcctcaaataaatacagatgtccccca

SEQ ID NO: 37812 - DNA, 690 bp, Homo sapiens
cggggccgcgcggctgcctgggaggctccgggccagccgcggtccagagcgcgcgaggttcggggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtccccctgccacttccgggtctaggccctgccccaaatccagccagtcctgccccagcccacccccacattggagccctcctgctgctttggtgcctcaaataaatacagatgtccccca

SEQ ID NO: 37813 - DNA, 629 bp, Homo sapiens
cggggccgcgcggctgcctgggaggctccgggccagccgcggtccagagcgcgcgaggttcggggagctcggccaggctgctggtacctgcgtccgcccggcgagcaggacaggctgctttggtttgtgacctccaggcaggacggccatcctctccagaatgaagatcttcttgccagtgctgctggctgcccttctgggtgtggagcgagccagctcgctgatgtgcttctcctgcttgaaccagaagagcaatctgtactgcctgaagccgaccatctgctccgaccaggacaactactgcgtgactgtgtctgctagtgccggcattgggaatctcgtgacatttggccacagcctgagcaagacctgttccccggcctgccccatcccagaaggcgtcaatgttggtgtggcttccatgggcatcagctgctgccagagctttctgtgcaatttcagtgcggccgatggcgggctgcgggcaagcgtcaccctgctgggtgccgggctgctgctgagcctgctgccggccctgctgcggtttggcccctgaccgcccagaccctgtccccgcctcctcaaaaagcaccagcacgaattcccttagcaccagcacgaattccctt

SEQ ID NO: 37814 - DNA, 711 bp, Homo sapiens
  misc_feature (43)..(43): n is a, c, g, or t
aggccggtccgtctgtcagctcagagcaggaccggcttcaggncctgactcggtctcctcttgacccgccccggaggcttgtggtgggctctgtgtttgcagctctcctgaacagagctagatgagggtgggaggccacttcgtgggcagcctgcccacgaagtggggtggatgatgtgaccttccttgggggactgcggaagggacgagggttccctggagtcttacggtccaacatcaggaccaagtcccatggacatgctgacagggtccccagggagaccgtgtcagtagggatgtgtgcctggctgtgtacgtgggtgtgcagtgcacgtgagagcacgtggcggcttctgggggccatgtttggggagggaggtgtgccagcagcctggagagcctcagtccctgtagccccctgccctggcacagctgcatgcacttcaagggcgtggcagcgctgcccacgaagtggcatatggacacccccagtgctgccggcctcgcttccggtacaaaagtctcagcaggaaaccaaccttaatggcttgttggtggataagacggcatcaacttgtacatttgcccattgagagaactcccaggagcaactgtcctctctccagtacacgcggcacgttgctaagaaggcagatttcaggatattcacattcatgcattacgtatctcacacttcgtgggcagcgggta

SEQ ID NO: 37815 - DNA, 207 bp, Homo sapiens
gtggctttgctggagggacagacagttgatcatagtggagctggtgagaggaagctgcacccaaaagccatggccgggaacctggatctgactgcagggaaacagaagcgtggtgggcgctgggcgatgatggaatttctaacaaatgctttgtttctgctaaagctaacttgcgcttccatctctggcatctcctccacttcccag

SEQ ID NO: 37816 - DNA, 447 bp, Homo sapiens
aatctaaatatattctattttttaaagagaaaacaggattggtattaacacagtatagtgtggttgtttataaagtaaaacctgtagagaacagtatgactcctgtgggaaaagaagaatacacctttattctggcatttaaagaagaaagccatccaggactggcgccgcggctcatacctgcaaccccagcagtttgagaggccgaagagggccaattgcttgagtccaggaatttgagaccagcctgggcaacatggagataccccgtctctacataaaatacaaaattttggtgggcgtgatggcaggtgcctgtaatcccagctatttgggagctaaggtgagaggactgctttagcaatggaagacaaggttgcagtgagtggagatcatgccactgcactccagggcaggtgacagaatgagaccctatctcaaaaaata

SEQ ID NO: 37817 - DNA, 370 bp, Homo sapiens
aaatcctttttcccccatagttttatgattttttttttactttagatgttgttatcatagattctagctttccttatataatacaaatatatattattgattctaagtcaaatttttttagaattttaatatctgacagttgggatgtgacttagaaataagtggtgtcttaaattagatgatatgcagtgtgatgtgaatatataaaatatgtgatgtcagtgaatatatgtgtatatatacatgcacgtgcatacattgattgggagctggcctactattagatagatttgaaattggtattcacgagtagactagtttcctaaagtgtatgggattatcatagatctgctgttggacccctgtatgt

SEQ ID NO: 37818 - DNA, 1275 bp, Homo sapiens
  misc_feature (23)..(23): n is a, c, g, or t
ggctcgagtgcctggcgggctcnggcttccgcgtccgcccctgctccggcttcgcccgcagctccgcgcccgcgggcaaccaagcccccagcgaagcccgcacagctccgggtgccaggacggggggccatgccgtgccggagggaggaggaagaggaagccggcgaggaggcggagggggaggaagaggaggacgacagcttcctcctgctgcagcagtcggtgacgctgggcagctcgggcgaggtggaccggctggtggcccagatcggcgagacgctgcagctggacgcggcgcaggacagcccggcctcgccgtgcgcgcccccgggggtgccgctgcgggccccggggcccctggctgcggcggtgccggcggacaaggcccggcccccggcggtgccgctgctgctgccgcccgcttcggctgagacggtgggcccggcgccctctggggccctgcgctgcgccctaggggaccgcggccgcgtgcgcggacgcgctgcgccctactgcgtggcggaggtcgccgcaggccccagcgcgctgccggggccgtgccggcgaggatggctcagggacgcggtcacctcccgccgcttgcagcagcgccgatggacccaagccggggcacgcgccggcgacgacgacccgcatcggctcctccagcagctcgtgctctcgggaaacctcatcaaggaagccgtgcggagactccaacgagccgtcgccgcggttgcagccacgggccccgcaagcgcccctgggcccgggggaggccgcagcggacctgaccgcattgccctgcagccctcaggctccttgctctgacgcaggcctcctggaggaggaagtggaggccgctgcgtagacccaacagcgtccagttcctactaactctgagctgaagccgacgtcgccagcctgggagcgaccactttggctgcggggaggcgcgtggggagagatctcaaccagagaagttaccagccgcggcgaggccgtcggagaaaacttaagcgtggagaaatgtatgcgccagggtgcttccgtggggcatgagaatttcccgggccatccaagcccaaggacctgggataaactgggagaactatggcagctacttgcatcgacttgtacctcacttagcccttgggggcgtcgtgagcttggattgtttaaggagggctcaggggtaggaatcgcgatggctttataacaatacttgaaaactaacgacacgcatacgcccagtacgcacatacgcccagatat

SEQ ID NO: 37819 - DNA, 1212 bp, Homo sapiens
  misc_feature (23)..(23): n is a, c, g, or t
ggctcgagtgcctggcgggctcnggcttccgcgtccgcccctgctccggcttcgcccgcagctccgcgcccgcgggcaaccaagcccccagcgaagcccgcacagctccgggtgccaggacggggggccatgccgtgccggagggaggaggaagaggaagccggcgaggaggcggagggggaggaagaggaggacgacagcttcctcctgctgcagcagtcggtgacgctgggcagctcgggcgaggtggaccggctggtggcccagatcggcgagacgctgcagctggacgcggcgcaggacagcccggcctcgccgtgcgcgcccccgggggtgccgctgcgggccccggggcccctggctgcggcggtgccggcggacaaggcccggcccccggcggtgccgctgctgctgccgcccgcttcggctgagacggtgggcccggcgccctctggggccctgcgctgcgccctaggggaccgcggccgcgtgcgcggacgcgctgcgccctactgcgtggcggaggtcgccgcaggccccagcgcgctgccggggccgtgccggcgaggatggctcagggacgcggtcacctcccgccgcttgcagcagcgccgatggacccaagccggggcacgcgccggcgacgacgacccgcatcggctcctccagcagctcgtgctctcgggaaacctcatcaaggaagccgtgcggagactccaacgagccgtcgccgcggttgcagccacgggccccgcaagcgcccctgggcccgggggaggccgcagcggacctgaccgcattgccctgcagccctcaggctccttgctctgacgcaggcctcctggaggaggaagtggaggccgctgcgtagacccaacagcgtccagttcctactaactctgagctgaagccgacgtcgccagcctgggagcgaccactttggctgcggggaggcgcgtggggagagatctcaaccagagaagttaccagccgcggcgaggccgtcggagaaaacttaagcgtggagaaatgtatgcgccagggtgcttccgtggggcatgagaatttcccgggccatccaagcccaaggacctgggataaactgggagatcacgagctggctcaatcactagtgatattcgcgccgcctgcagatcgacatatgagagctcccaacgcgtgaatgcatagcttgatattaataggcaccaa

SEQ ID NO: 37820 - DNA, 2441 bp, Homo sapiens
  misc_feature (23)..(23): n is a, c, g, or t
ggctcgagtgcctggcgggctcnggcttccgcgtccgcccctgctccggcttcgcccgcagctccgcgcccgcgggcaaccaagcccccagcgaagcccgcacagctccgggtgccaggacggggggccatgccgtgccggagggaggaggaagaggaagccggcgaggaggcggagggggaggaagaggaggacgacagcttcctcctgctgcagcagtcggtgacgctgggcagctcgggcgaggtggaccggctggtggcccagatcggcgagacgctgcagctggacgcggcgcaggacagcccggcctcgccgtgcgcgcccccgggggtgccgctgcgggccccggggcccctggctgcggcggtgccggcggacaaggcccggcccccggcggtgccgctgctgctgccgcccgcttcggctgagacggtgggcccggcgccctctggggccctgcgctgcgccctaggggaccgcggccgcgtgcgcggacgcgctgcgccctactgcgtggcggaggtcgccgcaggccccagcgcgctgccggggccgtgccggcgaggatggctcagggacgcggtcacctcccgccgcttgcagcagcgccgatggacccaagccggggcacgcgccggcgacgacgacccgcatcggctcctccagcagctcgtgctctcgggaaacctcatcaaggaagccgtgcggagactccaacgagccgtcgccgcggttgcagccacgggccccgcaagcgcccctgggcccgggggaggccgcagcggacctgaccgcattgccctgcagccctcaggctccttgctctgacgcaggcctcctggaggaggaagtggaggccgctgcgtagacccaacagcgtccagttcctactaactctgagctgaagccgacgtcgccagcctgggagcgaccactttggctgcggggaggcgcgtggggagagatctcaaccagagaagttaccagccgcggcgaggccgtcggagaaaacttaagcgtggagaaatgtatgcgccagggtgcttccgtggggcatgagaatttcccgggccatccaagcccaaggacctgggataaactgggagaactatggcagctacttgcatcgacttgtacctcacttagcccttgggggcgtcgtgagcttggattgtttaaggagggctcaggggtaggaatcgcgatggctttataacaatacttgaaaactaacgacacgcatacattttcttattttctggtggaggagcttagtaagtggtgctacaattgctgtgcaaagaaattccagaggggagaagaatgtaaaagtttggtggtgggtggcttggcattgcccctttttcccaccgattcggtggctggtgaaggtgggagatgtgaactccaattaagggactggagagaggtgaagaattttgcaggtgggagatttggatttgaatgtggacttgtaaatgacttgaccttgccatctgtgttcaaggtcacggtttgctgtggggttcctgggagagcttactcaccccggagtcttttctttctcttgctccaagaagagccctgttggtgctttaccaccgcttggagtctcccgaggacacaaacaggcagagagggacgtgtagggagagttctttcctgttttctgtgctttcctttttacaggactcccggaaggccactcatggccatgccaggagctttctcagaaacagtcataaacgatctcttgagtctctttcttgtcctcccagctgagctttcttattccaccctttctggtgtctataggaatgcatgagagaccctggacgtttttctgctctcttctggccctccatggagccatgggcctcggcctcggcggctcctcaccctcacaatttatttcctcctcccgtgccagcccttcttttgtgtctgaaaccggttttaaaatgtgactctcccagagaagaagccgctggctgtatgaaacttgacggcgcttttgtaaggtgccacccccaaactttaaggtagctaaaccaatttttaaaagattcaatggcttgttcatcctccagatgtagctattgatgtacacttcgcaacggagtgtctgaaattgtggtggtcctgatttataggatttcataattaaaatgtctgctgaataaaaaaaaaaaaaaaaaaaaaaaaaaaaaaaaaaaaaaaaaaaaaaaaaaaaaaaaaaaaaaaaaaaaaaaaaaaaaacgaagcgcgggggcgcgcgcgaggccaccaagagaagagaagcgccccgatgagaaaccccagcagggggaggggcggggaggcacaaatgggaggagaaaaggaaggggccacgagggggtcccacagggaaaccccgggggacgaaaacagagggggggggtccgcaagacaaaggc

SEQ ID NO: 37821 - DNA, 2187 bp, Homo sapiens
  misc_feature (23)..(23): n is a, c, g, or t
ggctcgagtgcctggcgggctcnggcttccgcgtccgcccctgctccggcttcgcccgcagctccgcgcccgcgggcaaccaagcccccagcgaagcccgcacagctccgggtgccaggacggggggccatgccgtgccggagggaggaggaagaggaagccggcgaggaggcggagggggaggaagaggaggacgacagcttcctcctgctgcagcagtcggtgacgctgggcagctcgggcgaggtggaccggctggtggcccagatcggcgagacgctgcagctggacgcggcgcaggacagcccggcctcgccgtgcgcgcccccgggggtgccgctgcgggccccggggcccctggctgcggcggtgccggcggacaaggcccggcccccggcggtgccgctgctgctgccgcccgcttcggctgagacggtgggcccggcgccctctggggccctgcgctgcgccctaggggaccgcggccgcgtgcgcggacgcgctgcgccctactgcgtggcggaggtcgccgcaggccccagcgcgctgccggggccgtgccggcgaggatggctcagggacgcggtcacctcccgccgcttgcagcagcgccgatggacccaagccggggcacgcgccggcgacgacgacccgcatcggctcctccagcagctcgtgctctcgggaaacctcatcaaggaagccgtgcggagactccaacgagccgtcgccgcggttgcagccacgggccccgcaagcgcccctgggcccgggggaggccgcagcggacctgaccgcattgccctgcagccctcaggctccttgctctgacgcaggcctcctggaggaggaagtggaggccgctgcgtagacccaacagcgtccagttcctactaactctgagctgaagccgacgtcgccagcctgggagcgaccactttggctgcggggaggcgcgtggggagagatctcaaccagagaagttaccagccgcggcgaggccgtcggagaaaacttaagcgtggagaaatgtatgcgccagggtgcttccgtggggcatgagaatttcccgggccatccaagcccaaggacctgggataaactgggagaactatggcagctacttgcatcgacttgtacctcacttagcccttgggggcgtcgtgagcttggattgtttaaggagggctcaggggtaggaatcgcgatggctttataacaatacttgaaaactaacgacacgcatacattttcttattttctggtggaggagcttagtaagtggtgctacaattgctgtgcaaagaaattccagaggggagaagaatgtaaaagtttggtggtgggtggcttggcattgcccctttttcccaccgattcggtggctggtgaaggtgggagatgtgaactccaattaagggactggagagaggtgaagaattttgcaggtgggagatttggatttgaatgtggacttgtaaatgacttgaccttgccatctgtgttcaaggtcacggtttgctgtggggttcctgggagagcttactcaccccggagtcttttctttctcttgctccaagaagagccctgttggtgctttaccaccgcttggagtctcccgaggacacaaacaggcagagagggacgtgtagggagagttctttcctgttttctgtgctttcctttttacaggactcccggaaggccactcatggccatgccaggagctttctcagaaacagtcataaacgatctcttgagtctctttcttgtcctcccagctgagctttcttattccaccctttctggtgtctataggaatgcatgagagaccctggacgtttttctgctctcttctggccctccatggagccatgggcctcggcctcggcggctcctcaccctcacaatttatttcctcctcccgtgccagcccttcttttgtgtctgaaaccggttttaaaatgtgactctcccagagaagaagccgctggctgtatgaaacttgacggcgcttttgtaaggtgccacccccaaactttaaggtagctaaaccaatttttaaaagattcaatggcttgttcatcctccagatgtagctattgatgtacacttcgcaacggagtgtctgaaattgtggtggtcctgatttataggatttcataattaaaatgtctgctgaataaa

SEQ ID NO: 37822 - DNA, 2232 bp, Homo sapiens
  misc_feature (23)..(23): n is a, c, g, or t
ggctcgagtgcctggcgggctcnggcttccgcgtccgcccctgctccggcttcgcccgcagctccgcgcccgcgggcaaccaagcccccagcgaagcccgcacagctccgggtgccaggacggggggccatgccgtgccggagggaggaggaagaggaagccggcgaggaggcggagggggaggaagaggaggacgacagcttcctcctgctgcagcagtcggtgacgctgggcagctcgggcgaggtggaccggctggtggcccagatcggcgagacgctgcagctggacgcggcgcaggacagcccggcctcgccgtgcgcgcccccgggggtgccgctgcgggccccggggcccctggctgcggcggtgccggcggacaaggcccggcccccggcggtgccgctgctgctgccgcccgcttcggctgagacggtgggcccggcgccctctggggccctgcgctgcgccctaggggaccgcggccgcgtgcgcggacgcgctgcgccctactgcgtggcggaggtcgccgcaggccccagcgcgctgccggggccgtgccggcgaggatggctcagggacgcggtcacctcccgccgcttgcagcagcgccgatggacccaagccggggcacgcgccggcgacgacgacccgcatcggctcctccagcagctcgtgctctcgggaaacctcatcaaggaagccgtgcggagactccaacgagccgtcgccgcggttgcagccacgggccccgcaagcgcccctgggcccgggggaggccgcagcggacctgaccgcattgccctgcagccctcaggctccttgctctgacgcaggcctcctggaggaggaagtggaggccgctgcgtagacccaacagcgtccagttcctactaactctgagctgaagccgacgtcgccagcctgggagcgaccactttggctgcggggaggcgcgtggggagagatctcaaccagagaagttaccagccgcggcgaggccgtcggagaaaacttaagcgtggagaaatgtatgcgccagggtgcttccgtggggcatgagaatttcccgggccatccaagcccaaggacctgggataaactgggagaactatggcagctacttgcatcgacttgtacctcacttagcccttgggggcgtcgtgagcttggattgtttaaggagggctcaggggtaggaatcgcgatggctttataacaatacttgaaaactaacgacacgcatacattttcttattttctggtggaggagcttagtaagtggtgctacaattgctgtgcaaagaaattccagaggggagaagaatgtaaaagtttggtggtgggtggcttggcattgcccctttttcccaccgattcggtggctggtgaaggtgggagatgtgaactccaattaagggactggagagaggtgaagaattttgcaggtgggagatttggatttgaatgtggacttgtaaatgacttgaccttgccatctgtgttcaaggtcacggtttgctgtggggttcctgggagagcttactcaccccggagtcttttctttctcttgctccaagaagagccctgttggtgctttaccaccgcttggagtctcccgaggacacaaacaggcagagagggacgtgtagggagagttctttcctgttttctgtgctttcctttttacaggactcccggaaggccactcatggccatgccaggagctttctcagaaacagtcataaacgatctcttgagtctctttcttgtcctcccagctgagctttcttattccaccctttctggtgtctataggaatgcatgagagaccctggacgtttttctgctctcttctggccctccatggagccatgggcctcggcctcggcggctcctcaccctcacaatttatttcctcctcccgtgccagcccttcttttgtgtctgaaaccggttttaaaatgtgactctcccagagaagaagccgctggctgtatgaaacttgacggcgcttttgtaaggtgccacccccaaactttaaggtagctaaaccaatttttaaaagattcaatggcttgttcatcctccagatgtagctattgatgtacacttcgcaacggagtgtctgaaattgtggtggtcctgatttataggatttcataattaaaatgtctgctgaataaatttggcttttgttttggaaataaaaaatacatatcggggatcctc

SEQ ID NO: 37823 - DNA, 496 bp, Homo sapiens
taagcagtgaagtcattgggtcctgggcttttgcttgctaggagacttatgattacacttgatcttagccaaaaggctgagaagtgataggagacttattattacagcttcaatctcattatttgttattagtctgttcaggtttcagatttgttcatggttgcatttcttggtattagttatgtctcctttttcacttctgattttatctggatcttttctcttttttttcttcatctggctaaagctttgtctattttgtttattttttcaaaaaaacaacttttcatttcattgatcttttgtatttttttggtctgtttccatttaacttatttctgctctgacctttattctttcttttcttttgagtatatacctagcaggattgctggatcacgtggtagttcttagttttgtgaggaactcccatactgttctccacagtggctgtactaatttacattcccaccaacagtgtacaggaagtgctagg

SEQ ID NO: 37824 - DNA, 589 bp, Homo sapiens
taagcagtgaagtcattgggtcctgggcttttgcttgctaggagacttatgattacacttgatcttagccaaaaggctgagaagtgataggagacttattattacagcttcaatctcattatttgttattagtctgttcaggtttcagatttgttcatggttgcatttcttggtattagttatgtctcctttttcacttctgattttatctggatcttttctcttttttttcttcatctggctaaagctttgtctattttgtttattttttcaaaaaaacaacttttcatttcattgatcttttgtatttttttggtctgtttccatttaacttatttctgctctgacctttattctttcttttcttctactaattttgggtttggtttgctcttgcttttctatgtttctggctggcctcacaggacacagactactaattttgggtttggttttctcttgcttttctagttctttaagatgcatcattaggttatttattagatgtttttccactttttgacgtaggtgtttattcctataaactctcttagtactgctttcattgtatgacatacgttttgatatg

SEQ ID NO: 37825 - DNA, 1449 bp, Homo sapiens
ggctggagtgcagtagtgtgaccataactcactggagcctctacctcctgggcttcaagcagtcctcttaccgcacctcctgagcagctgggaccacagacatgcaccccacgcctggctaattttttaatttttttgtagagatagggtctcactatgttgctcaagctgctctcgaactcctgggctcaagcaatcctccctccttggcctcccaaactgctgggattacaggtgtcagccaatgtgcctggccaaggatgtgccttttgttactcaaactaaggtacttgggagccaggtcagaccctgcctttgagtagcccttaaagcaatcgtgaggggattctgcaaagtggtgtgtcatcatggttagtcttgaggaaaaagcccagaggatggacaacagagaaggtgggagattgctcagggggctgggaagggcaggctgtgctcatgcatgtgtgcgtgtgtgtgtgtgtgtgtgtgtgtgtgtttgtgtgcgcctgcgtgcagggggagggtggcacagccagggtcatgacccccctcacagcagaaatgggggacacattgggcaggtgtccttagggataacatcaaggtagcccaaaccctgctttgaggtggagcagggagaccaccccctcgcagggccacctgtacctgatggtgactgcgtctgcaggcaggatagcctccctgtccccactagggaagagctgaggaatacaggagcttggaagtggaaccacaaccaattgagagtatatgtgccattggaagaagagcaatagaagatttgcaacatgaactaagatcaagaaatgctaacaaagtaattgttcaaagaacacagtagatggaatacataaaatggatacagctagagaacaagtagagaaggtggaaagtcagattagggaactactctggaagtaaaataggaactttaaaggaactattaagagagatgggagagaataagggctggtgtccagatagcagactcaaggagaagggatatgtttagtggtggttagggattgtctgaggaagcaggtggttggggttctctggactgggaagtggtccacagagggccccatggcatgttgagcttatctgtattctcaccatggaccacacaaaagccaagcaaaacacatcagacttccccacagtggaactggcacaagataacagtgcacccaatttatccaaattgtcactttattgtgcagttgtaataaaaaatatttttaagcatgtaagtttcagaagttttaacacacagaggtccgtactgaaaacagttttggtcaagatactaagagaaataaattcaagatgtgctataagatgtatgagagtaaggagaactcagtactaggtgaggtctgttgtgtaaattgtgtgtgtgtgtgtgtacacacacaccagtcaagt

SEQ ID NO: 37826 - DNA, 419 bp, Homo sapiens
ttttttttttttgagatggagtctcactctgtcgtccaggctggagtgcagtggcacgatcttgactcactgcaacctccgcctcccaagcgattcccctgcctcaacctcctgagtagctgggattatggccgcccacatccatgcccagctaatttttatatttttagtagagacggggttttaccatgttggccaggctggtttcgaatgcctgacctcaagtgatccgcccacctcggcctctcaaagtgccaggattacaggggtgagccaccgtgcccggcctcacttaatatttcttaagtcctgcagtcctcacaatgactcaaaagtaggtactactgttattttatctttttatgttttgaaacagggtctcactctgtcgccctggctatagtacacaggcacgatca

SEQ ID NO: 37827 - DNA, 1176 bp, Homo sapiens
gttattcactttttaccttcctatccaggtgcactgccaaaatgctctgctttttcagactgtggctgcttctcccccacccccaagagccaaataacttaggggcagcttttaatttttttttgtaaaaagtactgttgacttgggatttttaaggtaaaaattttggtacaggagctattctgtgtgccatgatggacagaactggaattgctattttgtgatttgggacagttgaggattccttcctagaacattattatgtagattgtttgtggcatggccttgatccccatcctcacatacatcaagaatgttgttccttgcacttgacggccacattcccatgtttgttatctattactgcattataacccctatcaaaactttgtggcttaaagtaataccagtttattagtttttactctggaggttggctgggcttagctacatggttctacagctgactgttcattcctggggtcactcatgcagctgtattgaggtgggaactcaacttggctgggaagagctggtaggcatagtgcacatgtgcggaaatggtattagctaaggcacttcggttctctttgtgttctcttattttccacaaggctacattggaccccttcatagcatggtggtctcagggttccagggtgaaggcatagaactggtacggtgtcacttctgtggattcttttggtcaggcaagtccagatttaatgagagggaaaatagacttcagctcttgatgggaggagtatgcaggatgggagacatgatggcagaggtgggacaggcaggcaaggttgctgagtccccttgctgcctcctcaggcccacttgggcctgcttttcccaaatggcagctcctctggacatgccattccttctcccacctgcctgattcttcatatgttgggtgtccctgtttttctggtgctatttcctgactgctgttcagctgccactgtcctgcaaagcctgcctttttaaatgcctcaccattccttcatttgtttcttaaatatgggaagtgaaagtgccacctgaggccgggcacagtggctcacgcctgtaatcccagcattttgggaggctggggcaggcagattgcttgagccaaggagtttgagaccagcctgaggaacatggtgaaaccccgtctgtacc

SEQ ID NO: 37828 - DNA, 3543 bp, Homo sapiens
  misc_feature (1574)..(1574): n is a, c, g, or t
  misc_feature (1986)..(1986): n is a, c, g, or t
  misc_feature (2346)..(2346): n is a, c, g, or t
gccggggatgggggcgactggaagggggtgcccgtggcttcctttgggcctttccttccaactagcgcctgcaggtggacccgggttgacttccctcacctccctcgggcggccgacctttggatggcggacctcagccgccccagggttgcgaggcgacgggcgcgctggcccaggccaccaggcgggctccatcagggctttgggtggtgagttgggggcgccggatttggctcatttcaacgctggccggaggtcacgaggatggaggtgaggtgtttgtgaaccgatccttgtcctccgcctcggggagctcctggtctgtgggttgggggaaccaagtagagactcggactgagcattcactgtcacaggcggcttaaacaagtaatgtcccagcttcccgatggggagatcagtgagggcctggcagactttcccagggacacagagagaaagggaggcgacagctagcgaataggagacttccagaggtgatgggatttgggtgggaggagaggcaagagagggcattccaggagaatgtatgggcaaaggcacagggatgaaaacgagcacagctgttgggggctgagcctgggagctcagccatgtgactgcccatggggtggtggagtctggagaaatttgcaacctgtcccctacatgttctgcctcacggagcagggctctgaaagagggagatggttcttgcaggggcatgattggcagagagattttgtttggggctacacaggtcttgctaacttaggtttgttctgggcttggtgagccttagggcaaagtctctagagctgagagggggctgtctctggtgaatgggcccctgaaagagggtcttaggtttagcaaaccccttggagagttagtggggtcccaggaggggagttctagagagagaccttgggctctgtggctgtttctttaaccgtttcctgagtggccacctccaagcaagttccccaagtcacctcccctctctgggcatctctttctagcacctttctctagagatgaaataataggactaagtagtgacctcccttgaggatgctccttgttctagtttagagcatcccccctttcttctccctcttccttttcctttcctcccctatccctctgcctccctgtccctatccccaccccttgccccccacagcatttcctttacaggctgcacttccttccctgctgccagccaggagtttcggaaggtttcctggaggaagtgtgatacagcaggtttgacagcagctttgggcttaatctgattgggggagggcgttaattgcctccctcccacccattgggaaagtgtccaagtcttaagcaagtatatggattgactgtgctctgtgctgggtccctcctggaaactccatccaggagggagtgaggagattatgggagaagacgtgaacacttagtgcccaatgactgactcaaaatgtatgcagcgggatgcagagcagcgatttttggaaaggcttcccagaaggggtgggatgtgagaaggtagcaggacttagaggagctgatagtgctgccantttaggggcactggaagcagagggggcggctagagatgatctcctgcatgaggctgggagtgtaggaggcaggtcaacctgtgagcagccaaaggtggtgggagggaggtttgtagctgactggcacaaagccttgaatgccaggcaaagatctgtaggaggctactgaatagtcatcagtaggacagggacagcatggccaggagactgctgttttctgaggattattcatagttctgggatttcagggcagaagatggggctaggagtgggatgaggggattggaggtagagcaggagggggaaacttccatcttagcaggttggctctgggcagcaaaaaggaatcaccatttctgtgccagggatgaggggcccatactggtgagcagggagccctggagttagcccnaggactctggcctgatctgaagccaggcttgaccctcgtctgctgccagaggcctcagtctccccactgtgggggcttctgtcctagcttcacaataaggaatggaatacattatagttagggtttcatgaacaaaattcaggtagtaactgctatcttattgataattaaggtgtttccctaggcctacatctttggagggatatgtagcccttatccccattataaaagattatcagttgagcagattgctaattcttctgttttgtagtctaagaactttggtttggccggcgcggtggctcatgcctgtaatcccagcacttggggaggccgaggcgggtggatcacctgaggtcnggagttcgagaccagcctggccaacatggtgaaaccgtgtctctagtaaaaatacaaaaattagccaggcatggtggtgcacgcctgtaatcccagttactagggaagctgaggcaggagaatagttcgaacttgggtggaggaggttgtagttagctgagatcgtgccactgcactccagcctgggcaacagagtgaaactccatctcaaaaaaaaaaaaaaaaagaactttggtttgcagaggccagtgattgctgtcttcccctccaaccccccaccccccatttcaaaggcttcccagaaacaagggcagagaagcctggagccttccatttctgtgaccctagtcttttaccaccctctcaagccccagattctctctgccctaacctttatatacaaacaaggcagctttgccctctgctctggtttctgctctgaattattcatactttgctgcactgacttctctggaactgtaagcagacttttgggagattgtctgggaccagggacaggggttaggctggagcccggttagggagaagactcctcctttgaggcccctatgttctagttgttttctcctctccctctgcttccttgttttcctggaggtctttagtgctggaccacagtctcccactccatgtcccattgtctcaggggaggtagtgcctctttcagtcaccattttaaccaactacatctgaatgtggtcctcattggcatgtggccacctctgaaatcttaaactctagtatttctctctgaccacagtctaactaatgctttatgtgctctgacctcaaggagacctctagttctcagacacctccattttctccatctcatgaattgcctcttccgtgttctttctgaactccatgccctcaaccactttgccactttgcctgtgtgtcacccgagctgccaggaagggtctccagtctcagccatcccttcatcacttatagaaacccctctcctcattcccatcagttcccctttctattccatgggaggagtattccaaactggactactctccccaggccctttgctcatgtagagggtggttggggtgtgtgtgggggaggtggaaccacccccatgttttcccgaggcggagcttgcagtgagccgagatcgcaccactgccctccagcctgggcgacagagcgagactccatctc

SEQ ID NO: 37829 - DNA, 494 bp, Homo sapiens
tatccagctgcactcccaagttgtgttctgctcaagggaccccaggccactgtgagtccagggcaaaggaccacctgagagtactccacggaatggaaaaaaatcacttcaaccataaattcacaaaaagccaggccatgctgccctcaaaatgtaggcaagaacttggaagggctgaaaaggcttttaattcatttttaaactagattaatgtaatatgaagctggaatttcctctctaagattctgcagcccttttctcaccaccctagtagtttccagtccagacaggtcaccatggcagcatgggattaattatttctgtctttcccgttgttttctcaggagcaggcaatgccctcagccatgaacattaaagaagttcagctacacctcccttttcaccacctacaagggtcccataaaaattcactgagagcagaccacccctcgtttttatactgatacacgttccaccattaaaatcctacatta

SEQ ID NO: 37830 - DNA, 232 bp, Homo sapiens
ccatgctgccatggtgacctgtctggactggaaactactagcatgggattaattatttctgtctttcccgttgttttctcaggagcaggcaatgccctcagccatgaacattaaagaagttcagctacacctcccttttcaccacctacaagggtcccataaaaattcactgagagcagaccacccctcgtttttatactgatacacgttccaccattaaaatcctacatta

SEQ ID NO: 37831 - DNA, 297 bp, Homo sapiens
tcctatgacttaaaagtctagaggaggggcagcttcaagtggtgagaggccatcgccagggtgatggtggcaggaattgcaaataaacaggagaagcaagttcctgcctgttcttcctgccttctggtctccctcgagtgccccctatcggcagagtctaacagacctagctggcaaagcacagaagtggttttcagagtctcagcccagcatcacagaactgagtctagaagagagggtttggaattgagagacaatagcttgataactatcacattttcatagaaaatgttattt

SEQ ID NO: 37832 - DNA, 826 bp, Homo sapiens
gcagcgggttgtgtccctggccttttagacctaagcagagagggaatttcaagtcaggtggcgcctgtacagtctatggaataggtagttaatgaggtctggagttgatgttgccttcctctccttctctgatcactttcatgtcactcacccatcccagatgccatggtgttctcaatgccccagttctggggtttcctgccccactccacctttcctttcctgatcctcaagaaaactgacttcttttcctaagccccccgtctccactttgtgaggggcattctgagcatggaggctaatcaatatgttctcagtatccaatggaagcctaacgtgccacctcttccaagggcagtgcattttaactcagacccaacgccccaaccaaatgaaagatctctaatctggaattttcaacaatggggctggtgggtcagggtgcaccagatctcaggaggtttatccagaagactttcaagtgccccaagaggctgagtggtccgccaagtgcctgcatgtgtgcagtcaggaagcttgagtctgggttctgcctggggcaagtcactacaactcccagagcctcatttctgctattcgtaaaatggagaagacacctcctatgatatcaagtcactgacttgttcccaggtgctaaaaaatgaaattacattgcttagccttgaaactgtgcaacctttcaactgctgatgaaaacaacctcagcaagatgaaaatttctccattttcctgaaactattctgcatcataaaattcattgcaggtggtacctttaaaaataaaagacttgtaaaaaatgtttttg

SEQ ID NO: 37833 - DNA, 1097 bp, Homo sapiens
taataattttgtataaagctggaagcccaatgggctgtactccagtgcaaagttgagtgggaagcagactgcctcatagagaggcagcagagaagcctgtgttctcactgatgtcggtggaaagaagcaatccatcttaagcatttgtaaccactgtccaggttacagaccattggaacggctaattatctttcttttgcaaggaggggaggatgcttacatataaacctatctgtgttggcctcctttcacctttttattttcctctctgtctcttctccctcttttttcctctttttcctctcctggggtaagtatggtacctatatattgatgagagactaattttacctggaagataaaactagtatgcatcaaataacatacagatgtatatagatctgcaagaaataattgatagtgtctgttatagtggagattttaacatacttcagtaatttattaggtcagacacacaaaaaaatcagtaaagacttatttttgagtagcagaattaacaagctcaactcaaagattgtacccaatatgaaagcacactcatttcaagcatgcatggaatatttatggagtttgccttgtgctaggccataaaggctaggcttaagaaatttcaaaaggctagtgtcgtataggcattggcaagaggatttcagcggtgggactaactagaaacccaaagaccttaaactccatatagcatgatggaaagtagagggaggagttggtgtgagggaagtgaggggttagtgggagaacaagctggagagttggtagaaccaggagctgcttcacaggaagcagagagcaatagaaagttcctaggctttgaagaatgataaacttgggaatgcctggtctcatgacttactagatgtgtgataggataaattgcttaaattttcttattcatttattaagtatggacagtattacctgtctcacagacttaaagaattgaacaacatttattaagttgttaatatagcactttggatggaaaatcttggcttctgtgatgataagtagggtcccattaaggaaagctcttgtggacactcaacagtacaaccagtagg

SEQ ID NO: 37834 - DNA, 755 bp, Homo sapiens
agcaggtcctgagtgtcaggaattcagattctctgccccactcctgctggataggaggacacttccactagaacctgggcctggcccctttccagttttctgctgggagtccggattctggtgctttgctccgaagcagtgcccgtgggcctccgggcctggctcatcatcacagcttctctgctcagtgaggagaccatcattgtgctgcttttctgatgccttccatttgcctttttctccacttgggaaaaacaaaaaaagctagtatgctacatcctgaaaagttgttaatccttcaccaccacatacattgaaaaatcagttcctgccgggaagtaccactaaaggcatattgtaaactttttttctaattggaaaggtaaacttttttcccccataactatttttcgtgtgaaggaagtaactgacctcttgagtcagagatggcactcgagtttttccccatgggtcttgcctgctacactcctggccaccctttctgtggggcttgaccaaatggaccacactggccagcctgacaaacccaccagaaccaaaagaaaagctggatgtgggaaagggctgaagaactccacgtgtctaaagggcaaagagatcctgggttgagaagaggagtttcagatttccaatggagaaagagaggcggaggttgcagtgagccgagatcgtaacactgcactcgagcctgatgacagtgagaccctgtctccgaaaaaaaaaaaaaaaaaaaa

SEQ ID NO: 37835 - DNA, 468 bp, Homo sapiens
tgattttttcatagcaaacaaaaaagtattaataattagcttggatatagaagaaataaaatgggtgcttacactattctaaaaatgaaagatattttaataatattaggctttaaaagcaaagaaaacaattacaaaaatgcatgcaaataaagaggacagaaaattagaaaattagtatgaaccaccctatggtactgaagtcagagatattaacatggaataattttttaaaatatatgctgagaattgtatgtgtgcacatgaattagcataacatgcatatatttcctagctgtatacactgagagaggctgcaaagtgtgaggccccagtaacagtgagcacacttaatgtccagattttggtttctaaacatcatctttcaaaaaacaataactagaatgccttggagagttcattgattccagggcaggtgcagagaatctgggacaccttgtgtaccag

SEQ ID NO: 37836 - DNA, 389 bp, Homo sapiens
tttaagtctttaatccattgtgagttgagttttgtatttgttgtgagataggatgtaattgcatttttttgcatgtcagtatctagttctcccagcactacttattgaaattactgttcttttcacattgtgttcttggcatctttgtcaaaaatcaattgaccataaaatgggtagattgatttctgggttctttattctgttccattggtctgtgtttttttgctagtgtcatgcagttttggttattactgctttgttttttaaattttttattttgctaaaaaattttttttagaaatggtcttactctgtcacccaggctggagtgcagtggcatgaccatggctcactgtagcctgggcacaagcgatcctctcacctcagcc

SEQ ID NO: 37837 - DNA, 188 bp, Homo sapiens
ggtcagcctggaacccctgccccgtgaacaccagccagcttcatgctgaggacccctcagtccaacccagaggcccatgctgaggtcccggcatgggggactgtggggtgcagccgccgcttggagtggaggtgaatgggaccccacacgtttcctcctcgttctctggatgcctgtaaccatcacag

SEQ ID NO: 37838 - DNA, 432 bp, Homo sapiens
ccagtccttgaactctgacctctacacctcactttcagaacggcacgggagcctgtactaaccagaaactttgcctaggtagtaatacagagctctgtgtcaattgtggaaatccttcaccttttagaattattttcttgtggtaaatatttgtacaattccttttgattttcatcagtgaaaggcacagggtcttgatgtgcctttgagagatccttttccacatattaatgacttcctcatctgcttcctgccaagttttgtactttgggttagaaagaggtcaagacatggatggttagatgaattccttgttacccgagctttgtgtattaatttctcactactccactctggctctagttagtcttttaaagtcagtttgcaacatggtgacaattttgacaggaaagtcaaatttagctaacaacc

SEQ ID NO: 37839 - DNA, 323 bp, Homo sapiens
gtgtctgcgcttctgagatgcaggatgtaatttcccattgcaactcagtatgcatagtagttaagatccttcttattaggtaaatgatatggggcaaggtacttcctctctctgattcttatttctaaaatgagtgtgaaagtatccatttgcaaggattgttaggattcagcgataatacacgaaaagcacccttaacgctgtgctcaattaaatatattgatagtatatattagaatttattatctggggccggacgcggtggcttacgcctgtaatcccaacactttgggaggccaaggtgggcagatcacttgagttca

SEQ ID NO: 37840 - DNA, 223 bp, Homo sapiens
aacaatattagtgagagcctgaattgatttaaccagtttttagagcaatttgacagtatgtcaaaggtgcccttgcgtaggacccagtaattccactcccacagaaacccttgcacacacgaatgggagagaggagcacaggacttgtttataagagccaaaagctgaaagcagattcagtgctcataagcacgagatgggtaagtgtggtatagttgcatcg

SEQ ID NO: 37841 - DNA, 402 bp, Homo sapiens
  misc_feature (175)..(175): n is a, c, g, or t
  misc_feature (315)..(315): n is a, c, g, or t
tcacaccacccagtcagggttcccactcacccactccctaccctgcctcgcttacacacacacactctcccagccaacctggaagtcaagagtggcccaggcatgttgtgtgtattcgtgtgtgtgagtgtgtgtgtgtgcatacgcctgtatgttgtctctgttttggatcgcnagtagaatgcagtatgtaaataagatggttattaccgcaatgttcatcaagctgacccgaaaaaacattaatagcctgatgaatatgcatgtgaatttgttaattaagttaattattctgctgaaaatgcattcgtcttnccaaggacattttcccaatgatttttacatgctctagccattagtcatgctatattttatcagggaaatgagtttgcttaagttgta

SEQ ID NO: 37842 - DNA, 461 bp, Homo sapiens
ttctgtatttttttctttttttgggttaataagcaaaatggaagaagactagcaaaagggtgtgtgcggaggtggggggatgtgtgtgtgaaagagatgttaaataggagtgacatattatgaagcacatatgtacgagttcacataaaaaaatttaattctgtttaccacatactaacacagccaaatgtatgaacaacctgtttttttttcctttgtaccaggaaacttccccacacatagtgattgaacacttttggcattaaccagagttcaattaaagaaaattctctcatttcatccacttctatctcctttgccctaaaaaagaaagctgaatgttaaactactgagtagaaagaaaagccttttagttatcaagaattgtatggttaagtgatttaaatgttttattactttgtgagtagccaagtactaaactgtattttgaaaacaactga

SEQ ID NO: 37843 - DNA, 351 bp, Homo sapiens
taatatgtaatttttgaactaaagttacgttttaaaattgaatagaaaaagaattataaaatgttaagtttaataatttttatataaatataaaagtgtgaaaattattctgatattactcattttgaaaagaacaagaagtaatgagaattttcaaacactgctcctagaagtataaattaatataattctttggcttagtatggcattatctgatgaagatgaaggagcacatcttaagactcagtacaggtactcttaccagaaaatgtatacacacacatgaatatcactgtgttttcatagctaaagttgagaagtttctcaaatgtctatcagtgataaaataga

SEQ ID NO: 37844 - DNA, 229 bp, Homo sapiens
aaaaaatatatatatatatatatatatatatatatatttcactgagccattactacagggaaagttcctgtagagctgagcagtcaagacgtgtgacttcaccaaggaccagcacagagttcaaggctgccttccggctgtttgactgaacaggtgatggcaaggtccttccagcccctgtgggggcgtgatgagggccctgggccagaaccccaccaatgccacggcg

SEQ ID NO: 37845 - DNA, 215 bp, Homo sapiens
gattctttcacttcttgaaagaaataaaataaattaatccattctttcattgtatatttgttttaaatttcagtattgatggttgtctctgtaattccaaaattctagtgggggcattatattataggaccacaataaatatttgttgaattaattaatctgagccactgtatgggtctgataggacacctaactcagtggaattatggttatgc

SEQ ID NO: 37846 - DNA, 436 bp, Homo sapiens
ctgtaatttagtataaagttcctatttcttttcaataattattatataataacaaacgtggatcttctgagaagaaaattattttagaagttttgcaaaatatttagggtttgtttgttgtcattgaaacatgagctttgaaccaaatcttcatttgtctcttagttctgtttttcatgtgaatttgagggagataataaaattttgtgagtcagttcgtctcacaacatttttctgaggattaaatgaagtgaagcagccaactagtaaatggcaaatacttggcaaaaattatttttaaaaccccaggtgttccttctgatctgtgtcttatgttagttttgatctactttattattgtcttaaagtcttttgggtgctaaaattatgtacttctctaagatattttatgaaatgttcctagattaaaaaaaaa

SEQ ID NO: 37847 - DNA, 89 bp, Homo sapiens
gtgaagacagtgcaggagagaggaagggtttgagactttggtggtggacaacctggggtttgaatcccagctctactccttactgacta

SEQ ID NO: 37848 - DNA, 391 bp, Homo sapiens
tctgcttatttttcatttcatctgctcttctttttccagtttcttaaagtggttaagaatgttacttaagtactgcttgagcaacattccacaaatttcgatatgttttcaatttttattcagctcaaaatactttctaattttctactttttagaagtctgttatttagtttccaaatatttggggattcctattagtctttgttattgattcccaatttaattttcagtcagagaacatactcttctgaaaggaaaataaaatcttggcacttcaaattcactatgccaaaagggaaaaattaaccttggaagctgagtcatgaaaaaaagcaaaacgcttgctttttcttttgttcttaaactgatagctatagctagaaggccacat

SEQ ID NO: 37849 - DNA, 557 bp, Homo sapiens
gcagagtggggatcccaaaaatatcattctaagttgctaaatcaagagaagaggttaagatatatcacataaaattgtaaagaaaatgactagaataatttaaaaatagatgtaaagcttgcagttcaccagaacaattattaaacaccagaaatctgtatagtaaagatgaaaagaataaaagaagaaacattatagcagacagtgtcacataggaagagataggatgaggaaaaatgtgtataattggatgcaaattgataaattcatctcttaaaataattcagtttgggggaatgtttaaaaatggtgcagggattctgatatgcctgccccctttgagaatcaggttgtggtgagttactgataacttagtgtttattatttaagagcagaaaaagagagaaccctgtccttcaggaatatctggttcaaccagactgacctagggacggatctccttcacttactttgacctgttactgactatttgatacatgcaagaattactcagcctccaacaatttctctcctgtgaaatccatgtaaatgcagat

SEQ ID NO: 37850 - DNA, 1795 bp, Homo sapiens
aaagcctgcgagcgccagccgagatcgcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaagcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagggctcctgctgaagctaccctttctggactcccccccagactcccagcactacgaggaccaagttcactggcaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactggccccacgtcacacagttacagtgaagcccaagccaggcctggttgagggtgataaacgccactgtctctaagggttc

SEQ ID NO: 37851 - DNA, 1756 bp, Homo sapiens
aaagcctgcgagcgccagccgagatcgcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaagcttccaggacgtgcatgccatggtcttcgtgggctttggcttcctcatggtcttcctgcagcgttacggcttcagcagcgtgggcttcaccttcctcctggccgcctttgccctgcagtggtccacactggtccagggctttctccactccttccacggtggccacatccatgttggcgtggagagcatgatcaatgctgacttttgtgcgggggccgtgctcatctcctttggtgccgtcctgggcaagaccgggcctacccagctgctgctcatggccctgctggaggtggtgctgtttggcatcaatgagtttgtgctccttcatctcctgggggtgagagatgccggaggctccatgactatccacacctttggtgcctacttcgggctcgtcctttcgcgggttctgtacaggccccagctggagaagagcaagcaccgccagggctccgtctaccattcagacctcttcgccatgattgggaccatcttcctgtggatcttctggcctagcttcaatgctgcactcacagcgctgggggctgggcagcatcggacggccctcaacacatactactccctggctgccagcacccttggcacctttgccttgtcagcccttgtaggggaagatgggaggcttgacatggtccacatccaaaatgcagcgctggctggaggggttgtggtggggacctcaagtgaaatgatgctgacaccctttggggctctggcagctggcttcttggctgggactgtctccacgctggggtacaagttcttcacgcccatccttgaatcaaaattcaaagtccaagacacatgtggagtccacaacctccatgggatgccgggggtcctgggggccctcctgggggtccttgtggctggacttgccacccatgaagcttacggagatggcctggagagtgtgtttccactcatagccgagggccagcgcagtgccacgtcacaggccatgcaccagctcttcgggctgtttgtcacactgatgtttgcctctgtgggcgggggccttggagactcccagcactacgaggaccaagttcactggcaggtgcctggcgagcatgaggataaagcccagagacctctgagggtggaggaggcagacactcaggcctaacccactgccagcccctgagaggacacgctccttttcgaagatgctgactggctgctactaggaagttctttttgagctcccattcctccagctgcaagaagggagccatgagccagaaggaggcccctttccacaggcagcgtctccacagggagaggggcaacaggaggctgggaaatggtggggagtggggccgtaactgggtacaatagggggaacctcaccagatgcccaacccgactgccctaccagcctgcacatgggtagaagaggccaaattgaggcacccaagtgatccactggccccacgtcacacagttacagtgaagcccaagccaggcctggttgagggtgataaacgccactgtctctaagggttc

SEQ ID NO: 37852 - DNA, 923 bp, Homo sapiens
aaagcctgcgagcgccagccgagatcgcagcccaacccatggccgggtctcctagccgcgccgcgggccggcgactgcagcttcccctgctgtgcctcttcctccagggcgccactgccgtcctctttgctgtctttgtccgctacaaccacaaaaccgacgctgccctctggcaccggagcaaccacagtaacgcggacaatgaattttactttcgctacccaaaagagtctcactctgttgcccaggctggagtgcaacggcgcaatctcggctcactgcaaccttcacctcccaggttcaagcgattcacccccctcagcctcccgagaagctgggattacaggcacccaccaaaacacctagataagttttgtatttttagtagagatgaggtttcgccatgttggccaggctggtcttgaattcctgacctcaggtgatccacccacctcggcctcccaatgtgctgggattacaggtgtgagccactgcacctggccctattaccctactttctgtatgcagagctcatcagcaggctatccccacctcaccctgttctagacccaacaaaatgaagctcaaaatgctaaggatatagagagtgaggtggaaacttggacttgggtgtgaagcaccagagcccccacccaccctaggcagaaggggctacagctcctccctccccatatttcatccacagccctggctagaaaagaaggatagagagttgggagggaacagtccagagtctgacagaactaagctgttgcgtaagggtctgacctggctgcttgccatgaacccctgacttgcttctcctcgaagcctccttattacaaagctttccctggagtccagcctcttgcccctgtgctgcaatggtaggctctccttggacatacagcatttcatccctg

SEQ ID NO: 37853 - DNA, 2436 bp, Homo sapiens
gagagtgccccgcccacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccagcccctcatatggaaaatttgaaatgcagaggggaaacagtagcaaaggagatcagtgaagccatgaagtccttgcctgcattaattgaacaaggagagggattttcccaagttctcaggatgcagcctgttatccacctccagaggattcaccaagaagtcttttccagttgtcataggaaaccagatgctaaacctgagaactttataacacagatagaaaccacaccaacagagactgcttccaggaaaacctctgacgtggtactgaaaagaaagcaaactaaagactgcccccagagaaaatggtatccattgcggccaaagaaaattaatcttgatacatgagctctttctgtttattttgggagttgaaaataggcaccatcaacatttagattacagcctaattaatacctagataagacttcatttgaaataagaaataactcttttactagtgattcatttatacagatatagtatctctgtgcggggatatgatataatattgtatttccttactgttttatctattgtaaataaaaagcattttaaaaagtattgacacaaagcccatcagtgggcattaaaaatattaaaagtgcagacttttactgtccttaagtgccatcaactctcagctcccttgtagcttttgtgggatttaacaagtaacaaattctgttgtgtttccctggtatacatctttctaggaaaaaaaaaaaaagagagagagctgtataatgatttttcgtttacatgctgaaaagtaattatcagttctgcacagcagcagatgcagggtttttttttaaagatgtagtttgatttatcaaattaatgtgctgatgataatactggctttgactttgttactccatgttcagctaatttaggtttgtgagattaactttaggattttttgttgtgtaagacaatgataactattatttgtgcaacattactctttgaaataaaaattggcatgtagccaatgtttcctgcccacactcacttttttctatagaccattaacataatttgacttggaactaatggtttctttttagggtttcttatttatttctttacaaatcattccagttcaaaatatatatcagattaatacactgaaaaaaaagtgtcattgtgttattgaactattttacatttgaagatgtttatatatcaggtatataatcactgggagaagtctgagaaaacgatattggctttacttctaacatttaactatagtttcttatagctcttattgtgtgtcttacattatacagtgtaggcagggccatcaaacttaccaactgtttccccttttgatgactctgataccttcattcatttttcaaaggaatttactgatcatgaggttggaaaatctgtatttctcttgcttattatgtattaataatcataaatgtctagattcaccagaagtcaccagaaggtctgtctcagtgaagaaaacttataaagccactttgttgcattttgtgtttcagtgttacagtttgagatctgtatatttgtacacagctatgtgtttttcattgaaataatgtacaaagactgatcttgatgctgtgtatttttatgagttgtcttaggcattcctgagctcagcttcagttggatggtgggtcagcaccctgcgtttctgaacatactagacttcagtttaaaactgttttgaggctgtataatatgttgctgtttttacagtgctaatgtttttatagtattaaaattctgtatgatttgtttcacttcagaggtccccaaacaaaagagttattgttaattctattagattatataagctacttgcattttgattatataagaacatggtccctcccttttaagagaggtatattgtgctacat

SEQ ID NO: 37854 - DNA, 775 bp, Homo sapiens
gagagtgccccgcccacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccaggagccaagcctggtggactagctctaggggcagtctaggagagaaggggatcggggaaccttcatcccttctgcctctggtgaactgcgcaagatgaagaggatgaagctgggtgacccagagcccgccctccctctctcggcagtcatctccaaggccggagtagactggactggagggcctctgagaggacacagccaggaagcacactctccctgtgctcttcacccaccatgaagagacag

SEQ ID NO: 37855 - DNA, 698 bp, Homo sapiens
gagagtgccccgcccacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccagttctcaacgggaatgctttcaacttttccccattcaacatgatgttggctgtggatttgtcatatatggtttttattacttcgagcccagcccccgatatggaattcctcgtaatccctcggggaaactccctcttcggatattcaccgtgccctgtatcacttgcct

SEQ ID NO: 37856 - DNA, 1586 bp, Homo sapiens
gagagtgccccgcccacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccagcccctcatatggaaaatttgaaatgcagaggggaaacagtagcaaaggagatcagtgaagccatgaagtccttgcctgcattaattgaacaaggagagggattttcccaagttctcaggatgcagcctgttatccacctccagaggattcaccaagaagtcttttccagttgtcataggaaaccagatgctaaacctgagaactttataacacagatagaaaccacaccaacagagactgcttccaggaaaacctctgacgtggtactgaaaagaaagcaaactaaagactgcccccagagaaaatggtatccattgcggccaaagaaaattaatcttgatacatgagctctttctgtttattttgggagttgaaaataggcaccatcaacatttagattacagcctaattaatacctagataagacttcatttgaaataagaaataactcttttactagtgattcatttatacagatatagtatctctgtgcggggatatgatataatattgtatttccttactgttttatctattgtaaataaaaagcattttaaaaagtattgacacaaagcccatcagtgggcattaaaaatattaaaagtgcagacttttactgtccttaagtgccatcaactctcagctcccttgtagcttttgtgggatttaacaagtaacaaattctgttgtgtttccctggtatacatctttctaggaaaaaaaaaaaaagagagagagctgtataatgatttttcgtttacatgctgaaaagtaattatcagttctgcacagcagcagatgcagggtttttttttaaagatgtagtttgatttatcaaattaatgtgctgatgggagaagactggatcagtcccatcaaaccactcattgtgtgacacgtcttggactgccgtttttataaccagcaagaggtcaatgtatagaaatccgctgatgggagaagatgcgcgcatcttctcccatcaggatggctactatcaacatcaaacaataatatgttttggtgaggacgtggaaaaattggaacccttgtgct

SEQ ID NO: 37857 - DNA, 2382 bp, Homo sapiens
gagagtgccccgcccacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccagcccctcatatggaaaatttgaaatgcagaggggaaacagtagcaaaggagatcagtgaagccatgaagtccttgcctgcattaattgaacaaggagagggattttcccaagttctcaggatgcagcctgttatccacctccagaggattcaccaagaagtcttttccagttgtcataggaaaccagatgctaaacctgagaactttataacacagatagaaaccacaccaacagagactgcttccaggaaaacctctgacgtggtactgaaaagaaagcaaactaaagactgcccccagagaaaatggtatccattgcggccaaagaaaattaatcttgatacatgagctctttctgtttattttgggagttgttcatttgaaataagaaataactcttttactagtgattcatttatacagatatagtatctctgtgcggggatatgatataatattgtatttccttactgttttatctattgtaaataaaaagcattttaaaaagtattgacacaaagcccatcagtgggcattaaaaatattaaaagtgcagacttttactgtccttaagtgccatcaactctcagctcccttgtagcttttgtgggatttaacaagtaacaaattctgttgtgtttccctggtatacatctttctaggaaaaaaaaaaaaagagagagagctgtataatgatttttcgtttacatgctgaaaagtaattatcagttctgcacagcagcagatgcagggtttttttttaaagatgtagtttgatttatcaaattaatgtgctgatgataatactggctttgactttgttactccatgttcagctaatttaggtttgtgagattaactttaggattttttgttgtgtaagacaatgataactattatttgtgcaacattactctttgaaataaaaattggcatgtagccaatgtttcctgcccacactcacttttttctatagaccattaacataatttgacttggaactaatggtttctttttagggtttcttatttatttctttacaaatcattccagttcaaaatatatatcagattaatacactgaaaaaaaagtgtcattgtgttattgaactattttacatttgaagatgtttatatatcaggtatataatcactgggagaagtctgagaaaacgatattggctttacttctaacatttaactatagtttcttatagctcttattgtgtgtcttacattatacagtgtaggcagggccatcaaacttaccaactgtttccccttttgatgactctgataccttcattcatttttcaaaggaatttactgatcatgaggttggaaaatctgtatttctcttgcttattatgtattaataatcataaatgtctagattcaccagaagtcaccagaaggtctgtctcagtgaagaaaacttataaagccactttgttgcattttgtgtttcagtgttacagtttgagatctgtatatttgtacacagctatgtgtttttcattgaaataatgtacaaagactgatcttgatgctgtgtatttttatgagttgtcttaggcattcctgagctcagcttcagttggatggtgggtcagcaccctgcgtttctgaacatactagacttcagtttaaaactgttttgaggctgtataatatgttgctgtttttacagtgctaatgtttttatagtattaaaattctgtatgatttgtttcacttcagaggtccccaaacaaaagagttattgttaattctattagattatataagctacttgcattttgattatataagaacatggtccctcccttttaagagaggtatattgtgctacat

SEQ ID NO: 37858 - DNA, 2521 bp, Homo sapiens
gagagtgccccgcccacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccagttctcaacgggaatgctttcaacttttccccattcaacatgatgttggctgtggatttgtcatatatggtttttattacttcgagcccctcatatggaaaatttgaaatgcagaggggaaacagtagcaaaggagatcagtgaagccatgaagtccttgcctgcattaattgaacaaggagagggattttcccaagttctcaggatgcagcctgttatccacctccagaggattcaccaagaagtcttttccagttgtcataggaaaccagatgctaaacctgagaactttataacacagatagaaaccacaccaacagagactgcttccaggaaaacctctgacgtggtactgaaaagaaagcaaactaaagactgcccccagagaaaatggtatccattgcggccaaagaaaattaatcttgatacatgagctctttctgtttattttgggagttgaaaataggcaccatcaacatttagattacagcctaattaatacctagataagacttcatttgaaataagaaataactcttttactagtgattcatttatacagatatagtatctctgtgcggggatatgatataatattgtatttccttactgttttatctattgtaaataaaaagcattttaaaaagtattgacacaaagcccatcagtgggcattaaaaatattaaaagtgcagacttttactgtccttaagtgccatcaactctcagctcccttgtagcttttgtgggatttaacaagtaacaaattctgttgtgtttccctggtatacatctttctaggaaaaaaaaaaaaagagagagagctgtataatgatttttcgtttacatgctgaaaagtaattatcagttctgcacagcagcagatgcagggtttttttttaaagatgtagtttgatttatcaaattaatgtgctgatgataatactggctttgactttgttactccatgttcagctaatttaggtttgtgagattaactttaggattttttgttgtgtaagacaatgataactattatttgtgcaacattactctttgaaataaaaattggcatgtagccaatgtttcctgcccacactcacttttttctatagaccattaacataatttgacttggaactaatggtttctttttagggtttcttatttatttctttacaaatcattccagttcaaaatatatatcagattaatacactgaaaaaaaagtgtcattgtgttattgaactattttacatttgaagatgtttatatatcaggtatataatcactgggagaagtctgagaaaacgatattggctttacttctaacatttaactatagtttcttatagctcttattgtgtgtcttacattatacagtgtaggcagggccatcaaacttaccaactgtttccccttttgatgactctgataccttcattcatttttcaaaggaatttactgatcatgaggttggaaaatctgtatttctcttgcttattatgtattaataatcataaatgtctagattcaccagaagtcaccagaaggtctgtctcagtgaagaaaacttataaagccactttgttgcattttgtgtttcagtgttacagtttgagatctgtatatttgtacacagctatgtgtttttcattgaaataatgtacaaagactgatcttgatgctgtgtatttttatgagttgtcttaggcattcctgagctcagcttcagttggatggtgggtcagcaccctgcgtttctgaacatactagacttcagtttaaaactgttttgaggctgtataatatgttgctgtttttacagtgctaatgtttttatagtattaaaattctgtatgatttgtttcacttcagaggtccccaaacaaaagagttattgttaattctattagattatataagctacttgcattttgattatataagaacatggtccctcccttttaagagaggtatattgtgctacat

SEQ ID NO: 37859 - DNA, 2196 bp, Homo sapiens
cttgactactgtgaatttattgcagacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccagcccctcatatggaaaatttgaaatgcagaggggaaacagtagcaaaggagatcagtgaagccatgaagtccttgcctgcattaattgaacaaggagagggattttcccaagttctcaggatgcagcctgttatccacctccagaggattcaccaagaagtcttttccagttgtcataggaaaccagatgctaaacctgagaactttataacacagatagaaaccacaccaacagagactgcttccaggaaaacctctgacgtggtactgaaaagaaagcaaactaaagactgcccccagagaaaatggtatccattgcggccaaagaaaattaatcttgatacatgagctctttctgtttattttgggagttgaaaataggcaccatcaacatttagattacagcctaattaatacctagataagacttcatttgaaataagaaataactcttttactagtgattcatttatacagatatagtatctctgtgcggggatatgatataatattgtatttccttactgttttatctattgtaaataaaaagcattttaaaaagtattgacacaaagcccatcagtgggcattaaaaatattaaaagtgcagacttttactgtccttaagtgccatcaactctcagctcccttgtagcttttgtgggatttaacaagtaacaaattctgttgtgtttccctggtatacatctttctaggaaaaaaaaaaaaagagagagagctgtataatgatttttcgtttacatgctgaaaagtaattatcagttctgcacagcagcagatgcagggtttttttttaaagatgtagtttgatttatcaaattaatgtgctgatgataatactggctttgactttgttactccatgttcagctaatttaggtttgtgagattaactttaggattttttgttgtgtaagacaatgataactattatttgtgcaacattactctttgaaataaaaattggcatgtagccaatgtttcctgcccacactcacttttttctatagaccattaacataatttgacttggaactaatggtttctttttagggtttcttatttatttctttacaaatcattccagttcaaaatatatatcagattaatacactgaaaaaaaagtgtcattgtgttattgaactattttacatttgaagatgtttatatatcaggtatataatcactgggagaagtctgagaaaacgatattggctttacttctaacatttaactatagtttcttatagctcttattgtgtgtcttacattatacagtgtaggcagggccatcaaacttaccaactgtttccccttttgatgactctgataccttcattcatttttcaaaggaatttactgatcatgaggttggaaaatctgtatttctcttgcttattatgtattaataatcataaatgtctagattcaccagaagtcaccagaaggtctgtctcagtgaagaaaacttataaagccactttgttgcattttgtgtttcagtgttacagtttgagatctgtatatttgtacacagctatgtgtttttcattgaaataatgtacaaagactgatcttgatgctgtgtatttttatgagttgtcttaggcattcctgagctcagcttcagttggatggtgggtcagcaccctgcgtttctgaacatactagacttcagtttaaaactgttttgaggctgtataatatgttgctgtttttacagtgctaatgtttttatagtattaaaattctgtatgatttgtttcacttcagaggtccccaaacaaaagagttattgttaattctattagattatataagctacttgcattttgattatataagaacatggtccctcccttttaagagaggtatattgtgctacat

SEQ ID NO: 37860 - DNA, 2357 bp, Homo sapiens
gagagtgccccgcccacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccagcccctcatatggaaaatttgaaatgcagaggggaaacagtagcaaaggagatcagtgaagccatgaagtccttgcctgcattaattgaacaaggagagggattttcccaagttctcaggatgcagcctgttatccacctccagaggattcaccaagaagtcttttccagttgtcataggaaaccagatgctaaacctgagaactttataacacagatagaaaccacaccaacagagactgcttccaggaaaacctctgacgtggtactgaaaagaaagcaaactaaagactgcccccagagaaaatggtatccattgcggccaaagaaaattaatcttgatacatgagctctttctgtttattttgggagttgaaaataggcaccatcaacatttagattacagcctaattaatacctagataagacttcatttgaaataagaaataactcttttactagtgattcatttatacagatatagtatctctgtgcggggatatgatataatattgtatttccttactgttttatctattgtaaataaaaagcattttaaaaagtattgacacaaagcccatcagtgggcattaaaaatattaaaagtgcagacttttactgtccttaagtgccatcaactctcagctcccttgtagcttttgtgggatttaacaagtaacaaattctgttgtgtttccctggtatacatctttctaggaaaaaaaaaaaaagagagagagctgtataatgatttttcgtttacatgctgaaaagtaattatcagttctgcacagcagcagatgcagggtttttttttaaagatgtagtttgatttatcaaattaatgtgctgatgataatactggctttgactttgttactccatgttcagctaatttaggtttgtgagattaactttaggattttttgttgtgtaagacaatgataactattatttgtgcaacattactctttgaaataaaaattggcatgtagccaatgtttcctgcccacactcacttttttctatagaccattaacataatttgacttggaactaatggtttctttttagggtttcttatttatttctttacaaatcattccagttcaaaatatatatcagattaatacactgaaaaaaaagtgtcattgtgttattgaactattttacatttgaagatgtttatatatcaggtatataatcactgggagaagtctgagaaaacgatattggctttacttctaacatttaactatagtttcttatagctcttattgtgtgtcttacattatacagtgtaggcagggccatcaaacttaccaactgtttccccttttgatgactctgataccttcattcatttttcaaaggaatttactgatcatgaggttggaaaatctgtatttctcttgcttattatgtattaataatcataaatgtctagattcaccagaagtcaccagaaggtctgtctcagtgaagaaaacttataaagccactttgttgcattttgtgtttcagtgttacagtttgagatctgtatatttgtacacagctatgtgtttttcattgaaataatgtacaaagactgatcttgatgctgtgtatttttatgagttgtcttaggcattcctgagctcagcttcagttggatggtgggtcagcaccctgcgtttctgaacatactagacttcagtttaaaactgttttgaggctgtataatatgttgctgtttttacagtgctaatgtttttatagtattaaaattctgtatgatttgtttcacttcagaggtccccaaacaaaagagttattgttaattctattagattatataagctacttgcattttgattatataagaacatggtccctcccttttaagagaggtatattgtgctacat

SEQ ID NO: 37861 - DNA, 2601 bp, Homo sapiens
gagagtgccccgcccacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtgggtacgggaccagttagccagttctttactcatcatcctcttacccaacacccaggatcttaggattcagaaagatcccacgccaggccttggcagaattaacggtgccccaggctactgtagaaccagttcgagaaacgctagaggagaaagaaatagatgctaatgtcagctgggtcttattaattacttagaccagcgctgtccagtgaaaatacaagacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgcccctcatatggaaaatttgaaatgcagaggggaaacagtagcaaaggagatcagtgaagccatgaagtccttgcctgcattaattgaacaaggagagggattttcccaagttctcaggatgcagcctgttatccacctccagaggattcaccaagaagtcttttccagttgtcataggaaaccagatgctaaacctgagaactttataacacagatagaaaccacaccaacagagactgcttccaggaaaacctctgacgtggtactgaaaagaaagcaaactaaagactgcccccagagaaaatggtatccattgcggccaaagaaaattaatcttgatacatgagctctttctgtttattttgggagttgaaaataggcaccatcaacatttagattacagcctaattaatacctagataagacttcatttgaaataagaaataactcttttactagtgattcatttatacagatatagtatctctgtgcggggatatgatataatattgtatttccttactgttttatctattgtaaataaaaagcattttaaaaagtattgacacaaagcccatcagtgggcattaaaaatattaaaagtgcagacttttactgtccttaagtgccatcaactctcagctcccttgtagcttttgtgggatttaacaagtaacaaattctgttgtgtttccctggtatacatctttctaggaaaaaaaaaaaaagagagagagctgtataatgatttttcgtttacatgctgaaaagtaattatcagttctgcacagcagcagatgcagggtttttttttaaagatgtagtttgatttatcaaattaatgtgctgatgataatactggctttgactttgttactccatgttcagctaatttaggtttgtgagattaactttaggattttttgttgtgtaagacaatgataactattatttgtgcaacattactctttgaaataaaaattggcatgtagccaatgtttcctgcccacactcacttttttctatagaccattaacataatttgacttggaactaatggtttctttttagggtttcttatttatttctttacaaatcattccagttcaaaatatatatcagattaatacactgaaaaaaaagtgtcattgtgttattgaactattttacatttgaagatgtttatatatcaggtatataatcactgggagaagtctgagaaaacgatattggctttacttctaacatttaactatagtttcttatagctcttattgtgtgtcttacattatacagtgtaggcagggccatcaaacttaccaactgtttccccttttgatgactctgataccttcattcatttttcaaaggaatttactgatcatgaggttggaaaatctgtatttctcttgcttattatgtattaataatcataaatgtctagattcaccagaagtcaccagaaggtctgtctcagtgaagaaaacttataaagccactttgttgcattttgtgtttcagtgttacagtttgagatctgtatatttgtacacagctatgtgtttttcattgaaataatgtacaaagactgatcttgatgctgtgtatttttatgagttgtcttaggcattcctgagctcagcttcagttggatggtgggtcagcaccctgcgtttctgaacatactagacttcagtttaaaactgttttgaggctgtataatatgttgctgtttttacagtgctaatgtttttatagtattaaaattctgtatgatttgtttcacttcagaggtccccaaacaaaagagttattgttaattctattagattatataagctacttgcattttgattatataagaacatggtccctcccttttaagagaggtatattgtgctacat

SEQ ID NO: 37862 - DNA, 2030 bp, Homo sapiens
tttcttgagaagtcttgctttgttgcccaggctggagggcagtggtgtgatctcagctcatgccctccagcctgggcaacaaagcaagacttctcaagaaaaaaaaaaaaaattagagtactgcatccatctttgtctgtttgtgtttcaacctgagattaatgttgaatattactgtttgtttgtttgaagtccttgcctgcattaattgaacaaggagagggattttcccaagttctcaggatgcagcctgttatccacctccagaggattcaccaagaagtcttttccagttgtcataggaaaccagatgctaaacctgagaactttataacacagatagaaaccacaccaacagagactgcttccaggaaaacctctgacgtggtactgaaaagaaagcaaactaaagactgcccccagagaaaatggtatccattgcggccaaagaaaattaatcttgatacatgagctctttctgtttattttgggagttgaaaataggcaccatcaacatttagattacagcctaattaatacctagataagacttcatttgaaataagaaataactcttttactagtgattcatttatacagatatagtatctctgtgcggggatatgatataatattgtatttccttactgttttatctattgtaaataaaaagcattttaaaaagtattgacacaaagcccatcagtgggcattaaaaatattaaaagtgcagacttttactgtccttaagtgccatcaactctcagctcccttgtagcttttgtgggatttaacaagtaacaaattctgttgtgtttccctggtatacatctttctaggaaaaaaaaaaaaagagagagagctgtataatgatttttcgtttacatgctgaaaagtaattatcagttctgcacagcagcagatgcagggtttttttttaaagatgtagtttgatttatcaaattaatgtgctgatgataatactggctttgactttgttactccatgttcagctaatttaggtttgtgagattaactttaggattttttgttgtgtaagacaatgataactattatttgtgcaacattactctttgaaataaaaattggcatgtagccaatgtttcctgcccacactcacttttttctatagaccattaacataatttgacttggaactaatggtttctttttagggtttcttatttatttctttacaaatcattccagttcaaaatatatatcagattaatacactgaaaaaaaagtgtcattgtgttattgaactattttacatttgaagatgtttatatatcaggtatataatcactgggagaagtctgagaaaacgatattggctttacttctaacatttaactatagtttcttatagctcttattgtgtgtcttacattatacagtgtaggcagggccatcaaacttaccaactgtttccccttttgatgactctgataccttcattcatttttcaaaggaatttactgatcatgaggttggaaaatctgtatttctcttgcttattatgtattaataatcataaatgtctagattcaccagaagtcaccagaaggtctgtctcagtgaagaaaacttataaagccactttgttgcattttgtgtttcagtgttacagtttgagatctgtatatttgtacacagctatgtgtttttcattgaaataatgtacaaagactgatcttgatgctgtgtatttttatgagttgtcttaggcattcctgagctcagcttcagttggatggtgggtcagcaccctgcgtttctgaacatactagacttcagtttaaaactgttttgaggctgtataatatgttgctgtttttacagtgctaatgtttttatagtattaaaattctgtatgatttgtttcacttcagaggtccccaaacaaaagagttattgttaattctattagattatataagctacttgcattttgattatataagaacatggtccctcccttttaagagaggtatattgtgctacat

SEQ ID NO: 37863 - DNA, 1541 bp, Homo sapiens
gagagtgccccgcccacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccagcccctcatatggaaaatttgaaatgcagaggggaaacagtagcaaaggagatcagtgaagccatgaagtccttgcctgcattaattgaacaaggagagggattttcccaagttctcaggatgcagcctgttatccacctccagaggattcaccaagaagtcttttccagttgtcataggaaaccagatgctaaacctgagaactttataacacagatagaaaccacaccaacagagactgcttccaggaaaacctctgacgtggtactgaaaagaaagcaaactaaagactgcccccagagaaaatggtatccattgcggccaaagaaaattaatcttgatacatgagctctttctgtttattttgggagttgaaaataggcaccatcaacatttagattacagcctaattaatacctagataagacttcatttgaaataagaaataactcttttactagtgattcatttatacagatatagtatctctgtgcggggatatgatataatattgtatttccttactgttttatctattgtaaataaaaagcattttaaaaagtattgacacaaagcccatcagtgggcattaaaaatattaaaagtgcagacttttactgtccttaagtgccatcaactctcagctcccttgtagcttttgtgggatttaacaagtaacaaattctgttgtgtttccctggtatacatctttctaggaaaaaaaaaaaaagagagagagctgtataatgatttttcgtttacatgctgaaaagtaattatcagttctgcacagcagcagatgcagggtttttttttaaagatgtagtttgatttatcaaattaatgtgctgatgataatactggctttgactttgttactccatgttcagctaatttaggtttgtgagattaactttaggattttttgttgtgtaagacaatgataactattatttgtgcaacattactctttgaaataaaaattggcatgtagccaatgtttcctgcccac

SEQ ID NO: 37864 - DNA, 698 bp, Homo sapiens
gagagtgccccgcccacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctggtaagatgatttgcctttaaaatgttatagtatattttaccacaataaaaacattaaacatataaggctctacgtggagataagtgacattttgttgtctttttctttcctgcctcaattagtattgtttgtctcttgtaagactttactcttctaagttgtactatgacatagtatagtcatactatactgtgttttgaacacactggttcaaaaatgaaaa

SEQ ID NO: 37865 - DNA, 1011 bp, Homo sapiens
gagagtgccccgcccacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccagcccctcatatggaaaatttgaaatgcagaggggaaacagtagcaaaggagatcagtgaagccatgaagtccttgcctgcattaattgaacaaggagagggattttcccaagttctcaggatgcagcctgttatccacctccagaggattcaccaagaagtcttttccagttgtcataggaaaccagatgctaaacctgagaactttataacacagatagaaaccacaccaacagagactgcttccaggaaaacctctgacgtggtactgaaaagaaagcaaactaaagactgcccccagagaaaatggtatccattgcggccaaagaaaattaatcttgatacatgagctctttctgtttattttgggagttgtaccttgggccaccacaattctcaatacacgacacatataacctacaataaactcattggcaaaaaaataccttttcaaacaacacataacgaaatcccgtcgggagc

SEQ ID NO: 37866 - DNA, 2656 bp, Homo sapiens
gagagtgccccgcccacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtgggtacgggaccagttagccagttctttactcatcatcctcttacccaacacccaggatcttaggattcagaaagatcccacgccaggccttggcagaattaacggtgccccaggctactgtagaaccagttcgagaaacgctagaggagaaagaaatagatgctaatgtcagctgggtcttattaattacttagaccagcgctgtccagtgaaaatacaagacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccagcccctcatatggaaaatttgaaatgcagaggggaaacagtagcaaaggagatcagtgaagccatgaagtccttgcctgcattaattgaacaaggagagggattttcccaagttctcaggatgcagcctgttatccacctccagaggattcaccaagaagtcttttccagttgtcataggaaaccagatgctaaacctgagaactttataacacagatagaaaccacaccaacagagactgcttccaggaaaacctctgacgtggtactgaaaagaaagcaaactaaagactgcccccagagaaaatggtatccattgcggccaaagaaaattaatcttgatacatgagctctttctgtttattttgggagttgaaaataggcaccatcaacatttagattacagcctaattaatacctagataagacttcatttgaaataagaaataactcttttactagtgattcatttatacagatatagtatctctgtgcggggatatgatataatattgtatttccttactgttttatctattgtaaataaaaagcattttaaaaagtattgacacaaagcccatcagtgggcattaaaaatattaaaagtgcagacttttactgtccttaagtgccatcaactctcagctcccttgtagcttttgtgggatttaacaagtaacaaattctgttgtgtttccctggtatacatctttctaggaaaaaaaaaaaaagagagagagctgtataatgatttttcgtttacatgctgaaaagtaattatcagttctgcacagcagcagatgcagggtttttttttaaagatgtagtttgatttatcaaattaatgtgctgatgataatactggctttgactttgttactccatgttcagctaatttaggtttgtgagattaactttaggattttttgttgtgtaagacaatgataactattatttgtgcaacattactctttgaaataaaaattggcatgtagccaatgtttcctgcccacactcacttttttctatagaccattaacataatttgacttggaactaatggtttctttttagggtttcttatttatttctttacaaatcattccagttcaaaatatatatcagattaatacactgaaaaaaaagtgtcattgtgttattgaactattttacatttgaagatgtttatatatcaggtatataatcactgggagaagtctgagaaaacgatattggctttacttctaacatttaactatagtttcttatagctcttattgtgtgtcttacattatacagtgtaggcagggccatcaaacttaccaactgtttccccttttgatgactctgataccttcattcatttttcaaaggaatttactgatcatgaggttggaaaatctgtatttctcttgcttattatgtattaataatcataaatgtctagattcaccagaagtcaccagaaggtctgtctcagtgaagaaaacttataaagccactttgttgcattttgtgtttcagtgttacagtttgagatctgtatatttgtacacagctatgtgtttttcattgaaataatgtacaaagactgatcttgatgctgtgtatttttatgagttgtcttaggcattcctgagctcagcttcagttggatggtgggtcagcaccctgcgtttctgaacatactagacttcagtttaaaactgttttgaggctgtataatatgttgctgtttttacagtgctaatgtttttatagtattaaaattctgtatgatttgtttcacttcagaggtccccaaacaaaagagttattgttaattctattagattatataagctacttgcattttgattatataagaacatggtccctcccttttaagagaggtatattgtgctacat

SEQ ID NO: 37867 - DNA, 2368 bp, Homo sapiens
gagagtgccccgcccacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgaagcagtaccaccctgttgtacatccactggacctaaaatatgaccctgatccagtccttgcctgcattaattgaacaaggagagggattttcccaagttctcaggatgcagcctgttatccacctccagaggattcaccaagaagtcttttccagttgtcataggaaaccagatgctaaacctgagaactttataacacagatagaaaccacaccaacagagactgcttccaggaaaacctctgacgtggtactgaaaagaaagcaaactaaagactgcccccagagaaaatggtatccattgcggccaaagaaaattaatcttgatacatgagctctttctgtttattttgggagttgaaaataggcaccatcaacatttagattacagcctaattaatacctagataagacttcatttgaaataagaaataactcttttactagtgattcatttatacagatatagtatctctgtgcggggatatgatataatattgtatttccttactgttttatctattgtaaataaaaagcattttaaaaagtattgacacaaagcccatcagtgggcattaaaaatattaaaagtgcagacttttactgtccttaagtgccatcaactctcagctcccttgtagcttttgtgggatttaacaagtaacaaattctgttgtgtttccctggtatacatctttctaggaaaaaaaaaaaaagagagagagctgtataatgatttttcgtttacatgctgaaaagtaattatcagttctgcacagcagcagatgcagggtttttttttaaagatgtagtttgatttatcaaattaatgtgctgatgataatactggctttgactttgttactccatgttcagctaatttaggtttgtgagattaactttaggattttttgttgtgtaagacaatgataactattatttgtgcaacattactctttgaaataaaaattggcatgtagccaatgtttcctgcccacactcacttttttctatagaccattaacataatttgacttggaactaatggtttctttttagggtttcttatttatttctttacaaatcattccagttcaaaatatatatcagattaatacactgaaaaaaaagtgtcattgtgttattgaactattttacatttgaagatgtttatatatcaggtatataatcactgggagaagtctgagaaaacgatattggctttacttctaacatttaactatagtttcttatagctcttattgtgtgtcttacattatacagtgtaggcagggccatcaaacttaccaactgtttccccttttgatgactctgataccttcattcatttttcaaaggaatttactgatcatgaggttggaaaatctgtatttctcttgcttattatgtattaataatcataaatgtctagattcaccagaagtcaccagaaggtctgtctcagtgaagaaaacttataaagccactttgttgcattttgtgtttcagtgttacagtttgagatctgtatatttgtacacagctatgtgtttttcattgaaataatgtacaaagactgatcttgatgctgtgtatttttatgagttgtcttaggcattcctgagctcagcttcagttggatggtgggtcagcaccctgcgtttctgaacatactagacttcagtttaaaactgttttgaggctgtataatatgttgctgtttttacagtgctaatgtttttatagtattaaaattctgtatgatttgtttcacttcagaggtccccaaacaaaagagttattgttaattctattagattatataagctacttgcattttgattatataagaacatggtccctcccttttaagagaggtatattgtgctacat

SEQ ID NO: 37868 - DNA, 2313 bp, Homo sapiens
gagagtgccccgcccacagttccgacgaaaaatggcggggtctcctgagttggtggtccttgaccctccatgggacaaggagctcgcggctggcacagagagccaggccttggtctccgccactccccgagaagactttcgggtgcgctgcacctcgaagcgggctgtgaccgaaatgctacaactgtgcggccgcttcgtgcaaaagctcggggacgctctgccggaggagattcgggagcccgctctgcgagatgcgcagtggacttttgaatcagctgtgcaagagaatatcagcattaatgggcaagcatggcaggaagcttcagataattgttttatggattctgacatcaaagtacttgaagatcagtttgatgaaatcatagtagatatagccacaaaacgtaagcagtatcccagaaagatcctggaatgtgtcatcaaaaccataaaagcaaaacaagaaattctgtccttgcctgcattaattgaacaaggagagggattttcccaagttctcaggatgcagcctgttatccacctccagaggattcaccaagaagtcttttccagttgtcataggaaaccagatgctaaacctgagaactttataacacagatagaaaccacaccaacagagactgcttccaggaaaacctctgacgtggtactgaaaagaaagcaaactaaagactgcccccagagaaaatggtatccattgcggccaaagaaaattaatcttgatacatgagctctttctgtttattttgggagttgaaaataggcaccatcaacatttagattacagcctaattaatacctagataagacttcatttgaaataagaaataactcttttactagtgattcatttatacagatatagtatctctgtgcggggatatgatataatattgtatttccttactgttttatctattgtaaataaaaagcattttaaaaagtattgacacaaagcccatcagtgggcattaaaaatattaaaagtgcagacttttactgtccttaagtgccatcaactctcagctcccttgtagcttttgtgggatttaacaagtaacaaattctgttgtgtttccctggtatacatctttctaggaaaaaaaaaaaaagagagagagctgtataatgatttttcgtttacatgctgaaaagtaattatcagttctgcacagcagcagatgcagggtttttttttaaagatgtagtttgatttatcaaattaatgtgctgatgataatactggctttgactttgttactccatgttcagctaatttaggtttgtgagattaactttaggattttttgttgtgtaagacaatgataactattatttgtgcaacattactctttgaaataaaaattggcatgtagccaatgtttcctgcccacactcacttttttctatagaccattaacataatttgacttggaactaatggtttctttttagggtttcttatttatttctttacaaatcattccagttcaaaatatatatcagattaatacactgaaaaaaaagtgtcattgtgttattgaactattttacatttgaagatgtttatatatcaggtatataatcactgggagaagtctgagaaaacgatattggctttacttctaacatttaactatagtttcttatagctcttattgtgtgtcttacattatacagtgtaggcagggccatcaaacttaccaactgtttccccttttgatgactctgataccttcattcatttttcaaaggaatttactgatcatgaggttggaaaatctgtatttctcttgcttattatgtattaataatcataaatgtctagattcaccagaagtcaccagaaggtctgtctcagtgaagaaaacttataaagccactttgttgcattttgtgtttcagtgttacagtttgagatctgtatatttgtacacagctatgtgtttttcattgaaataatgtacaaagactgatcttgatgctgtgtatttttatgagttgtcttaggcattcctgagctcagcttcagttggatggtgggtcagcaccctgcgtttctgaacatactagacttcagtttaaaactgttttgaggctgtataatatgttgctgtttttacagtgctaatgtttttatagtattaaaattctgtatgatttgtttcacttcagaggtccccaaacaaaagagttattgttaattctattagattatataagctacttgcattttgattatataagaacatggtccctcccttttaagagaggtatattgtgctacat

SEQ ID NO: 37869 - DNA, 356 bp, Homo sapiens
cataatccctagtatcccggccttgaggcccagagcctcattttactggcccttaaatgctccaaaattacccacttttttcctttgtttccagtctctacccccctaacttcatcccctgtccaaaatattatgctaatcctaatcagtggaaagcagttttattaatttatttaaaatatttgaatggatggtaattacttgatgttacaaaaatagtttggtttcatattttactaaaatagtcacagaaacttcttttaggctcctatctttgaattcctttctgttgtgggtacgactggctggggctggtgttgcaggtagtaaaataatttaccaagacagtcgtaggt

SEQ ID NO: 37870 - DNA, 390 bp, Homo sapiens
gactccataaccagtttctgtaacaaagactcctctgggtctcctccagtctcatattgccatcaacctaaagaaagctgacagtccactccttttttcatcatggaaggtagccgagttatataaagacttggaatcaggatattaaggtttgagtctgtttaccactcaccatttaatctggaaacaagtcatttaacctgctgatccttgttacatcatttgaaaacagaggagaggggatgtgtttgttgtgaggttattgtgtttaagtgagccagttgtgagctagcatagtggcctggtatatataaagtccttagtaagtctaagtgtagatgactagacagtaaaaatctgggtatgttgctaggtagctattacagggtg

SEQ ID NO: 37871 - DNA, 340 bp, Homo sapiens
caaaggatttatatgaagtacaagaattaaagtttagaattatagagtaggaccacgttaaagtaacttaaatgctaggatagggaatttgagctctatattactggaaattcatatttgtattcagtagttgtgctgcctctcacctgtcttctattctcagccccttgctgtttaaaatatagttcttggaccagcagcattggcatcacttgggaacttgttagaaatacagaatttcagatccctcttaggcttattgaatgatagtctgcattttagcaagattcccaagtgacttatgtacacagtaaagtttgagaaacactgctttgatcac

SEQ ID NO: 37872 - DNA, 456 bp, Homo sapiens
cacttatcatgctccacctcgtattattattaaattatgtgtgcatcgtttttgtaatgagactctaaatgccctgaaaaggaaatttacatatcttcatatataccatagacattaacagaatgatcgggacataacagcatttaataccagtgttgattaaagctctttttttaattagctgaaaaacctatgggccaagaattgtgtcagtacaggaatcagtattgagcaagtcagtctctgtctctgctgacacaggaacttacaggctgatgaggaagcatcaccatcgttgaagcagtacacctgatacttcacttgacttttttctttaaaaaataaaactcatttttaattggtcatttcatgttaaatctcagattgttcagagaaacaagaatcaagtagctaaactattgatttgaaaatgttgcctgggcaacacagcgagat

SEQ ID NO: 37873 - DNA, 823 bp, Homo sapiens
gggcgacagagtgagactcagtctcgctgaaaaaaacaacaacattgctttacagtgtgattccagttacagagaatattcacataggtgcataaataaatgaaaaaattattggttaatgtctctgtatgttgggattctcagtgattttatttttctactttttattttttataatttctccagtgtgttggtgttagctttatagattatatcaagtaaccttttgctgcaccaaaaaaccccccaaatctagtggattaaaacaaaaccatcttacaattttgtcagaactgtctaagctgatatttactgggctctctcctgaatgtggggtcagctggggggttggctaatagggtaccctaggatggtctcactcatctgtggtggttggcagaccgttgtccaagacactgcacttctcttccgggtggcttctcacgccttctgatgtgctagcttgggtttgttcacatggtggtctcttccagggatagtacaaggtacagctcacgtgcatgaggtgcaagttgatacagtttggatgtttgtcccctccaaatctgatgttgaaatttgatccccagtgctggaggttgggcctggtgggaggtctttgggacattggggcggatccctcttgaatggcttggtgtgtcctcatggtaaccagtgaggtcttgctttatgagtccccaggagagctgattcttaaaaagagcctagcacctcccttccgtcttgccctccatcctctcgctgtcatctatacacaacagctccccttccccttctgccttgagcggaagcttcctgaagc

SEQ ID NO: 37874 - DNA, 631 bp, Homo sapiens
ctacgaggatctcgtttggatgcggctatgtcgggagactggtaacggaaattcgtctagcatctgctagtttaaagttgagagaaatgtacagagacctgttttgggtgatagggtaatgcccgtgttctgaagatacgggccttttcaggaacatgaaaattagttgtagtcatgcttgatgtgtacctttttccttcctacttctgcttggtttagaaataagttctgtctagcactttgatccattccagcccaaagtgagatgagaataattcgttttatgtctgaagaaacatgcttggttgtacagaggaaggaacagtaaaattggagataagagacctgaatatctctattttattttatttttagacaaaatctcgctctgtagcccagagtggaggttgggcctggtgggaggtctttgggacattggggcggatccctcttgaatggcttggtgtgtcctcatggtaaccagtgaggtcttgctttatgagtccccaggagagctgattcttaaaaagagcctagcacctcccttccgtcttgccctccatcctctcgctgtcatctatacacaacagctccccttccccttctgccttgagcggaagcttcctgaagc

SEQ ID NO: 37875 - DNA, 650 bp, Homo sapiens
aggagtcctgagttgatatggaggcatgattaccacccctagagaagcctgtagctgatagactgtgccattcagaaacttcccaagctaatgaaaagtgggcaggcccttcccagaagaacaaaccacaggagcgctcaaaaacatgctttaaaaaatgcaggtgattatccccgtgtaagatgaaagggcttgcagggggagtggccactgagatactccaggaagcatcctagagttggtgagtctgaagcaagacagggcaagacctagaagtgagctgagggtctgctttctcaagtgaggtctgggtgcaggctgagaaacagattggtttagcaggagcaaatatgcattctgcccaaaggagctttgtatatgaatagaacctcgggatggtagaaccaagaaggcctccaagagaatctgatctagtctttctcttgaccgcttcctcctttgttgaatgtaaaaaatcacatgcctttttactgatattaaattgttaagaattactcataaaatagctttccaagctattgctgttactaatacaattagtaattactaattcttaaacccgaaggcaaataacttcacatactgcctcatatttcaactcaatttctctgtaacaaaaaaagtaaaaa

SEQ ID NO: 37876 - DNA, 3178 bp, Homo sapiens
ggcacgagatgacaccaagcaaagcctacttagtttagatctccagaaattggctggtggaaaaaaatcaaacatgaagattgcagttttgttttgtttttttctgcttatcatttttcaaactgactttggaaaaaatgaagaaattcctaggaagcaaaggaggaagatctaccacagaaggttgaggaaaagttcaacctcacacaagcacagatcaaacagacagcttggaattcagcaaacaacagtttttacaccagtagcaagacttcctattgttaactttgattatagcatggaggaaaagtttgaatccttttcaagttttcctggagtagaatcaagttataatgtgttaccaggaaagaagggacactgtttggtaaagggcataaccatgtacaacaaagctgtgtggtcgcctgagccctgcactacctgcctctgctcagatggaagagttctttgtgatgaaaccatgtgccatccccagaggtgcccccaaacagttatacctgaaggggaatgctgcccggtctgctccgctactgtctcctattctctactcagtggtatagcattaaatgatagaaatgaattttctggtgattcttcagaacaaagagaacctaccaatttacttcataagcaactgccacctcctcaggtgggaatggaccgaatagtaagaaaagaagcacttcaatctgaggaggatgaagaagtgaaagaagaagatacagagcaaaagagagagacccctgaatctagaaatcaggggcaactttacagtgagggggacagcagaggaggagacagaaagcagaggcctggagaggagaggaggctggcacaccagcaacaacgccaaggaagggaggaggaggaggatgaggaggaggagggtgaggagggtgaggaggatgaggaggacgaggaggacccggtaagaggagatatgttccgaatgccctctcgatccccgcttcctgctcctcccagaggcacactgcgcctgccaagcgggtgctctctgtcctacaggaccatcagctgcatcaacgccatgcttacccagataccaccgctgacagcaccacagataacaagtctggagctcactggcaattccatcgcctccatcccagatgaagcatttaatggattaccaaatttggaaaggcttgatctgagtaaaaataatatcacttcttcaggcataggtccaaaagcattcaagcttctgaagaagttaatgcgtttgaatatggatggaaataatttgatacagattccttcacaattgccatctacattagaagaacttaaagtcaatgagaacaatcttcaggctatcgatgaagaaagtttatcagacttaaatcagttggtcaccttagaattggaaggaaacaatctcagtgaagccaatgtcaatcctttagctttcaaacctttgaagagcctagcctacttgcgtctgggaaaaaataaatttagaattataccgcagggtcttcctggttctattgaggaattatacctagaaaataaccaaattgaagaaataactgaaatttgtttcaatcataccagaaagatcaatgtcattgtactacgttataacaaaattgaagaaaataggattgctcctttagcctggataaatcaagaaaatctagaatccattgatctctcctacaacaagctctatcacgtcccgtcctatctacccaagtccttgctgcacctagtactccttgggaaccagattgaacggatccctggctatgtgtttggccacatggaaccaggcctggaatacttgtacctgtcatttaacaaacttgctgatgatggcatggaccgtgtctccttctatggggcatatcattctctgagagaattatttctggatcacaatgacttaaaatctataccacctgggatacaagaaatgaaagcactacattttctgaggctgaacaacaacaagatacggaacattcttccagaagaaatttgcaatgctgaagaggatgatgactcaaatctggaacatcttcatcttgaaaacaattatattaaaattagagaaataccatcttacacattttcatgcataagatcatactcaagtatcgttcttaaaccacaaaacatcaagtaattccaagttttcctttgctgtttataaactttactcatgtatttgtagtagctgcatttgtcattaataagagagacataatcctcctgttatactcagtatcattatatgctagtcaacctgattcactaacacacagatgaacaaccaaaatatacctaaaaggtatagtctctaggagttttattaatagtaaaggtaaaatctctcagtttcctacctctagaaagaggccatctcactagaataggatattatgcatactgagctagaccagaagagtctggaacaaaataaacacagcctttataatcaacttgaatactggtgttagctgagaactctgtaagtccctttaaaaattatgtatcttttggttcaagattaagaagcataatgacaacaaaaaaagcaggcagaatttatgaataagtgttgtttattattaaaacaataatttgttaatttcttataaggtcctgtgctataattactggtataaatataactgaatattggggtagctttcatttcttccattaattacatgtgtaaaattaaaacactactgtaatgttaatttcctggttttgaaaatcatattatggttatgtacattgttaacattaaggaaagctggcagaagggtgtgcataaattctatactctttttgaaacttttctataattctaaaattattttttaaagttaaacagtatattaagattaccttcactattcctcactcaagattaagacattttttgaaaagcagtagagtttgcttaaaatacaaattaattattcttgactataaccttgtaaaggtaaatctaatgtataaatttttgaaaaattttgcaccactggtcatagcatctatctcctttgccttaatttactgaaatacatcattttattcggttcaattgaaataaagctatgtctttactatgtattggccctaccaaaatcatatattaaaattttctaacataatgatt

SEQ ID NO: 37877 - DNA, 2229 bp, Homo sapiens
ctagaggtggagtgttatgaagtaatggtaggtctcttgtctgaagaataccagaaaatcatttctatcatttaatgctataccactgagtagagaataggagacagtagcggatcaaacagacagcttggaattcagcaaacaacagtttttacaccagtagcaagacttcctattgttaactttgattatagcatggaggaaaagtttgaatccttttcaagttttcctggagtagaatcaagttataatgtgttaccaggaaagaagggacactgtttggtaaagggcataaccatgtacaacaaagctgtgtggtcgcctgagccctgcactacctgcctctgctcagatggaagagttctttgtgatgaaaccatgtgccatccccagaggtgcccccaaacagttatacctgaaggggaatgctgcccggtctgctccgctactgtctcctattctctactcagtggtatagcattaaatgatagaaatgaattttctggtgattcttcagaacaaagagaacctaccaatttacttcataagcaactgccacctcctcaggtgggaatggaccgaatagtaagaaaagaagcacttcaatctgaggaggatgaagaagtgaaagaagaagatacagagcaaaagagagagacccctgaatctagaaatcaggggcaactttacagtgagggggacagcagaggaggagacagaaagcagaggcctggagaggagaggaggctggcacaccagcaacaacgccaaggaagggaggaggaggaggatgaggaggaggagggtgaggagggtgaggaggatgaggaggacgaggaggacccggtaagaggagatatgttccgaatgccctctcgatccccgcttcctgctcctcccagaggcacactgcgcctgccaagcgggtgctctctgtcctacaggaccatcagctgcatcaacgccatgcttacccagataccaccgctgacagcaccacagataacaagtctggagctcactggcaattccatcgcctccatcccagatgaagcatttaatggattaccaaatttggaaaggcttgatctgagtaaaaataatatcacttcttcaggcataggtccaaaagcattcaagcttctgaagaagttaatgcgtttgaatatggatggaaataatttgatacagattccttcacaattgccatctacattagaagaacttaaagtcaatgagaacaatcttcaggctatcgatgaagaaagtttatcagacttaaatcagttggtcaccttagaattggaaggaaacaatctcagtgaagccaatgtcaatcctttagctttcaaacctttgaagagcctagcctacttgcgtctgggaaaaaataaatttagaattataccgcagggtcttcctggttctattgaggaattatacctagaaaataaccaaattgaagaaataactgaaatttgtttcaatcataccagaaagatcaatgtcattgtactacgttataacaaaattgaagaaaataggattgctcctttagcctggataaatcaagaaaatctagaatccattgatctctcctacaacaagctctatcacgtcccgtcctatctacccaagtccttgctgcacctagtactccttgggaaccagattgaacggatccctggctatgtgtttggccacatggaaccaggcctggaatacttgtacctgtcatttaacaaacttgctgatgatggcatggaccgtgtctccttctatggggcatatcattctctgagagaattatttctggatcacaatgacttaaaatctataccacctgggatacaagaaatgaaagcactacattttctgaggctgaacaacaacaagatacggtaaattttggctttttcaagtatctgtttaaattttggttggcaaaatatatgataaaacaaccatgacatgatctctgggatttacgttaagggaaaaaaaaatggtgctaaggggttggattaaacaagattggcaaatgttagtaattaccaaaggtggatgacaggtatgtgaggattcattataagcttttcctacttttgcacatgtttataaatttccatagttaaaacatcttttggtcaggtgcagtggctcacgcccttatttgcgatatgcttgaggtggccagtttgaatggcgaccatggtccacgtccataag

SEQ ID NO: 37878 - DNA, 550 bp, Homo sapiens
ctagaggtggagtgttatgaagtaatggtaggtctcttgtctgaagaataccagaaaatcatttctatcatttaatgctataccactgagtagagaataggagacagtagcggatcaaacagacagcttggaattcagcaaacaacagtttttacaccagtagcaagacttcctattgttaactttgattatagcatggaggaaaagtttgaatccttttcaagttttcctggagtagaatcaagttataatgtgttaccaggaaagaagggacactgtttggtaaagggcataaccatgtacaacaaagctgtgtggtcgcctgagccctgcactacctgcctctgctcagatggaagagttctttgtgatgaaaccatgtgccatccccagaggtgcccccaaacagttatacctgaaggggaatgctgcccggtctgctccgctactggtacagagatttagctaagcaaaatatcagtgtgtgattaatctttaacttccatttgtttttgttactaattttagattaaaattatgatacattaaa

SEQ ID NO: 37879 - DNA, 441 bp, Homo sapiens
tctctgtcctacaggaccatcagctgcatcaacgccatgcttacccagataccaccgctgacagcaccacagataacaagtctggagctcactggtaagagatgttgacttctgctttattttgtgctttaaaagtaaatgactcttagcagctgggcacggtggctcacgcctataatctcagcactttgaaaggctgaggtggccagatcacctgaggtcaggggtttgagaccagcctggacaatatggtgaaaccccatctctaccaaaaatacaaaaattagccgggcgtggtggggcatgcctgtaatcccagctactcagaaggccgaggcaggagaatcgtttgaatccaggaggcggaggttgcagtgagctgagattgagccactgttctctagcctgggcacttgagcgagactccatctcaaaaaaaaa

SEQ ID NO: 37880 - DNA, 3075 bp, Homo sapiens
ctagaggtggagtgttatgaagtaatggtaggtctcttgtctgaagaataccagaaaatcatttctatcatttaatgctataccactgagtagagaataggagacagtagcggatcaaacagacagcttggaattcagcaaacaacagtttttacaccagtagcaagacttcctattgttaactttgattatagcatggaggaaaagtttgaatccttttcaagttttcctggagtagaatcaagttataatgtgttaccaggaaagaagggacactgtttggtaaagggcataaccatgtacaacaaagctgtgtggtcgcctgagccctgcactacctgcctctgctcagatggaagagttctttgtgatgaaaccatgtgccatccccagaggtgcccccaaacagttatacctgaaggggaatgctgcccggtctgctccgctactgtctcctattctctactcagtggtatagcattaaatgatagaaatgaattttctggtgattcttcagaacaaagagaacctaccaatttacttcataagcaactgccacctcctcaggtgggaatggaccgaatagtaagaaaagaagcacttcaatctgaggaggatgaagaagtgaaagaagaagatacagagcaaaagagagagacccctgaatctagaaatcaggggcaactttacagtgagggggacagcagaggaggagacagaaagcagaggcctggagaggagaggaggctggcacaccagcaacaacgccaaggaagggaggaggaggaggatgaggaggaggagggtgaggagggtgaggaggatgaggaggacgaggaggacccggtaagaggagatatgttccgaatgccctctcgatccccgcttcctgctcctcccagaggcacactgcgcctgccaagcgggtgctctctgtcctacaggaccatcagctgcatcaacgccatgcttacccagataccaccgctgacagcaccacagataacaagtctggagctcactggcaattccatcgcctccatcccagatgaagcatttaatggattaccaaatttggaaaggcttgatctgagtaaaaataatatcacttcttcaggcataggtccaaaagcattcaagcttctgaagaagttaatgcgtttgaatatggatggaaataatttgatacagattccttcacaattgccatctacattagaagaacttaaagtcaatgagaacaatcttcaggctatcgatgaagaaagtttatcagacttaaatcagttggtcaccttagaattggaaggaaacaatctcagtgaagccaatgtcaatcctttagctttcaaacctttgaagagcctagcctacttgcgtctgggaaaaaataaatttagaattataccgcagggtcttcctggttctattgaggaattatacctagaaaataaccaaattgaagaaataactgaaatttgtttcaatcataccagaaagatcaatgtcattgtactacgttataacaaaattgaagaaaataggattgctcctttagcctggataaatcaagaaaatctagaatccattgatctctcctacaacaagctctatcacgtcccgtcctatctacccaagtccttgctgcacctagtactccttgggaaccagattgaacggatccctggctatgtgtttggccacatggaaccaggcctggaatacttgtacctgtcatttaacaaacttgctgatgatggcatggaccgtgtctccttctatggggcatatcattctctgagagaattatttctggatcacaatgacttaaaatctataccacctgggatacaagaaatgaaagcactacattttctgaggctgaacaacaacaagatacggaacattcttccagaagaaatttgcaatgctgaagaggatgatgactcaaatctggaacatcttcatcttgaaaacaattatattaaaattagagaaataccatcttacacattttcatgcataagatcatactcaagtatcgttcttaaaccacaaaacatcaagtaattccaagttttcctttgctgtttataaactttactcatgtatttgtagtagctgcatttgtcattaataagagagacataatcctcctgttatactcagtatcattatatgctagtcaacctgattcactaacacacagatgaacaaccaaaatatacctaaaaggtatagtctctaggagttttattaatagtaaaggtaaaatctctcagtttcctacctctagaaagaggccatctcactagaataggatattatgcatactgagctagaccagaagagtctggaacaaaataaacacagcctttataatcaacttgaatactggtgttagctgagaactctgtaagtccctttaaaaattatgtatcttttggttcaagattaagaagcataatgacaacaaaaaaagcaggcagaatttatgaataagtgttgtttattattaaaacaataatttgttaatttcttataaggtcctgtgctataattactggtataaatataactgaatattggggtagctttcatttcttccattaattacatgtgtaaaattaaaacactactgtaatgttaatttcctggttttgaaaatcatattatggttatgtacattgttaacattaaggaaagctggcagaagggtgtgcataaattctatactctttttgaaacttttctataattctaaaattattttttaaagttaaacagtatattaagattaccttcactattcctcactcaagattaagacattttttgaaaagcagtagagtttgcttaaaatacaaattaattattcttgactataaccttgtaaaggtaaatctaatgtataaatttttgaaaaattttgcaccactggtcatagcatctatctcctttgccttaatttactgaaatacatcattttattcggttcaattgaaataaagctatgtctttactatgtattggccctaccaaaatcatatattaaaattttctaacataatgatt

SEQ ID NO: 37881 - DNA, 407 bp, Homo sapiens
gacacgagcgttccaaggcaggagcagaactccatgttggccattataaagacaagattccttttcccccgctttttatagcctctctgggtaagatgtgtctggaaggaggtgtgggccaggaaagagcatatgtctgatgcctgggattccaggacagaaagtacagccgactccaagctcttgggatgggattggagggtctcaaaaccttgccagctttggagtcagagagaaaagagtcccaaccccagatttatcatttgctaacaaatgtgaccttgggcaaatcagctcacctctctggccctcaacagagataatcctgggacctatttcacagtcatggagaggattaaatgggaagaggaataaaaggagtttggagaagtgcccaggacatagta

SEQ ID NO: 37882 - DNA, 539 bp, Homo sapiens
  misc_feature (19)..(19): n is a, c, g, or t
  misc_feature (444)..(444): n is a, c, g, or t
  misc_feature (465)..(465): n is a, c, g, or t
  misc_feature (477)..(477): n is a, c, g, or t
  misc_feature (514)..(514): n is a, c, g, or t
ttttttttttaagagggangggggctgtcctcactatgttgcccacattggacttgaactcttgaggtcaagcaatcctcctgtctccccagaagctgggactacaggagcttcaaatgactcttgattgtattatatttccaatacatgctgcagtgcaaataaataaataaaaaaaattagctgaaactgaagtttctagaatacttagttggacctcccctttttacaggccaatcatggagctaaatggttactttgttacacagattgagggagtaaatctctgtgttaatgaatacactatcttatcggcttcaagaagagtaacctcaagcacaaaaagaaaagaattaagtctaactgaaggtaccatgattagcaaaaacactttggtttcaggaattgcaaagacagactggccattacaggaagtaaatggcntggaccaaaattgggtttttnaaaaaaaacccnttgggttttttttaaaccaaggggaaaaaaaaagggnttttaaagggggggaaaaaaaaagt

SEQ ID NO: 37883 - DNA, 330 bp, Homo sapiens
  misc_feature (12)..(12): n is a, c, g, or t
tcccccggtaanaggctgcgtgcttgtattaatgctgacaatgttaaactgtttacagaaagtaggaagctgtgggatgttcctcccactgtcacacacactgtcctgtcctacgtaacaagtgttgccttatttctcaataagtgaatataaattaaacaaaaaaaaatagttggaaatgactcctagccattttgtcagttttcatccatatctccaattgtatcatccagccaacccctgactcccatctctttattcatctgagttaccaaattatctagctattgtcacataagaaggttttctaaagacagggtaactcaaaag

SEQ ID NO: 37884 - DNA, 3169 bp, Homo sapiens
cgcccgggcaggtagcggccgctgaattctagaacgcccaccatgccccggcagctcagcgcggcggccgcgctcttcgcgtccctggccgtaattttgcacgatggcagtcaaatgagagcaaaagcatttccagaaaccagagattattctcaacctactgcagcagcaacagtacaggacataaaaaaacctgtccagcaaccagctaagcaagcacctcaccaaactttagcagcaagattcatggatggtcatatcacctttcaaacagcggccacagtaaaaattccaacaactaccccagcaactacaaaaaacactgcaaccaccagcccaattacctacaccctggtcacaacccaggccacacccaacaactcacacacagctcctccagttactgaagttacagtcggccctagcttagccccttattcactgccacccaccatcaccccaccagctcatacaactggaaccagttcatcaaccgtcagccacacaactgggaacaccactcaacccagtaaccagaccacccttccagcaactttatcgatagcactgcacaaaagcacaaccggtcagaagcctgttcaacccacccatgccccaggaacaacggcagctgcccacaataccacccgcacagctgcacctgcctccacggttcctgggcccacccttgcacctcagccatcgtcagtcaagactggaatttatcaggttctaaacggaagcagactctgtataaaagcagagatggggatacagctgattgttcaagacaaggagtcggttttttcacctcggagatacttcaacatcgaccccaacgcaacgcaagcctctgggaactgtggcacccgaaaatccaaccttctgttgaattttcagggcggatttgtgaatctcacatttaccaaggatgaagaatcatattatatcagtgaagtgggagcctatttgaccgtctcagatccagagacagtttaccaaggaatcaaacatgcggtggtgatgttccagacagcagtcgggcattccttcaagtgcgtgagtgaacagagcctccagttgtcagcccacctgcaggtgaaaacaaccgatgtccaacttcaagcctttgattttgaagatgaccactttggaaatgtggatgagtgctcgtctgactacacaattgtgcttcctgtgattggggccatcgtggttggtctctgccttatgggtatgggtgtctataaaatccgcctaaggtgtcaatcatctggataccagagaatctaattgttgcccggggggaatgaaaataatggaatttagagaactctttcatcccttccaggatggatgttgggaaattccctcagagtgtgggtccttcaaacaatgtaaaccaccatcttctattcaaatgaagtgagtcatgtgtgatttaagttcaggcagcacatcaatttctaaatactttttgtttattttatgaaagatatagtgagctgtttattttctagtttcctttagaatattttagccactcaaagtcaacatttgagatatgttgaattaacataatatatgtaaagtagaataagccttcaaattataaaccaagggtcaattgtaactaatactactgtgtgtgcattgaagattttattttacccttgatcttaacaaagcctttgctttgttatcaaatggactttcagtgcttttactatctgtgttttatggtttcatgtaacatacatattcctggtgtagcacttaactccttttccactttaaatttgtttttgttttttgagacggagtttcactcttgtcacccaggctggagtacagtggcacgatctcggcttatggcaacctccgcctcccgggttcaagtgattctcctgcttcagcttcccgagtagctgggattacaggcacacactaccacgcctggctaatttttgtatttttattatagacggggtttcaccatgttggccagactggtcttgaactcttgacctcaggtgatccacccacctcagcctcccaaagtgctgggattacaggcatgagccattgcgcccggccttaaatgttttttttaatcatcaaaaagaacaacatatctcaggttgtctaagtgtttttatgtaaaaccaacaaaaagaacaaatcagcttatattttttatcttgatgactcctgctccagaatcgctagactaagaattaggtggctacagatggtagaactaaacaataagcaagagacaataataatggcccttaattattaacaaagtgccagagtctaggctaagcactttatctatatctcatttcattctcacaacttataggtgaatgagtaaactgagacttaagggaactgaatcacttaaatgtcacctggctaactgatggcagagccagagcttgaattcatgttggtctgacatcaaggtctttggtcttctccctacaccaagttacctacaagaacaatgacaccacactctgcctgaaggctcacacctcataccagcatacgctcaccttacagggaaatgggtttatccaggatcatgagacattagggtagatgaaaggagagctttgcagataacaaaatagcctatccttaataaatcctccactctctggaaggagactgaggggctttgtaaaacattagtcagttgctcatttttatgggattgcttagctgggctgtaaagatgaaggcatcaaataaactcaaagtatttttaaatttttttgataatagagaaacttcgctaaccaactgttctttcttgagtgtatagccccatcttgtggtaacttgctgcttctgcacttcatatccatatttcctattgttcactttattctgtagagcagcctgccaagaattttatttctgctgttttttttgctgctaaagaaaggaactaagtcaggatgttaacagaaaagtccacataaccctagaattcttagtcaaggaataattcaagtcagcctagagaccatgttgactttcctcatgtgtttccttatgactcagtaagttggcaaggtcctgactttagtcttaataaaacattgaattgtagtaaaggtttttgtaataaaaacttactttggaaatatgtgca

SEQ ID NO: 37885 - DNA, 3360 bp, Homo sapiens
agcggaggcccgggccccggcggctgcgccgagtccccgcccctcccggctccgtaggggtaggagggggccggcggagtttccctccccgcccagcggccctgggcgggcttttcggctgcttctcataagcaggtggtttcgtttctccggcacaggtaggtttctctggcaccgattcggggcctgcccggacttcgccgcacgctgcagaacctcgcccagcgcccaccatgccccggcagctcagcgcggcggccgcgctcttcgcgtccctggccgtaattttgcacgatggcagtcaaatgagagcaaaagcatttccagaaaccagagattattctcaacctactgcagcagcaacagtacaggacataaaaaaacctgtccagcaaccagctaagcaagcacctcaccaaactttagcagcaagattcatggatggtcatatcacctttcaaacagcggccacagtaaaaattccaacaactaccccagcaactacaaaaaacactgcaaccaccagcccaattacctacaccctggtcacaacccaggccacacccaacaactcacacacagctcctccagttactgaagttacagtcggccctagcttagccccttattcactgccacccaccatcaccccaccagctcatacaactggaaccagttcatcaaccgtcagccacacaactgggaacaccactcaacccagtaaccagaccacccttccagcaactttatcgatagcactgcacaaaagcacaaccggtcagaagcctgttcaacccacccatgccccaggaacaacggcagctgcccacaataccacccgcacagctgcacctgcctccacggttcctgggcccacccttgcacctcagccatcgtcagtcaagactggaatttatcaggttctaaacggaagcagactctgtataaaagcagagatggggatacagctgattgttcaagacaaggagtcggttttttcacctcggagatacttcaacatcgaccccaacgcaacgcaagcctctgggaactgtggcacccgaaaatccaaccttctgttgaattttcagggcggatttgtgaatctcacatttaccaaggatgaagaatcatattatatcagtgaagtgggagcctatttgaccgtctcagatccagagacagtttaccaaggaatcaaacatgcggtggtgatgttccagacagcagtcgggcattccttcaagtgcgtgagtgaacagagcctccagttgtcagcccacctgcaggtgaaaacaaccgatgtccaacttcaagcctttgattttgaagatgaccactttggaaatgtggatgagtgctcgtctgactacacaattgtgcttcctgtgattggggccatcgtggttggtctctgccttatgggtatgggtgtctataaaatccgcctaaggtgtcaatcatctggataccagagaatctaattgttgcccggggggaatgaaaataatggaatttagagaactctttcatcccttccaggatggatgttgggaaattccctcagagtgtgggtccttcaaacaatgtaaaccaccatcttctattcaaatgaagtgagtcatgtgtgatttaagttcaggcagcacatcaatttctaaatactttttgtttattttatgaaagatatagtgagctgtttattttctagtttcctttagaatattttagccactcaaagtcaacatttgagatatgttgaattaacataatatatgtaaagtagaataagccttcaaattataaaccaagggtcaattgtaactaatactactgtgtgtgcattgaagattttattttacccttgatcttaacaaagcctttgctttgttatcaaatggactttcagtgcttttactatctgtgttttatggtttcatgtaacatacatattcctggtgtagcacttaactccttttccactttaaatttgtttttgttttttgagacggagtttcactcttgtcacccaggctggagtacagtggcacgatctcggcttatggcaacctccgcctcccgggttcaagtgattctcctgcttcagcttcccgagtagctgggattacaggcacacactaccacgcctggctaatttttgtatttttattatagacggggtttcaccatgttggccagactggtcttgaactcttgacctcaggtgatccacccacctcagcctcccaaagtgctgggattacaggcatgagccattgcgcccggccttaaatgttttttttaatcatcaaaaagaacaacatatctcaggttgtctaagtgtttttatgtaaaaccaacaaaaagaacaaatcagcttatattttttatcttgatgactcctgctccagaatcgctagactaagaattaggtggctacagatggtagaactaaacaataagcaagagacaataataatggcccttaattattaacaaagtgccagagtctaggctaagcactttatctatatctcatttcattctcacaacttataggtgaatgagtaaactgagacttaagggaactgaatcacttaaatgtcacctggctaactgatggcagagccagagcttgaattcatgttggtctgacatcaaggtctttggtcttctccctacaccaagttacctacaagaacaatgacaccacactctgcctgaaggctcacacctcataccagcatacgctcaccttacagggaaatgggtttatccaggatcatgagacattagggtagatgaaaggagagctttgcagataacaaaatagcctatccttaataaatcctccactctctggaaggagactgaggggctttgtaaaacattagtcagttgctcatttttatgggattgcttagctgggctgtaaagatgaaggcatcaaataaactcaaagtatttttaaatttttttgataatagagaaacttcgctaaccaactgttctttcttgagtgtatagccccatcttgtggtaacttgctgcttctgcacttcatatccatatttcctattgttcactttattctgtagagcagcctgccaagaattttatttctgctgttttttttgctgctaaagaaaggaactaagtcaggatgttaacagaaaagtccacataaccctagaattcttagtcaaggaataattcaagtcagcctagagaccatgttgactttcctcatgtgtttccttatgactcagtaagttggcaaggtcctgactttagtcttaataaaacattgaattgtagtaaaggtttttgtaataaaaacttactttggaaatatgtgca

SEQ ID NO: 37886 - DNA, 3425 bp, Homo sapiens
cggggagtcggcagcgcgagctcccagccagacctagcgcctctgggctgtgctcctgttgcttcccgcaaaccgcggtcctggcgaggcctgggcgtggagcgcggctgccgcagactccctgggaagacatggagtcagggtgcttaggggtttttaggctcctgctcgcctagtggctggctttctcccggctgagaagcgtctctgggttcccagaaaggtaggtttctctggcaccgattcggggcctgcccggacttcgccgcacgctgcagaacctcgcccagcgcccaccatgccccggcagctcagcgcggcggccgcgctcttcgcgtccctggccgtaattttgcacgatggcagtcaaatgagagcaaaagcatttccagaaaccagagattattctcaacctactgcagcagcaacagtacaggacataaaaaaacctgtccagcaaccagctaagcaagcacctcaccaaactttagcagcaagattcatggatggtcatatcacctttcaaacagcggccacagtaaaaattccaacaactaccccagcaactacaaaaaacactgcaaccaccagcccaattacctacaccctggtcacaacccaggccacacccaacaactcacacacagctcctccagttactgaagttacagtcggccctagcttagccccttattcactgccacccaccatcaccccaccagctcatacaactggaaccagttcatcaaccgtcagccacacaactgggaacaccactcaacccagtaaccagaccacccttccagcaactttatcgatagcactgcacaaaagcacaaccggtcagaagcctgttcaacccacccatgccccaggaacaacggcagctgcccacaataccacccgcacagctgcacctgcctccacggttcctgggcccacccttgcacctcagccatcgtcagtcaagactggaatttatcaggttctaaacggaagcagactctgtataaaagcagagatggggatacagctgattgttcaagacaaggagtcggttttttcacctcggagatacttcaacatcgaccccaacgcaacgcaagcctctgggaactgtggcacccgaaaatccaaccttctgttgaattttcagggcggatttgtgaatctcacatttaccaaggatgaagaatcatattatatcagtgaagtgggagcctatttgaccgtctcagatccagagacagtttaccaaggaatcaaacatgcggtggtgatgttccagacagcagtcgggcattccttcaagtgcgtgagtgaacagagcctccagttgtcagcccacctgcaggtgaaaacaaccgatgtccaacttcaagcctttgattttgaagatgaccactttggaaatgtggatgagtgctcgtctgactacacaattgtgcttcctgtgattggggccatcgtggttggtctctgccttatgggtatgggtgtctataaaatccgcctaaggtgtcaatcatctggataccagagaatctaattgttgcccggggggaatgaaaataatggaatttagagaactctttcatcccttccaggatggatgttgggaaattccctcagagtgtgggtccttcaaacaatgtaaaccaccatcttctattcaaatgaagtgagtcatgtgtgatttaagttcaggcagcacatcaatttctaaatactttttgtttattttatgaaagatatagtgagctgtttattttctagtttcctttagaatattttagccactcaaagtcaacatttgagatatgttgaattaacataatatatgtaaagtagaataagccttcaaattataaaccaagggtcaattgtaactaatactactgtgtgtgcattgaagattttattttacccttgatcttaacaaagcctttgctttgttatcaaatggactttcagtgcttttactatctgtgttttatggtttcatgtaacatacatattcctggtgtagcacttaactccttttccactttaaatttgtttttgttttttgagacggagtttcactcttgtcacccaggctggagtacagtggcacgatctcggcttatggcaacctccgcctcccgggttcaagtgattctcctgcttcagcttcccgagtagctgggattacaggcacacactaccacgcctggctaatttttgtatttttattatagacggggtttcaccatgttggccagactggtcttgaactcttgacctcaggtgatccacccacctcagcctcccaaagtgctgggattacaggcatgagccattgcgcccggccttaaatgttttttttaatcatcaaaaagaacaacatatctcaggttgtctaagtgtttttatgtaaaaccaacaaaaagaacaaatcagcttatattttttatcttgatgactcctgctccagaatcgctagactaagaattaggtggctacagatggtagaactaaacaataagcaagagacaataataatggcccttaattattaacaaagtgccagagtctaggctaagcactttatctatatctcatttcattctcacaacttataggtgaatgagtaaactgagacttaagggaactgaatcacttaaatgtcacctggctaactgatggcagagccagagcttgaattcatgttggtctgacatcaaggtctttggtcttctccctacaccaagttacctacaagaacaatgacaccacactctgcctgaaggctcacacctcataccagcatacgctcaccttacagggaaatgggtttatccaggatcatgagacattagggtagatgaaaggagagctttgcagataacaaaatagcctatccttaataaatcctccactctctggaaggagactgaggggctttgtaaaacattagtcagttgctcatttttatgggattgcttagctgggctgtaaagatgaaggcatcaaataaactcaaagtatttttaaatttttttgataatagagaaacttcgctaaccaactgttctttcttgagtgtatagccccatcttgtggtaacttgctgcttctgcacttcatatccatatttcctattgttcactttattctgtagagcagcctgccaagaattttatttctgctgttttttttgctgctaaagaaaggaactaagtcaggatgttaacagaaaagtccacataaccctagaattcttagtcaaggaataattcaagtcagcctagagaccatgttgactttcctcatgtgtttccttatgactcagtaagttggcaaggtcctgactttagtcttaataaaacattgaattgtagtaaaggtttttgtaataaaaacttactttggaaatatgtgca

SEQ ID NO: 37887 - DNA, 3466 bp, Homo sapiens
agcggaggcccgggccccggcggctgcgccgagtccccgcccctcccggctccgtaggggtaggagggggccggcggagtttccctccccgcccagcggccctgggcgggcttttcggctgcttctcataagcaggtggtttcgtttctccggcacaggtaggtttctctggcaccgattcggggcctgcccggacttcgccgcacgctgcagaacctcgcccagcgcccaccatgccccggcagctcagcgcggcggccgcgctcttcgcgtccctggccgtacagggctcatcagcacatggtaattaacaatgatggacatggcttcctggcactctctgcatgccaggcactgttcgcagtgctttaatccacaaaacagcttttaattttgcacgatggcagtcaaatgagagcaaaagcatttccagaaaccagagattattctcaacctactgcagcagcaacagtacaggacataaaaaaacctgtccagcaaccagctaagcaagcacctcaccaaactttagcagcaagattcatggatggtcatatcacctttcaaacagcggccacagtaaaaattccaacaactaccccagcaactacaaaaaacactgcaaccaccagcccaattacctacaccctggtcacaacccaggccacacccaacaactcacacacagctcctccagttactgaagttacagtcggccctagcttagccccttattcactgccacccaccatcaccccaccagctcatacaactggaaccagttcatcaaccgtcagccacacaactgggaacaccactcaacccagtaaccagaccacccttccagcaactttatcgatagcactgcacaaaagcacaaccggtcagaagcctgttcaacccacccatgccccaggaacaacggcagctgcccacaataccacccgcacagctgcacctgcctccacggttcctgggcccacccttgcacctcagccatcgtcagtcaagactggaatttatcaggttctaaacggaagcagactctgtataaaagcagagatggggatacagctgattgttcaagacaaggagtcggttttttcacctcggagatacttcaacatcgaccccaacgcaacgcaagcctctgggaactgtggcacccgaaaatccaaccttctgttgaattttcagggcggatttgtgaatctcacatttaccaaggatgaagaatcatattatatcagtgaagtgggagcctatttgaccgtctcagatccagagacagtttaccaaggaatcaaacatgcggtggtgatgttccagacagcagtcgggcattccttcaagtgcgtgagtgaacagagcctccagttgtcagcccacctgcaggtgaaaacaaccgatgtccaacttcaagcctttgattttgaagatgaccactttggaaatgtggatgagtgctcgtctgactacacaattgtgcttcctgtgattggggccatcgtggttggtctctgccttatgggtatgggtgtctataaaatccgcctaaggtgtcaatcatctggataccagagaatctaattgttgcccggggggaatgaaaataatggaatttagagaactctttcatcccttccaggatggatgttgggaaattccctcagagtgtgggtccttcaaacaatgtaaaccaccatcttctattcaaatgaagtgagtcatgtgtgatttaagttcaggcagcacatcaatttctaaatactttttgtttattttatgaaagatatagtgagctgtttattttctagtttcctttagaatattttagccactcaaagtcaacatttgagatatgttgaattaacataatatatgtaaagtagaataagccttcaaattataaaccaagggtcaattgtaactaatactactgtgtgtgcattgaagattttattttacccttgatcttaacaaagcctttgctttgttatcaaatggactttcagtgcttttactatctgtgttttatggtttcatgtaacatacatattcctggtgtagcacttaactccttttccactttaaatttgtttttgttttttgagacggagtttcactcttgtcacccaggctggagtacagtggcacgatctcggcttatggcaacctccgcctcccgggttcaagtgattctcctgcttcagcttcccgagtagctgggattacaggcacacactaccacgcctggctaatttttgtatttttattatagacggggtttcaccatgttggccagactggtcttgaactcttgacctcaggtgatccacccacctcagcctcccaaagtgctgggattacaggcatgagccattgcgcccggccttaaatgttttttttaatcatcaaaaagaacaacatatctcaggttgtctaagtgtttttatgtaaaaccaacaaaaagaacaaatcagcttatattttttatcttgatgactcctgctccagaatcgctagactaagaattaggtggctacagatggtagaactaaacaataagcaagagacaataataatggcccttaattattaacaaagtgccagagtctaggctaagcactttatctatatctcatttcattctcacaacttataggtgaatgagtaaactgagacttaagggaactgaatcacttaaatgtcacctggctaactgatggcagagccagagcttgaattcatgttggtctgacatcaaggtctttggtcttctccctacaccaagttacctacaagaacaatgacaccacactctgcctgaaggctcacacctcataccagcatacgctcaccttacagggaaatgggtttatccaggatcatgagacattagggtagatgaaaggagagctttgcagataacaaaatagcctatccttaataaatcctccactctctggaaggagactgaggggctttgtaaaacattagtcagttgctcatttttatgggattgcttagctgggctgtaaagatgaaggcatcaaataaactcaaagtatttttaaatttttttgataatagagaaacttcgctaaccaactgttctttcttgagtgtatagccccatcttgtggtaacttgctgcttctgcacttcatatccatatttcctattgttcactttattctgtagagcagcctgccaagaattttatttctgctgttttttttgctgctaaagaaaggaactaagtcaggatgttaacagaaaagtccacataaccctagaattcttagtcaaggaataattcaagtcagcctagagaccatgttgactttcctcatgtgtttccttatgactcagtaagttggcaaggtcctgactttagtcttaataaaacattgaattgtagtaaaggtttttgtaataaaaacttactttggaaatatgtgca

SEQ ID NO: 37888 - DNA, 3354 bp, Homo sapiens
cggggagtcggcagcgcgagctcccagccagacctagcgcctctgggctgtgctcctgttgcttcccgcaaaccgcggtcctggcgaggcctgggcgtggagcgcggctgccgcagactccctgggaagacatggagtcagggtgcttaggggtttttaggctcctgctcgcctagtggctggctttctcccggctgagaagcgtctctgggttcccagaaaggtaggtttctctggcaccgattcggggcctgcccggacttcgccgcacgctgcagaacctcgcccagcgcccaccatgccccggcagctcagcgcggcggccgcgctcttcgcgtccctggccgtaattttgcacgatggcagtcaaatgagagcaaaagcatttccagaaaccagagattattctcaacctactgcagcagcaacagtacaggacataaaaaaacctgtccagcaaccagctaagcaagcacctcaccaaactttagcagcaagattcatggatggtcatatcacctttcaaacagcggccacagtaaaaattccaacaactaccccagcaactacaaaaaacactgcaaccaccagcccaattacctacaccctggtcacaacccaggccacacccaacaactcacacacagctcctccagttactgaagttacagtcggccctagcttagccccttattcactgccacccaccatcaccccaccagctcatacaactggaaccagttcatcaaccgtcagccacacaactgggaacaccactcaacccagtaaccagaccacccttccagcaactttatcgatagcactgcacaaaagcacaaccggtcagaagcctgttcaacccacccaccacccttgcacctcagccatcgtcagtcaagactggaatttatcaggttctaaacggaagcagactctgtataaaagcagagatggggatacagctgattgttcaagacaaggagtcggttttttcacctcggagatacttcaacatcgaccccaacgcaacgcaagcctctgggaactgtggcacccgaaaatccaaccttctgttgaattttcagggcggatttgtgaatctcacatttaccaaggatgaagaatcatattatatcagtgaagtgggagcctatttgaccgtctcagatccagagacagtttaccaaggaatcaaacatgcggtggtgatgttccagacagcagtcgggcattccttcaagtgcgtgagtgaacagagcctccagttgtcagcccacctgcaggtgaaaacaaccgatgtccaacttcaagcctttgattttgaagatgaccactttggaaatgtggatgagtgctcgtctgactacacaattgtgcttcctgtgattggggccatcgtggttggtctctgccttatgggtatgggtgtctataaaatccgcctaaggtgtcaatcatctggataccagagaatctaattgttgcccggggggaatgaaaataatggaatttagagaactctttcatcccttccaggatggatgttgggaaattccctcagagtgtgggtccttcaaacaatgtaaaccaccatcttctattcaaatgaagtgagtcatgtgtgatttaagttcaggcagcacatcaatttctaaatactttttgtttattttatgaaagatatagtgagctgtttattttctagtttcctttagaatattttagccactcaaagtcaacatttgagatatgttgaattaacataatatatgtaaagtagaataagccttcaaattataaaccaagggtcaattgtaactaatactactgtgtgtgcattgaagattttattttacccttgatcttaacaaagcctttgctttgttatcaaatggactttcagtgcttttactatctgtgttttatggtttcatgtaacatacatattcctggtgtagcacttaactccttttccactttaaatttgtttttgttttttgagacggagtttcactcttgtcacccaggctggagtacagtggcacgatctcggcttatggcaacctccgcctcccgggttcaagtgattctcctgcttcagcttcccgagtagctgggattacaggcacacactaccacgcctggctaatttttgtatttttattatagacggggtttcaccatgttggccagactggtcttgaactcttgacctcaggtgatccacccacctcagcctcccaaagtgctgggattacaggcatgagccattgcgcccggccttaaatgttttttttaatcatcaaaaagaacaacatatctcaggttgtctaagtgtttttatgtaaaaccaacaaaaagaacaaatcagcttatattttttatcttgatgactcctgctccagaatcgctagactaagaattaggtggctacagatggtagaactaaacaataagcaagagacaataataatggcccttaattattaacaaagtgccagagtctaggctaagcactttatctatatctcatttcattctcacaacttataggtgaatgagtaaactgagacttaagggaactgaatcacttaaatgtcacctggctaactgatggcagagccagagcttgaattcatgttggtctgacatcaaggtctttggtcttctccctacaccaagttacctacaagaacaatgacaccacactctgcctgaaggctcacacctcataccagcatacgctcaccttacagggaaatgggtttatccaggatcatgagacattagggtagatgaaaggagagctttgcagataacaaaatagcctatccttaataaatcctccactctctggaaggagactgaggggctttgtaaaacattagtcagttgctcatttttatgggattgcttagctgggctgtaaagatgaaggcatcaaataaactcaaagtatttttaaatttttttgataatagagaaacttcgctaaccaactgttctttcttgagtgtatagccccatcttgtggtaacttgctgcttctgcacttcatatccatatttcctattgttcactttattctgtagagcagcctgccaagaattttatttctgctgttttttttgctgctaaagaaaggaactaagtcaggatgttaacagaaaagtccacataaccctagaattcttagtcaaggaataattcaagtcagcctagagaccatgttgactttcctcatgtgtttccttatgactcagtaagttggcaaggtcctgactttagtcttaataaaacattgaattgtagtaaaggtttttgtaataaaaacttactttggaaatatgtgca

SEQ ID NO: 37889 - DNA, 2437 bp, Homo sapiens
agcggaggcccgggccccggcggctgcgccgagtccccgcccctcccggctccgtaggggtaggagggggccggcggagtttccctccccgcccagcggccctgggcgggcttttcggctgcttctcataagcaggtggtttcgtttctccggcacaggtaggtttctctggcaccgattcggggcctgcccggacttcgccgcacgctgcagaacctcgcccagcgcccaccatgccccggcagctcagcgcggcggccgcgctcttcgcgtccctggccgtaattttgcacgatggcagtcaaatgagagcaaaagcatttccagaaaccagagattattctcaacctactgcagcagcaacagtacaggacataaaaaaacctgtccagcaaccagctaagcaagcacctcaccaaactttagcagcaagattcatggatggtcatatcacctttcaaacagcggccacagtaaaaattccaacaactaccccagcaactacaaaaaacactgcaaccaccagcccaattacctacaccctggtcacaacccaggccacacccaacaactcacacacagctcctccagttactgaagttacagtcggccctagcttagccccttattcactgccacccaccatcaccccaccagctcatacaactggaaccagttcatcaaccgtcagccacacaactgggaacaccactcaacccagtaaccagaccacccttccagcaactttatcgatagcactgcacaaaagcacaaccggtcagaagcctgttcaacccacccatgccccaggaacaacggcagctgcccacaataccacccgcacagctgcacctgcctccacggttcctgggcccacccttgcacctcagccatcgtcagtcaagactggaatttatcaggttctaaacggaagcagactctgtataaaagcagagatggggatacagctgattgttcaagacaaggagtcggttttttcacctcggagatacttcaacatcgaccccaacgcaacgcaagcctctgggaactgtggcacccgaaaatccaaccttctgttgaattttcagggcggatttgtgaatctcacatttaccaaggatgaagaatcatattatatcagtgaagtgggagcctatttgaccgtctcagatccagagacagtttaccaaggaatcaaacatgcggtggtgatgttccagacagcagtcgggcattccttcaagtgcgtgagtgaacagagcctccagttgtcagcccacctgcaggtgaaaacaaccgatgtccaacttcaagcctttgattttgaagatgaccactttggaaatgtggatgagtgctcgtctgactacacaattgtgcttcctgtgattggggccatcgtggttggtctctgccttatgggtatgggtgtctataaaatccgcctaaggtgtcaatcatctggataccagagaatctaattgttgcccggggggaatgaaaataatggaatttagagaactctttcatcccttccaggatggatgttgggaaattccctcagagtgtgggtccttcaaacaatgtaaaccaccatcttctattcaaatgaagtgagtcatgtgtgatttaagttcaggcagcacatcaatttctaaatactttttgtttattttatgaaagatatagtgagctgtttattttctagtttcctttagaatattttagccactcaaagtcaacatttgagatatgttgaattaacataatatatgtaaagtagaataagccttcaaattataaaccaagggtcaattgtaactaatactactgtgtgtgcattgaagattttattttacccttgatcttaacaaagcctttgctttgttatcaaatggagtttatccaggatcatgagacattagggtagatgaaaggagagctttgcagataacaaaatagcctatccttaataaatcctccactctctggaaggagactgaggggctttatgaaggcatcaaataaactcaaagtatttttaaatttttttgataatagagaaacttcgctaaccaactgttctttcttgagtgtatagccccatcttgtggtaacttgctgcttctgcacttcatatccatatttcctattgttcactttattctgtagagcagcctgccaagaattttatttctgctgttttttttgctgctaaagaaaggaactaagtcaggatgttaacagaaaagtccacataaccctagaattcttagtcaaggaataattcaagtcagcctagagaccatgttgactttcctcatgtgtttccttatgactcagtaagttggcaaggtcctgactttagtcttaataaaacattgaattgtagtaaaggtttttgtaataaaaacttactttggaaatatgtgca

SEQ ID NO: 37890 - DNA, 2874 bp, Homo sapiens
agcggaggcccgggccccggcggctgcgccgagtccccgcccctcccggctccgtaggggtaggagggggccggcggagtttccctccccgcccagcggccctgggcgggcttttcggctgcttctcataagcaggtggtttcgtttctccggcacaggtaggtttctctggcaccgattcggggcctgcccggacttcgccgcacgctgcagaacctcgcccagcgcccaccatgccccggcagctcagcgcggcggccgcgctcttcgcgtccctggccgtaattttgcacgatggcagtcaaatgagagcaaaagcatttccagaaaccagagattattctcaacctactgcagcagcaacagtacaggacataaaaaaacctgtccagcaaccagctaagcaagcacctcaccaaactttagcagcaagattcatggatggtcatatcacctttcaaacagcggccacagtaaaaattccaacaactaccccagcaactacaaaaaacactgcaaccaccagcccaattacctacaccctggtcacaacccaggccacacccaacaactcacacacagctcctccagttactgaagttacagtcggccctagcttagccccttattcactgccacccaccatcaccccaccagctcatacaactggaaccagttcatcaaccgtcagccacacaactgggaacaccactcaacccagtaaccagaccacccttccagcaactttatcgatagcactgcacaaaagcacaaccggtcagaagcctgttcaacccacccatgccccaggaacaacggcagctgcccacaataccacccgcacagctgcacctgcctccacggttcctgggcccacccttgcacctcagccatcgtcagtcaagactggaatttatcaggttctaaacggaagcagactctgtataaaagcagagatggggatacagctgattgttcaagacaaggagtcggttttttcacctcggagatacttcaacatcgaccccaacgcaacgcaagcctctgggaactgtggcacccgaaaatccaaccttctgttgaattttcagggcggatttgtgaatctcacatttaccaaggatgaagaatcatattatatcagtgaagtgggagcctatttgaccgtctcagatccagagacagtttaccaaggaatcaaacatgcggtggtgatgttccagacagcagtcgggcattccttcaagtgcgtgagtgaacagagcctccagttgtcagcccacctgcaggtgaaaacaaccgatgtccaacttcaagcctttgattttgaagatgaccactttggaaatgtggatgagtgctcgtctgactacacaattgtgcttcctgtgattggggccatcgtggttggtctctgccttatgggtatgggtgtctataaaatccgcctaaggtgtcaatcatctggataccagagaatctaattgttgcccggggggaatgaaaataatggaatttagagaactctttcatcccttccaggatggatgttgggaaattccctcagagtgtgggtccttcaaacaatgtaaaccaccatcttctattcaaatgaagtgagtcatgtgtgatttaagttcaggcagcacatcaatttctaaatactttttgtttattttatgaaagatatagtgagctgtttattttctagtttcctttagaatattttagccactcaaagtcaacatttgagatatgttgaattaacataatatatgtaaagtagaataagccttcaaattataaaccaagggtcaattgtaactaatactactgtgtgtgcattgaagattttattttacccttgatcttaacaaagcctttgctttgttatcaaatggactttcagtgcttttactatctgtgttttatggtttcatgtaacatacatattcctggtgtagcacttaactccttttccactttaaatttgtttttgttttttgagacggagtttcactcttgtcacccaggctggagtacagtggcacgatctcggcttatggcaacctccgcctcccgggttcaagtgattctcctgcttcagcttcccgagtagctgggattacaggcacacactaccacgcctggctaatttttgtatttttattatagacggggtttcaccatgttggccagactggtcttgaactcttgacctcaggtgatccacccacctcagcctcccaaagtgctgggattacaggcatgagccattgcgcccggccttaaatgttttttttaatcatcaaaaagaacaacatatctcaggttgtctaagtgtttttatgtaaaaccaacaaaaagaacaaatcagcttatattttttatcttgatgactcctgctccagaatcgttattaacaaagtgccagagtctaggctaagcactttatctatatctcatttcattctcacaacttataggtgaatgagtaaactgagacttaagggaactgaatcacttaaatgtcacctggctaactgatggcagagccagagcttgaattcatgttggtctgacatcaaggtctttggtcttctccctacaccaagttacctacaagaattttatttctgctgttttttttgctgctaaagaaaggaactaagtcaggatgttaacagaaaagtccacataaccctagaattcttagtcaaggaataattcaagtcagcctagagaccatgttgactttcctcatgtgtttccttatgactcagtaagttggcaaggtcctgactttagtcttaataaaacattgaattgtagtaaaggtttttgtaataaaaacttactttggaaatatgtgca

SEQ ID NO: 37891 - DNA, 786 bp, Homo sapiens
gtgtctcccttataccccaaacagagcagctgaaaaagtctccaaaccgcaccagggtgttttttcatggggagaaggtggcagaacccccagaaagcccctcggaaggaaggaaggccatttagctgtgcacaggcagcccggccacagctggagctcagcggttacatctcaggactcttatgcatctatctgtcaccttttcagagacagtttaccaaggaatcaaacatgcggtggtgatgttccagacagcagtcgggcattccttcaagtgcgtgagtgaacagagcctccagttgtcagcccacctgcaggtgaaaacaaccgatgtccaacttcaagcctttgattttgaagatgaccactttggaaatggtaagttaagggtcgatcaggttgcaaacatacactttagagaccccagggtagatccaaagtgttttctgtctgcagctgtcgaaggagcttttttctcatgagcttcctgggatggtgtgattccacatagctcacagggccaggctcctctggccacctcagaatcaggcacctgcacccacccagtcacgggtgtcccgcagcggggtgcactctcttcgactcacgcacattcttactcatttaaacactcacgcgctcaatcaaaaaacagaaataccacctggggctttcctttatggcctgggggggggaaattcagatatggttggagaacactttaaagaccctgagtattagtaatgggctgaataaagaattgagaataggttgtttcccccctgg

SEQ ID NO: 37892 - DNA, 499 bp, Homo sapiens
gtgatctgtatgaatcacagcagatcatgggggaggaggattggcatgcagtgctgttgaaaattgggcttgttgttagatcagaacaacctccatgtatatggttagaacgaatcaattaatggaatcctagtatttctgcaagtttggtgatttttaaaaactggaatagaagcattaattcagtgcttagttctagtattagaaaacccctttgatgtaatgccttgtattaaccctttgagcattgtaagatatacaatgggggacaaaagcctttcagatcatttatttagacttagaccggtaaagtatactctatatccaaatgtctaattatgctgtttttttaaaggggggggtaggaagagaaagtgtttccacgccgaacacttgcattttatatacaactcttaatttttcttcaagagggcttgatatatttattcccaaatattcactgccatctaagtaagtgtactgtttacagaaaaaaaaa

SEQ ID NO: 37893 - DNA, 416 bp, Homo sapiens
accctacctactcccctccttcataattcacagatatctcctctaataaatctctttcagacttaatgccatcttgccatctgttttgtagagaacctagattaacatggataactttttaaaaacaacctacagtttttcagaaaatgtcatacaatgcttgttatttttttagtgtaatcatagtttaaacacttttatatcgcttgagggatttctgggaatttgtatgttgatcttttatgtacaaggctcatgccatggagtgttgtacataatgagtgtttggttagattgaattatgtctactaggtcccagttgctgagatctacaatgtgtcaaaatatatatattacctattattaaacttgtaagagcaagcataaagccacattctgctagtaaataacaaatg

SEQ ID NO: 37894 - DNA, 377 bp, Homo sapiens
ttttttttttgagacagagtctcgctctgtttcccaggctggagtgcagtggcacgattatctcactgcaacctccgcctcccgggttcaaaggattcttgtgcctcagcctctcaagtagctgggactacaggtgcatgccaccatgcctggctaattcttttgtatttttagtagagatggggtttcaccattttggccaggctggtctcaaactcctgacctcgtgatccacccgcctcggcctcccaaagtgctgggtttacaggcgtgagccaccatggccagccaaaagccccttttcttaaacaaaaaatgaatatgatctttaaaagctgcttctttttaagcttatatcaaactttctattccatctg

SEQ ID NO: 37895 - DNA, 361 bp, Homo sapiens
tcagactgtcctacccaatggcctctcctcaatcctgtccttccatcttccttttaaatgttggcttttatccaggttccaatcttgccctcttggcttcttgcttcctatgtacttccttgtggatttcatccatcaaagtcattgattctaattagggctggaatcaaatgagagagagagaaatactggagatattttgaacagcagctactattgttttgaaactcagttttatggtctatgagggattaatgcttaggtgagttaacatggttgaaagatagggaaatccctatgtttactatttatttatttattagagacaagtctcaatctgtctcccaggctggagtgcagt

SEQ ID NO: 37896 - DNA, 298 bp, Homo sapiens
ggtcgacggctgtgaaatgttgtgcacctgttggtgaactgaagctgttgctactgttccctgatttcacaggccacacagctctgtggacaggagcgttctaggaaggacaggcagagcatcccagcctgccccagaagaacacaggccagatgcctcaggatattcctttgggcccagcagctactcccaaaccgtgatgtgctcactgttgccctggggatggctatatttccatatggtcattaacatcataagtcataagttccctgagtcaggtgctctgtcccattagtct

SEQ ID NO: 37897 - DNA, 346 bp, Homo sapiens
tggcagcttccgcttgtggatctatgcccgtctagctcagatgttcatgcctggtgagcattatctggggtatttctgagccagcctacagttggatcttctgctcagctcttaaaatctctgattaaaccagagaatcaaatgtagtttacatcgcttctttgagcggccactcttagcaccctcccctttctaccactgttgaagatacttcctctagcaattaaacacctgaaaaagatgatgtgtgtcttcagctagtgctcgctctctctctctctctctctctctctctctctctctctctctctctccctctctttgttgtatgctggaaattgcagtc

SEQ ID NO: 37898 - DNA, 342 bp, Homo sapiens
ctgccctccccacagccttccgcagctactttgagatcttcaatggtcctggtgaggtggatgcacagagcctgaagaatatcctgctcctaatgggcttctctgtgacgctggcccaggtggaggacgccctgatgagtgctgatgtcaatggagatggtcgtgtggacttcaaagacttcttggctgtgatgacagacaccaggcgcttcttctgctctgtggaacagaacgccctgtcggacatggctccccacaacccccacactctactctttgagatcctgtccctgctggtagagatgctggccttaccagaggcagtcttagaggaaatcacaa

SEQ ID NO: 37899 - DNA, 659 bp, Homo sapiens
ggtaagacctggctggcaactgttgtgatatgtttatattcacatatggttaatgtgtagtatgtgctttgttatggaaatcataatgaagtaataatgtccaccttaataagataataaaattcagataatatgattaaatattgagtttatgtgaacacaaagtttgagggtagccactggggaaacacatcctgaagagtggggtcactgctcccactcttaactggagaagttaagtcttcacttctgtagggcaaaatgaagatgcttaatagggttacattttccatacaaagccaatgcatatatttcaatgatttcattggttgccgcttgccaaattgcagcttaccaaatttcaaggatgattgctttaactttttgtaaggaggggtagtggtatcaaaaggatcctacctctggcacttctcagtgttttctaatgacttatagcccaagaacaaggaagagagttaatctttttgacatgcacacggaaggagcaattacatggtagcgtaaacacatttctcaatatgtttattgagtgaaagggttagatactttccctgatgaggggtgataggtaagtgccttataatttccttccagcctataataaaccgagtttgagagattttgccggattcttcaaa

SEQ ID NO: 37900 - DNA, 859 bp, Homo sapiens
ttttttttttgagacggagtcttgctctgtcgcccaggctggagtgcagtggtgcgatctcggctcactacaagctccgcctcccgggttcacgccattctcctgcctcagcctccagagtagctgggactacaggcgcccgccaccacgcctggctaatttttttgtatttttagtagagacggggtttcactgtgttagctaggacggtctcgatctcctgacctcatgatccgcctgcttaggcctcccaaagtgctgggattacaggtgtgagccaccgcgcccagccccaaccaggtccagtcttaggaatagttgttaacatcacttttgatatcagcatttactagatctacaagttagactcagtatgtccctgcttttcaaataactataaacaacaaccctaagggaagaatgccttggatgagtgtaattatttgagcgtaagcaaaatgactttatttaaaacagtaagagcctggtgacagtaactccataatagaaaagaaacgtgaaccgcagcaccccgagcgtgaccgaaaacaagtgtaacaactcgcatcgcctgacctgagcgtggggacccagagaaaagcactgtcttccctcccactgggttgcttcccagactttccttgaagcacccagggtgttctgttcttgaaaaaaagatggggttggcacttccttcgctaccctggtacagagttcacagagatgctaatctgatccaccctggaacatttcctccctcaataaaattctctctccaaagacaaagcaaacagtgatgcagactgcaagaaaaccaagatgccacccatggtcaagggcagggacaagagaatgtgcg

SEQ ID NO: 37901 - DNA, 735 bp, Homo sapiens
ttggtcataaaagctcgcctgcggatcacgccttctccttgtgtatttttagtagagacggggtttcactgtgttagctaggacggtctcgatctcctgacctcatgatccgcctgcttaggcctcccaaagtgctgggattacaggtgtgagccaccgcgcccagccccaaccaggtccagtcttaggaatagttgttaacatcacttttgatatcagcatttactagatctacaagttagactcagtatgtccctgcttttcaaataactataaacaacaaccctaagggaagaatgccttggatgagtgtaattatttgagcgtaagcaaaatgactttatttaaaacagtaagagcctggtgacagtaactccataatagaaaagaaacgtgaaccgcagcaccccgagcgtgaccgaaaacaagtgtaacaactcgcatcgcctgacctgagcgtggggacccagagaaaagcactgtcttccctcccactgggttgcttcccagactttccttgaagcacccagggtgttctgttcttgaaaaaaagatggggttggcacttccttcgctaccctggtacagagttcacagagatgctaatctgatccaccctggaacatttcctccctcaataaaattctctctccaaagacaaagcaaacagtgatgcagactgcaagaaaaccaagatgccacccatggtcaagggcagggacaagagaatgtgcg

SEQ ID NO: 37902 - DNA, 271 bp, Homo sapiens
aatttcagggtctatgctcaaagttcctcagcttttctagccagatttacatattactttagttttgttttatttttaatggacatgtaattgtacatatttgtgaagtacaatgtaatgtttcaatacatgtatacattgtttagaaatcaaatcgggggccgagcccggtggctcactcctgtaatcccagcattttgggaggccaaggcaggcagatcaggaggtcaagagattgagaccatcctggccaacatggtgaaaccccgtc

SEQ ID NO: 37903 - DNA, 977 bp, Homo sapiens
gccccagcaactacagtgctttacaggaagtgttcgatgcaaatttgtatattttagaccggaaactgctccttttttttttttttttcgcatttttgaactgggtgtctcctcctgtgtctggatccagaaagtgaaaaaaattcaattcaaaatagcaacaagtttttatagctttattgtgtgaattgtgatggcgcctggaagtttcatccttcctctagattttcccactcagataccaagagaccaaagtccattctgtgttctgacttctgttcttctactgtgccctcaccctcttcttaactagcctttcttacatgcaagacagaaagatacagtatgtggtttataaatgcatattctgaacttttatttctttaatcccatagtatcttatttctatctgattccttttattgttttccaaatcttctcttgagaatattttgtttgctatccatttgaagatgagattctcagaagggtgaatgcttcattagagggtaggtgagcttgcaaggtgaattctactttgaagaagtcatcagtgtctgaacttgagctatttagtctcaaattttgtcaacatagagaatgaagccattcagggatgaacttaactttgtccaggctcataatgtataaaagtggtatataaatccagaatgctgatatattagctatatgatctcagcaagtgaccatggttaatataaatgttatttcttcaaagtctaatcctttgaaaatttactctgtatagacttgcattgcaactccatttcaactagaatgtttactcagaatattctgttctttaaactattttagataacacattttaaaaccatatatagataatatagttctaccaagtgacagtctttcatcaattgcttatgttcttttgaaatgtactttatgagattttttaaaagatcttaaatatgaataaaaatataggacaatga

SEQ ID NO: 37904 - DNA, 434 bp, Homo sapiens
gtgatgtgggaggctccacggcctccctcggtatcttggaagatggggatgatggtgatatccacatcgcggggctcttaggaagatgaagctacgtcatgcagcaggtctcaagaaggccaatctcctctctttccctgccctgtagtcccatctctctcctgcccagagttgagtcacctgggccagtgtaccctgaggccctggccagccttgcctcttcccctcaagggtctcagactggtgccaacagtcacattgtcacaccaaagccaggagtgcggagagaggatgtggacagggtctagatacctgaagctggggacacatggcctgcacgtctctactaaaaaattaaaaattagctgagtgcggtggtacatacctgtggtcctagctactcaggaggctgagacaggaagatcatttggagc

SEQ ID NO: 37905 - DNA, 547 bp, Homo sapiens
gatgtggtctcactatgttgcccaggctggtctcaaactcctggcctcaagtcatcctgtggcctcggcctgccagagttttgggattacaggcatgagccaccgagcctggccaggaaagttatttctaacagcacaagactgtttgataactgccaataggtactgaggtacaaagttgggggaagtggagagaaatgaccactagaaggttgtttttaaaataggaataaaaatgatgatttcctggccgggcacagtggctcacgcctgtaatcccagcactttgggaggctgaggcaggtggatcacctggggtcaggagttcaagaccagcctggccaacatggtgaaaccctgtctctacaaaaaaaaaaaaaaaagttggctggggtggtggcgggcacctataatcccagctactcgggaggctgaagcaggagaatggcttgaacctggaaggcagaggttgcagtgagctatgatggcaccactgcacttcagcctgggtgacagagcaagactccaactcaaaaaaaaaaaaaaa

SEQ ID NO: 37906 - DNA, 197 bp, Homo sapiens
ctctggggggccggcacagactgcggacacgggctagggccctgcaccctgcccccgcctgcttctgccatgcgtccctgtgtgtctgcatgtggcggtgtcctggtgtgcgggctcctctgtgagcaccagagcgactccatccactgtctgtgtcatctgtgtctgtgcaaatgtaattacttgtgcatcagagc

SEQ ID NO: 37907 - DNA, 253 bp, Homo sapiens
ggagagcctgcaggcaaccagctctgggggctgctgggcctgaggaaagcatcccaagtcaaggggctgctggacccaatggggcactgcaagtctggaccagggaaggatccacattttagctttgaggttggaaggacacttgtgttgggaagaaaagctacttaaatgctcagttgagcagttctgaattattcctccactctgttccttcttgaggttgagccctgccttctggttatttgagatcaag

SEQ ID NO: 37908 - DNA, 725 bp, Homo sapiens
agggaatttggccctcgaggcaaggagattcgggcacgagactgggtataacaatggaaaccattaaaaaggaaataggcaaataaccgaagggaaaattactgtggaatttcaaatgttgtgaaggaaggagataaaaagtggaatatacagttttattattttgaggattcaagggaaaattccccaccctacctctctacttgtccttttcttcatttttaaaaaatcacttgatttttaatttttttttaaacagggtcttgctctgttatccagattggagtgtagtggcatgatcacagctcactgcaacctcaacttatcttgcctcagcctcccaagtacctgggacagtaggtgtgtaccactgggcatggctaagatttatataaataaaatatccttccacctccgtctccctagtcattttttaatattgtgttgcgagttgtgtaaatggtgccaggatacaatttctaatccccttactcactaaatcatctccttcctgattttcgtaaagtccacactgagcaaaccctgatgcaaaagctagtgagggccatataagaaccacataaagaacctacatttgtgatgaattttgtcatgaaggaggtgacttgtgtctggattgtgatcatgtaatcatgcctccttgtattaatcctgcaaccaatataccatgtgagcttagatagtgaggctcttactttatttga

SEQ ID NO: 37909 - DNA, 348 bp, Homo sapiens
aattatttcacaatgtatgcatcatgttatacaccttaaatataaataatttttatttgtcatttatatctcaataaggttgggaaggaaagaaactattagatccctaaaaactttgttctttactataagcattttggaataacttttttttgcagatcttactatatcaattcaataagtaaagaagaatgttgtttaatctactgggtataacaatggaaaccattaaaaaggaaataggcaaataaccgaagggaaaattactgtggaatttcaaatgttgtgaaggaaggagataaaaagtggaatatacagttttattattttgaggattcaagggaaaat

SEQ ID NO: 37910 - DNA, 1250 bp, Homo sapiens
  misc_feature (1)..(3): n is a, c, g, or t
nnnggtgtccctgctccgctcctctcagtgagtgaaagtggccgccgccgccgccggcccagcgcccgcagccgcctcagcgccgccgccatcttggggtcccaggagccgcggagggagcgagctaggagcgtccacgcccaacgcagtcaccgtcccacggcctcagagagcgaaccgcggctccaccgtcggcggggcgacccccccctccggaccccgcccgcaccccgccccccctccgccgccgtcgcggcggcggggccaggcggcccgagccgtgcagtcggaggtccttgtgcatgaagacagatttgttctatggcctcggagttgggtgccagggatgatggaggctgcactgagctggcaaagcccctctatcttcagtacttggagagggccctccggttggaccattttctgcgacaaacgtcagctatcttcaataggaatatttctagtgatgacagtgaagatggactggatgacagtaatccattattgccccagtctggggatcccttaatacaagttaaggaagaacctccaaattcattgcttggtgaaacttctggagcaggcagttctggaatgttaaacacatattctctgaatggagttctacagtcagaatcaaaatgtgataaggggaatttatataatttctctaagctgaagaaaagcagaaagtggctaaagagcattctgctaagtgatgaatccagcgaggctgattctcagagtgaagacgatgatgaagaagaactcaatctcagcagagaagaacttcacaacatgcttcgactacacaaatataagaaacttcaccaaaataagtatagtaaagacaaggagttgcagcaatatcagtactacagtgcaggcctgctctccacatatgaccctttctatgagcaacaacggcacctacttggacccaagaaaaagaaatttaaggaggaaaagaaacttaaagctaagttgaaaaaagtgaagaaaaaaagacgaagagatgaagaactttcctctgaagaatcccctcgtcgccatcaccaccagaccaaagtctttgccaagttttctcacgatgcacctccccctggcactaagaaaaagcacttatccattgagcagctgaatgctcgtcgcaggaaagtatggctcagcattgtgaaaaaggaactaccaaaggcaataagcagaaagcttcacgctcgtaacctgttctcaccatacccgcgcacgtc

SEQ ID NO: 37911 - DNA, 510 bp, Homo sapiens
cccatgttttattgcattttagtttgtattccctaagtttaattagtattcttaatgtttttcagttgaatttataaagcatgtcataaggggaactggagtgactatctttctgctgtttttgtcattgttttggatctaggaaaaaatgcttggattataaatgggattgcttcacagcaaaagatacatttctattttcacccttttcagagcattctgctaagtgatgaatccagcgaggctgattctcagagtgaagacgatgatgaagaagaactcaatctcagcagagaagaacttcacaacatgcttcgactacacaaatataagaaacttcaccaaaataagtatagtaaagacaaggaggtaagagtttcaggagaaacacttcaaactgaatattcaccctctgctttatagtcattaaagatacatcattttggctgggcgtggtggctcacacctataatcccagcactttgggaggacgaggcgggcggatcatga

SEQ ID NO: 37912 - DNA, 472 bp, Homo sapiens
gtgcagtttacctacagatacagaaaaggtcaataaacaagaacagaactgttaaccacaattgcaataagagggaggaagtggaatggaaggagtagggggcttctgctgtatctacatatatatctgaaggacataagagcaaattttttaaattttaaaaaggtagatggtgggtgtagaaacttccaggccgggtgcagtagctcacgcctgtagtcccagcactttgggagggctgggctggaggatcgcttgagcccaggaatttgagaccagcctaggcaacatagcgaccccatctctataaaatatagaacgattagctgggcacagtggtgtgtgcctgtggtcccagtggcatgtgcccatggtcccagctatttgggaggctgactcagaaggatcacttgggcccgggaagtcgagatggcagtgagctgtgattgtgccacttggcagactgggcaac

SEQ ID NO: 37913 - DNA, 141 bp, Homo sapiens
attaacatcagagacgagaacaaagaatcaggaattttatagaaattcatgcgggacacattttaagaacatcctacacctattcacatgtcttagtcttctcaggctactgtaacaaaatcccatagacttggtggttta

SEQ ID NO: 37914 - DNA, 361 bp, Homo sapiens
ataatgactgaataaaaccataaaaactgaaatcttaagaacaggggaaaaagatgattcctgactgcaagccacatggatgcagaggacccatttttttaaaaaaagtttgtttctctattcaagccttcttaagtttgatcattcttatgatcttctctttgcctcaaataaaaccaccattattgtgccttttatgactcttgattcctgttggcagtggtaggaataggaactataactactgtttcttcttagtttattttaaccttttcattaccctgagtcacagtcaaactatgacttagaaatagaaggttacaaatagaagggttttataaaaagacccaccaaaaaaaaa

SEQ ID NO: 37915 - DNA, 281 bp, Homo sapiens
gaggcgtgagcttagctgctgtgaccagaaggaccaaaaacattgttcatccaaaagataagatgaaggccaaaaaagaccatcatcatattgaacacacacacacacacacacacaggcgcgcgcgcgcgcgcaatccaaaatcattatattctggtctaataagaaatgttcagttctgtaacggacttaagatttgggatagagaaaggcaactaaaagttatcagtgcaacctcactgaaggtcaactaaagtaattagggctcttctgtttaaaaa

SEQ ID NO: 37916 - DNA, 331 bp, Homo sapiens
ttgtgacttgctttgaccaaaggaatggagcagaagtcatattcttctgagccaggcctcaagatgccttgcagcttctacctttagcccttagcctcttggaatgtgttactgcccttgaagcagctcagctagcttgctggaggatgagaccgcatgaagcaggaggaagctgtcccagctgggtcccctaggccaaccagctctaaggggagtcaagagatgactgcaaagagatgactgcagctccttgggcaaccctggggccaaccactgtcagaagaaccacacagccaaaaccagcccaaattcctggcccacaggtttgtga

SEQ ID NO: 37917 - DNA, 492 bp, Homo sapiens
gtacttagtgagatgaataggaaaaagtatgtctactcaatttttccagaagtctttgctgtcaacctttactaaattagtaggtttccttttattcctggttttctaaaagtttattttttaaacataaatggttttttacatttaaaaaatagtttatcagaattgactcatttcattgtattttccttcttaatctcctaatatagtgaattatattgagagatttttaaaatgtgaaacatctttgcattcctgggataaaccctatttgttcatcctatagttacacatttactgttggtgttatttagttaatattttacttgggttgttgtatttacttttataaagcatggacgtaaaacttgcctttcttgtatttccttgtttgtttttgtaataaaaatttctctaaacaataacctaggcagattttgttcttcattctgtttcctggaataataaatagaaatgtcttttcaaagggca

SEQ ID NO: 37918 - DNA, 478 bp, Homo sapiens
ccagtaatttcatatcttagaatctatcccaagcaaattgttagaagtatgaaccaagagctgactcattgctgagtaacttatcaatagcaaataaccaaatagaagatctgaaataaaccaaacagaagatctgaaaccacttaagtgtctctaggaagttgaataaaatgttacatccatatgatgaaacactgtacaatcataagttatgttttaaatgatgatattgggaaatattcaaaatctattatatggggaagtttacagtttactttgggggttgggttatggtgggattagatttgtggcttttttttctttaaaaacatttttatgtgggaaatacattagaaggacttctccaaatgttaagcagttatctctgggtaatgggttgatggataattttatcccttgtatacttcattgtaaaattattttacaacaatatatattccaaaataagaaaaaaaat

SEQ ID NO: 37919 - DNA, 786 bp, Homo sapiens
tgaatactttctgtgactcaaggtaatcagggcattccatatatttctaattttgaaatttgcataattgtgaaaattatttctccaactcttggacctatgagaatgttggaagggaaaactttcacgctgctgacctaaaatcataatgaaaacatgatctgaaggagataacatttcaaggcaagtgtagagagtgcgttaacattttttatgtcactgcagggtgttttctgggtcttgagccaatatgcacgtcttagtcctcatgaccaccaagttcaagctcctgtgcaatttgctgatcgtagatgactagttcctccgtaatgaggaggtgctgtgattctcaagcacggaggccagcacagatctggatctagggaggtgctgtggtccttaaaacacagagccaaaagccaaactgcagctgaaaagaattacagcatttcgctaatgtaatcagggatacgcagctgtgttcactgttctctagtcctttcatgttgctagaggggagaaaagatagtttttcctctacccatcataggttcatggccaaggccctgataacaaaaaaacagattaacaagcaaaaagcatacagttgggcacagcagcaggtgcctataatccctgttatagcaggtgcctataattccagttacttggaaggctgaggtgggaggatcccttgaggccagtagttggagactagcctgggcaacagtgaggcaccacctccccacactcacacacacacacactccagccccatttcttaaa

SEQ ID NO: 37920 - DNA, 290 bp, Homo sapiens
attgcagatctaccatatggctttgtgtttaataccattagcttcagctacctcagagcagtattatgtttcagccattctaatcactgtttggcccatagaaaaaaatttatgttgttttacaaattgatcgaactcccacagtaggaaaagacaaagatgatatgtaattctgatagtgcacaatatgtggcaatgataggataatattcaatatattagaaatatatttttttctgatcgaacattttcctctcctttcactaaaatataaacaaagtttaacaaag

SEQ ID NO: 37921 - DNA, 591 bp, Homo sapiens
aggacacgttcacaagctttcccttttcctaaggctgaactggagagaaggaataaacacacacacacacacacactcacagagacacacacaaaatagtgtgtctctctatatagtgcatatatatatatatatatatatacatatagtcacacaccgcttaacaatgtatcccttaacaacagggatacattctgggaaattcatcattagatttcatcgtcgtgtgaacaaacctgcatagtacagcctgctacacacctaggctagatggtacagcctattgctcctaggctacaaagctgtacaacatgttactgtactgaatactataggccattgtaacacaatggtattggtgtatctaaacatagaaaaattacagtaaaaatgttataaagattaaaaatggtccaccatgaatggagcttgcaggactggaagttgctctgggtgagtgagtgagtggagggagtatgaggcctaggacattactatacactactgtagactctaaaaaatgctgtacacttatgctacacattgattgaaaacttttctttcttcaataataaatttactctaacattt

SEQ ID NO: 37922 - DNA, 504 bp, Homo sapiens
cttgaaaatagacattctcttctttaaacaacataaactgaacaaactcagtctgttttggtgcctctgtgagtaccctcggttgctctgggctgctgtgcgatgctgaccgggacttcctcagaggcctcatcttctgcatccagtggactgcaagccactttacacttcctgggtgataaggtttggatttgtgtccccgcccaaatctcatgtggaatgtcattcctaatgttggaagaggggcctggtgggaggtgattggatcatgggggcagaattccctcttgcagttctcttggtagtgagttctcacaagatctggttgtttaaaagtatgtagcacctcctgctttcgctgtcttcctcctgctcccgccatgtaagacgtggcctcctttcccttcgccttccgccatgattgaaagtcttcagaggcctccccagccatgcttcatgtacagcctgtggaactgtgagccaattaaacctcttttcttcata

SEQ ID NO: 37923 - DNA, 334 bp, Homo sapiens
cagttcttacaggcaggcttcaaaattgaaaagccagaaacttaagcaaagaagaaaaatttaagttgaaagaactgttcatcaaattcaatgcaatacgaactctttgaggagttattttcaactgctgtgtttaaaaataccacttttcccacagttagtagttaggatttcatcataaaatactcccataaaaactatttaattttctagtacagggagggaggatttgatcccttgttaaacattttatgggaaagtctaaaagtgctttcaattatttatcgaattgaaatctaggccttggaaactgctggcatcacacacacacaca

SEQ ID NO: 37924 - DNA, 340 bp, Homo sapiens
tctcccctatgactgatctcagtccttgcctggccactcctgcctgtcctacaaacaccgaaaaccactgtccttttctcagccgtcatttagcagtcgggaagcgtgtgtcctgacgtatgggctgcagtcaaggcgggggccctgacaaacaggattcattcaccaggccctggcctgccagctccctcacgggcgtcacatggggccgaatgaaaagagcagggggtgcccgccagggaggcctatccaggggctttcttccccgcggcgccgttccctgggcctgccaagtcccacgagccagcacactggagaagcgttttcaaagcgaggcctt

SEQ ID NO: 37925 - DNA, 2118 bp, Homo sapiens
caagacttctctgcattttctgccaaaatctgtgtcagatttaagacacatgcttctgcaagcttccatgaaggttgtgcaaaaaagtttcaatccagagttgggttccagctttctgtagctgtaagcattggtggccacaccacctccttacaaagcaactagaacctgcggcatacattggagagatttttttaattttctggacatgaagtaaatttagagtgctttctaatttcaggtagaagacatgtccaccttctgattatttttggagaacattttgatttttttcatctctctctccccacccctaagattgtgcaaaaaaagcgtaccttgcctaattgaaataatttcattggattttgatcagaactgattatttggttttctgtgtgaagttttgaggtttcaaactttccttctggagaatgccttttgaaacaattttctctagctgcctgatgtcaactgcttagtaatcagtggatattgaaatattcaaaatgtacagagagtgggtagtggtgaatgttttcatgatgttgtacgtccagctggtgcagggctccagtaatgaacatggaccagtgaagcgatcatctcagtccacattggaacgatctgaacagcagatcagggctgcttctagtttggaggaactacttcgaattactcactctgaggactggaagctgtggagatgcaggctgaggctcaaaagttttaccagtatggactctcgctcagcatcccatcggtccactaggtttgcggcaactttctatgacattgaaacactaaaagttatagatgaagaatggcaaagaactcagtgcagccctagagaaacgtgcgtggaggtggccagtgagctggggaagagtaccaacacattcttcaagcccccttgtgtgaacgtgttccgatgtggtggctgttgcaatgaagagagccttatctgtatgaacaccagcacctcgtacatttccaaacagctctttgagatatcagtgcctttgacatcagtacctgaattagtgcctgttaaagttgccaatcatacaggttgtaagtgcttgccaacagccccccgccatccatactcaattatcagaagatccatccagatccctgaagaagatcgctgttcccattccaagaaactctgtcctattgacatgctatgggatagcaacaaatgtaaatgtgttttgcaggaggaaaatccacttgctggaacagaagaccactctcatctccaggaaccagctctctgtgggccacacatgatgtttgacgaagatcgttgcgagtgtgtctgtaaaacaccatgtcccaaagatctaatccagcaccccaaaaactgcagttgctttgagtgcaaagaaagtctggagacctgctgccagaagcacaagctatttcacccagacacctgcagctgtgaggacagatgcccctttcataccagaccatgtgcaagtggcaaaacagcatgtgcaaagcattgccgctttccaaaggagaaaagggctgcccaggggccccacagccgaaagaatccttgattcagcgttccaagttccccatccctgtcatttttaacagcatgctgctttgccaagttgctgtcactgtttttttcccaggtgttaaaaaaaaaatccattttacacagcaccacagtgaatccagaccaaccttccattcacaccagctaaggagtccctggttcattgatggatgtcttctagctgcagatgcctctgcgcaccaaggaatggagaggaggggacccatgtaatccttttgtttagttttgtttttgttttttggtgaatgagaaaggtgtgctggtcatggaatggcaggtgtcatatgactgattactcagagcagatgaggaaaactgtagtctctgagtcctttgctaatcgcaactcttgtgaattattctgattcttttttatgcagaatttgattcgtatgatcagtactgactttctgattactgtccagcttatagtcttccagtttaatgaactaccatctgatgtttcatatttaagtgtatttaaagaaaataaacaccattattcaagccatataatt

SEQ ID NO: 37926 - DNA, 980 bp, Homo sapiens
gaaggagatgggtgaatccaagttacttacggatgacataaaagatacaatcaacttggtgatccaatgccacactacaactatctgaccaacacgtttctgtttctctttagaccactctcatctccaggaaccagctctctgtgggccacacatgatgtttgacgaagatcgttgcgagtgtgtctgtaaaacaccatgtcccaaagatctaatccagcaccccaaaaactgcagttgctttgagtgcaaagaaagtctggagacctgctgccagaagcacaagctatttcacccagacacctgcagctgtgaggacagatgcccctttcataccagaccatgtgcaagtggcaaaacagcatgtgcaaagcattgccgctttccaaaggagaaaagggctgcccaggggccccacagccgaaagaatccttgattcagcgttccaagttccccatccctgtcatttttaacagcatgctgctttgccaagttgctgtcactgtttttttcccaggtgttaaaaaaaaaatccattttacacagcaccacagtgaatccagaccaaccttccattcacaccagctaaggagtccctggttcattgatggatgtcttctagctgcagatgcctctgcgcaccaaggaatggagaggaggggacccatgtaatccttttgtttagttttgtttttgttttttggtgaatgagaaaggtgtgctggtcatggaatggcaggtgtcatatgactgattactcagagcagatgaggaaaactgtagtctctgagtcctttgctaatcgcaactcttgtgaattattctgattcttttttatgcagaatttgattcgtatgatcagtactgactttctgattactgtccagcttatagtcttccagtttaatgaactaccatctgatgtttcatatttaagtgtatttaaagaaaataaacaccattattcaagccatataatt

SEQ ID NO: 37927 - DNA, 1024 bp, Homo sapiens
agctggtacggtcgggattttaggatgaagatccatccagatcctaaagaagatcgctgttcccattccaagaaactctgtcctattgacatgctatgggatagcaacaaatgtaaatgtgttttgcaggaggaaaatccacttgctggaacagaagaccactctcatctccaggaaccagctctctgtgggccacacatgatgtttgacgaagatcgttgcgagtgtgtctgtaaaacaccatgtcccaaagatctaatccagcaccccaaaaactgcagttgctttgagtgcaaagaaagtctggagacctgctgccagaagcacaagctatttcacccagacacctgcagctgtgaggacagatgcccctttcataccagaccatgtgcaagtggcaaaacagcatgtgcaaagcattgccgctttccaaaggagaaaagggctgcccaggggccccacagccgaaagaatccttgattcagcgttccaagttccccatccctgtcatttttaacagcatgctgctttgccaagttgctgtcactgtttttttcccaggtgttaaaaaaaaaatccattttacacagcaccacagtgaatccagaccaaccttccattcacaccagctaaggagtccctggttcattgatggatgtcttctagctgcagatgcctctgcgcaccaaggaatggagaggaggggacccatgtaatccttttgtttagttttgtttttgttttttggtgaatgagaaaggtgtgctggtcatggaatggcaggtgtcatatgactgattactcagagcagatgaggaaaactgtagtctctgagtcctttgctaatcgcaactcttgtgaattattctgattcttttttatgcagaatttgattcgtatgatcagtactgactttctgattactgtccagcttatagtcttccagtttaatgaactaccatctgatgtttcatatttaagtgtatttaaagaaaataaacaccattattcaagccatataatt

SEQ ID NO: 37928 - DNA, 2150 bp, Homo sapiens
  misc_feature (2120)..(2120): n is a, c, g, or t
caagacttctctgcattttctgccaaaatctgtgtcagatttaagacacatgcttctgcaagcttccatgaaggttgtgcaaaaaagtttcaatccagagttgggttccagctttctgtagctgtaagcattggtggccacaccacctccttacaaagcaactagaacctgcggcatacattggagagatttttttaattttctggacatgaagtaaatttagagtgctttctaatttcaggtagaagacatgtccaccttctgattatttttggagaacattttgatttttttcatctctctctccccacccctaagattgtgcaaaaaaagcgtaccttgcctaattgaaataatttcattggattttgatcagaactgattatttggttttctgtgtgaagttttgaggtttcaaactttccttctggagaatgccttttgaaacaattttctctagctgcctgatgtcaactgcttagtaatcagtggatattgaaatattcaaaatgtacagagagtgggtagtggtgaatgttttcatgatgttgtacgtccagctggtgcagggctccagtaatgaacatggaccagtgaagcgatcatctcagtccacattggaacgatctgaacagcagatcagggctgcttctagtttggaggaactacttcgaattactcactctgaggactggaagctgtggagatgcaggctgaggctcaaaagttttaccagtatggactctcgctcagcatcccatcggtccactaggtttgcggcaactttctatgacattgaaacactaaaagttatagatgaagaatggcaaagaactcagtgcagccctagagaaacgtgcgtggaggtggccagtgagctggggaagagtaccaacacattcttcaagcccccttgtgtgaacgtgttccgatgtggtggctgttgcaatgaagagagccttatctgtatgaacaccagcacctcgtacatttccaaacagctctttgagatatcagtgcctttgacatcagtacctgaattagtgcctgttaaagttgccaatcatacaggttgtaagtgcttgccaacagccccccgccatccatactcaattatcagaagatccatccagatccctgaagaagatcgctgttcccattccaagaaactctgtcctattgacatgctatgggatagcaacaaatgtaaatgtgttttgcaggaggaaaatccacttgctggaacagaagaccactctcatctccaggaaccagctctctgtgggccacacatgatgtttgacgaagatcgttgcgagtgtgtctgtaaaacaccatgtcccaaagatctaatccagcaccccaaaaactgcagttgctttgagtgcaaagaaagtctggagacctgctgccagaagcacaagctatttcacccagacacctgcagctgtgaggacagatgcccctttcataccagaccatgtgcaagtggcaaaacagcatgtgcaaagcattgccgctttccaaaggagaaaagggctgcccaggggccccacagccgaaagaatccttgattcagcgttccaagttccccatccctgtcatttttaacagcatgctgctttgccaagttgctgtcactgtttttttcccaggtgttaaaaaaaaaatccattttacacagcaccacagtgaatccagaccaaccttccattcacaccagctaaggagtccctggttcattgatggatgtcttctagctgcagatgcctctgcgcaccaaggaatggagaggaggggacccatgtaatccttttgtttagttttgtttttgttttttggtgaatgagaaaggtgtgctggtcatggaatggcaggtgtcatatgactgattactcagagcagatgaggaaaactgtagtctctgagtcctttgctaatcgcaactcttgtgaattattctgattcttttttatgcagaatttgattcgtatgatcagtactgactttctgattactgtccagcttatagtcttccagtttaatgaactaccatctgatgtttcatatttaagtgtatttaaagaaaataaacaccgatgcggccaccctttccctcntcccttcaccgcgcattcgtcccccccttc

SEQ ID NO: 37929 - DNA, 5118 bp, Homo sapiens
  misc_feature (2)..(2): n is a, c, g, or t
  misc_feature (4)..(7): n is a, c, g, or t
  misc_feature (10)..(12): n is a, c, g, or t
gnannnngcnnngaggacgagggggagggccagagctgcgcgtgctgctttgcccgagcccgagcccgagcccgagcccgagcccgagcccgagcccgagcccgaacgcaagcctgggagcgcggagcccggctagggactcctcctatttatggagcaggcacccaacatggctgagccccggggccccgtagaccatggagtccagattcgcttcatcacagagccagtgagtggtgcagagatgggcactctacgtcgaggtggacgacgcccagctaaggatgcaagagccagtacctacggggttgctgtgcgtgtgcagggaatcgctgggcagccctttgtggtgctcaacagtggggagaaaggcggtgactcctttggggtccaaatcaagggggccaatgaccaaggggcctcaggagctctgagctcagatttggaactccctgagaacccctactctcaggtcaagggatttcctgccccctcgcagagcagcacatctgatgaggagcctggggcctactggaatggaaagctactccgttcccactcccaggcctcactggcaggccctggcccagtggatcctagtaacagaagcaacagcatgctggagctagccccgaaagtggcttccccaggtagcaccattgacactgctcccctgtcttcagtggactcactcatcaacaagtttgacagtcaacttggaggccaggcccggggtcggactggccgccgaacacggatgctaccccctgaacagcgcaaacggagcaagagcctggacagccgcctcccacgggacacctttgaggaacgggagcgccagtccaccaaccactggacctctagcacaaaatatgacaaccatgtgggcacttcgaagcagccagcccagagccagaacctgagtcctctcagtggctttagccgttctcgtcagactcaggactgggtccttcagagttttgaggagccgcggaggagtgcacaggaccccaccatgctgcagttcaaatcaactccagacctccttcgagaccagcaggaggcagccccaccaggcagtgtggaccatatgaaggccaccatctatggcatcctgagggagggaagctcagaaagtgaaacctctgtgaggaggaaggttagtttggtgctggagaagatgcagcctctagtgatggtttcttctggttctactaaggccgtggcagggcagggtgagcttacccgaaaagtggaggagctacagcgaaagctggatgaagaggtgaagaagcggcagaagctagagccatcccaagttgggctggagcggcagctggaggagaaaacagaagagtgcagccgactgcaggagctgctggagaggaggaagggggaggcccagcagagcaacaaggagctccagaacatgaagcgcctcttggaccagggtgaagatttacgacatgggctggagacccaggtgatggagctgcagaacaagctgaaacatgtccagggtcctgagcctgctaaggaggtgttactgaaggacctgttagagacccgggaacttctggaagaggtcttggaggggaaacagcgagtagaggagcagctgaggctgcgggagcgggagttgacagccctgaagggggccctgaaagaggaggtagcctcccgtgaccaggaggtggaacatgtccggcagcagtaccagcgagacacagagcagctccgcaggagcatgcaagatgcaacccaggaccatgcagtgctggaggccgagaggcagaagatgtcagcccttgtgcgagggctgcagagggagctggaggagacttcagaggagacagggcattggcagagtatgttccagaagaacaaggaggatcttagagccaccaagcaggaactcctgcagctgcgaatggagaaggaggagatggaagaggagcttggagagaagatagaggtcttgcagagggaattagagcaggcccgagctagtgctggagatactcgccaggttgaggtgctcaagaaggagctgctccggacacaggaggagcttaaggaactgcaggcagaacggcagagccaggaggtggctgggcgacaccgggaccgggagttggagaagcagctggcggtcctgagggtcgaggctgatcgaggtcgggagctggaagaacagaacctccagctacaaaagaccctccagcaactgcgacaggactgtgaagaggcttccaaggctaagatggtggccgaggcagaggcaacagtgctggggcagcggcgggccgcagtggagacgacgcttcgggagacccaggaggaaaatgacgaattccgccggcgcatcctgggtttggagcagcagctgaaggagactcgaggtctggtggatggtggggaagcggtggaggcacgactacgggacaagctgcagcggctggaggcagagaaacagcagctggaggaggccctgaatgcgtcccaggaagaggaggggagtctggcagcagccaagcgggcactggaggcacgcctagaggaggctcagcgggggctggcccgcctggggcaggagcagcagacactgaaccgggccctggaggaggaagggaagcagcgggaggtgctccggcgaggcaaggctgagctggaggagcagaagcgtttgctggacaggactgtggaccgactgaacaaggagttggagaagatcggggaggactctaagcaagccctgcagcagctccaggcccagctggaggattataaggaaaaggcccggcgggaggtggcagatgcccagcgccaggccaaggattgggccagtgaggctgagaagacctctggaggactgagccgacttcaggatgagatccagaggctgcggcaggccctgcaggcatcccaggctgagcgggacacagcccggctggacaaagagctactggcccagcgactgcaggggctggagcaagaggcagagaacaagaagcgttcccaggacgacagggcccggcagctgaagggtctcgaggaaaaagtctcacggctggaaacagagttagatgaggagaagaacaccgtggagctgctaacagatcgggtgaatcgtggccgggaccaggtggatcagctgaggacagagctcatgcaggaaaggtctgctcggcaggacctggagtgtgacaaaatctccttggagagacagaacaaggacctgaagacccggttggccagctcagaaggcttccagaagcctagtgccagcctctctcagcttgagtcccagaatcagttgttgcaggagcggctacaggctgaagagagggagaagacagttctgcagtctaccaatcgaaaactggagcggaaagttaaagaactatccatccagattgaagacgagcggcagcatgtcaatgaccagaaagaccagctaagcctgagggtgaaggctttgaagcgtcaggtggatgaagcagaagaggaaattgagcgactggacggcctgaggaagaaggcccagcgtgaggtggaggagcagcatgaggtcaatgaacagctccaggcccggatcaagtctctggagaaggactcctggcgcaaagcttcccgctcagctgctgagtcagctctcaaaaacgaagggctgagctcagatgaggaattcgacagtgtctacgatccctcgtccattgcatcactgcttacggagagcaacctacagaccagctcctgttagctcgtggtcctcaaggactcagaaaccaggctcgaggcctatcccagcaagtgctgctctgctctgcccaccctgggttctgcattcctatgggtgacccaattattcagacctaagacagggaggggtcagagtgatggtgataaaaaaaaaaaaatcatcagcaataagctgatagatggactttccactgtaggagtggacgtttcaagccaactgagccttttcctcaagtgccgacacctccctcatctctcttatagtggaaggatggtcagcattaggctgatggggactgagaaggataggaagggatagaaattgccatgtgtataaagctttattctttagcccttaaccctaaggctcagggaaataccctatgttattgtgctccctggattcctgcaactcattttccttccactctggagcagggtgaggggaatgttatgggtaacagacatgcaggcatggctctacccatttctttgcacaagtatggggcccatgtggtagtccccatacccctccagttcctatatttttgtcttcttcctttcccctctttgccattcctaccttgcatttttcctgtcagtgccttagccaaggcaaggagataaggatgctcttcttgctttttatatctgcacattcatacctctccaaagaccagcttttccccagccagggccctcagccttccctgctgccccagtgattgattgagagagctgttggggtttctctgccaatgacccctgggagagggactttggtagggtcatgataaagtggcgggggtctggtcctgctcagggttttcatccttcctcctctccctcctctgtgactgtggatatggttataaggtggttgcacctgggagccctgacaactggctgcacaaattccaaaagtaaaggtgtcagtccctgtggccttccttggggcttctctgaccacatgtgcccaacttcaataagagaaccaagggaccctcattttctgaggtgcttggctctgattcagggctttgcaaggggttagaagctgactgtaaaaatgggaagaggcaacggaagacatttatttctcctttggattttggggagaaccaagccctggtagggaagaggtaagggggatgattcacctccatatttcctaagcaggttgtatagggagccggtggcaggaggaaggctgttttcacaaatgacttgtaatgtcgtgattaaaaaaattcctatattcttctgcaaatcaaacgttctttcccaatccaatccagccttggttttattttaaattaaatattaaaattacacatttatattgaaaaaaaaagt

SEQ ID NO: 37930 - DNA, 424 bp, Homo sapiens
tatgttgacttctgctctggtgtcatattacgggtgcatacagaacccacataccatgaaggccaccatctatgcatcctgagggagggaagctcagaaagtgaaacctctgtgaggaggaaggttagtttggtgctggagaagatgcagcctctagtgatggtttcttctggttctactaaggccgtggcagggcagggtgagcttacccgaaaagtggaggagctacagcgaaagctggatgaagaggtgaagaagcggcagaagctagagccatcccaagttgggctggagcggcagctggaggagaaaacagaagagtgcagccgactgcaggagctgctggagaggaggaagggggaggcccagcagagcaacaaggacgacgcagagcagaaggtcgacgcagggcagaaggtcgacg

SEQ ID NO: 37931 - DNA, 3413 bp, Homo sapiens
ttgatttgaagtgacctcttccctctgagccttctggtgtccaactctccccttctctaggaccatgcagtgctggaggccgagaggcagaagatgtcagcccttgtgcgagggctgcagagggagctggaggagacttcagaggagacagggcattggcagagtatgttccagaagaacaaggaggatcttagagccaccaagcaggaactcctgcagctgcgaatggagaaggaggagatggaagaggagcttggagagaagatagaggtcttgcagagggaattagagcaggcccgagctagtgctggagatactcgccaggttgaggtgctcaagaaggagctgctccggacacaggaggagcttaaggaactgcaggcagaacggcagagccaggaggtggctgggcgacaccgggaccgggagttggagaagcagctggcggtcctgagggtcgaggctgatcgaggtcgggagctggaagaacagaacctccagctacaaaagaccctccagcaactgcgacaggactgtgaagaggcttccaaggctaagatggtggccgaggcagaggcaacagtgctggggcagcggcgggccgcagtggagacgacgcttcgggagacccaggaggaaaatgacgaattccgccggcgcatcctgggtttggagcagcagctgaaggagactcgaggtctggtggatggtggggaagcggtggaggcacgactacgggacaagctgcagcggctggaggcagagaaacagcagctggaggaggccctgaatgcgtcccaggaagaggaggggagtctggcagcagccaagcgggcactggaggcacgcctagaggaggctcagcgggggctggcccgcctggggcaggagcagcagacactgaaccgggccctggaggaggaagggaagcagcgggaggtgctccggcgaggcaaggctgagctggaggagcagaagcgtttgctggacaggactgtggaccgactgaacaaggagttggagaagatcggggaggactctaagcaagccctgcagcagctccaggcccagctggaggattataaggaaaaggcccggcgggaggtggcagatgcccagcgccaggccaaggattgggccagtgaggctgagaagacctctggaggactgagccgacttcaggatgagatccagaggctgcggcaggccctgcaggcatcccaggctgagcgggacacagcccggctggacaaagagctactggcccagcgactgcaggggctggagcaagaggcagagaacaagaagcgttcccaggacgacagggcccggcagctgaagggtctcgaggaaaaagtctcacggctggaaacagagttagatgaggagaagaacaccgtggagctgctaacagatcgggtgaatcgtggccgggaccaggtggatcagctgaggacagagctcatgcaggaaaggtctgctcggcaggacctggagtgtgacaaaatctccttggagagacagaacaaggacctgaagacccggttggccagctcagaaggcttccagaagcctagtgccagcctctctcagcttgagtcccagaatcagttgttgcaggagcggctacaggctgaagagagggagaagacagttctgcagtctaccaatcgaaaactggagcggaaagttaaagaactatccatccagattgaagacgagcggcagcatgtcaatgaccagaaagaccagctaagcctgagggtgaaggctttgaagcgtcaggtggatgaagcagaagaggaaattgagcgactggacggcctgaggaagaaggcccagcgtgaggtggaggagcagcatgaggtcaatgaacagctccaggcccggatcaagtctctggagaaggactcctggcgcaaagcttcccgctcagctgctgagtcagctctcaaaaacgaagggctgagctcagatgaggaattcgacagtgtctacgatccctcgtccattgcatcactgcttacggagagcaacctacagaccagctcctgttagctcgtggtcctcaaggactcagaaaccaggctcgaggcctatcccagcaagtgctgctctgctctgcccaccctgggttctgcattcctatgggtgacccaattattcagacctaagacagggaggggtcagagtgatggtgataaaaaaaaaaaaatcatcagcaataagctgatagatggactttccactgtaggagtggacgtttcaagccaactgagccttttcctcaagtgccgacacctccctcatctctcttatagtggaaggatggtcagcattaggctgatggggactgagaaggataggaagggatagaaattgccatgtgtataaagctttattctttagcccttaaccctaaggctcagggaaataccctatgttattgtgctccctggattcctgcaactcattttccttccactctggagcagggtgaggggaatgttatgggtaacagacatgcaggcatggctctacccatttctttgcacaagtatggggcccatgtggtagtccccatacccctccagttcctatatttttgtcttcttcctttcccctctttgccattcctaccttgcatttttcctgtcagtgccttagccaaggcaaggagataaggatgctcttcttgctttttatatctgcacattcatacctctccaaagaccagcttttccccagccagggccctcagccttccctgctgccccagtgattgattgagagagctgttggggtttctctgccaatgacccctgggagagggactttggtagggtcatgataaagtggcgggggtctggtcctgctcagggttttcatccttcctcctctccctcctctgtgactgtggatatggttataaggtggttgcacctgggagccctgacaactggctgcacaaattccaaaagtaaaggtgtcagtccctgtggccttccttggggcttctctgaccacatgtgcccaacttcaataagagaaccaagggaccctcattttctgaggtgcttggctctgattcagggctttgcaaggggttagaagctgactgtaaaaatgggaagaggcaacggaagacatttatttctcctttggattttggggagaaccaagccctggtagggaagaggtaagggggatgattcacctccatatttcctaagcaggttgtatagggagccggtggcaggaggaaggctgttttcacaaatgacttgtaatgtcgtgattaaaaaaattcctatattcttctgcaaatcaaacgttctttcccaatccaatccagccttggttttattttaaattaaatattaaaattacacatttatattgaaaaaaaaagt

SEQ ID NO: 37932 - DNA, 5429 bp, Homo sapiens
  misc_feature (2)..(2): n is a, c, g, or t
  misc_feature (4)..(7): n is a, c, g, or t
  misc_feature (10)..(12): n is a, c, g, or t
gnannnngcnnngaggacgagggggagggccagagctgcgcgtgctgctttgcccgagcccgagcccgagcccgagcccgagcccgagcccgagcccgagcccgaacgcaagcctgggagcgcggagcccggctagggactcctcctatttatggagcaggcacccaacatggctgagccccggggccccgtagaccatggagtccagattcgcttcatcacagagccagtgagtggtgcagagatgggcactctacgtcgaggtggacgacgcccagctaaggatgcaagagccagtacctacggggttgctgtgcgtgtgcagggaatcgctgggcagccctttgtggtgctcaacagtggggagaaaggcggtgactcctttggggtccaaatcaagggggccaatgaccaaggggcctcaggagctctgagctcagatttggaactccctgagaacccctactctcaggtcaagggatttcctgccccctcgcagagcagcacatctgatgaggagcctggggcctactggaatggaaagctactccgttcccactcccaggcctcactggcaggccctggcccagtggatcctagtaacagaagcaacagcatgctggagctagccccgaaagtggcttccccaggtagcaccattgacactgctcccctgtcttcagtggactcactcatcaacaagtttgacagtcaacttggaggccaggcccggggtcggactggccgccgaacacggatgctaccccctgaacagcgcaaacggagcaagagcctggacagccgcctcccacgggacacctttgaggaacgggagcgccagtccaccaaccactggacctctagcacaaaatatgacaaccatgtgggcacttcgaagcagccagcccagagccagaacctgagtcctctcagtggctttagccgttctcgtcagactcaggactgggtccttcagagttttgaggagccgcggaggagtgcacaggaccccaccatgctgcagttcaaatcaactccagacctccttcgagaccagcaggaggcagccccaccaggcagtgtggaccatatgaaggccaccatctatggcatcctgagggagggaagctcagaaagtgaaacctctgtgaggaggaaggttagtttggtgctggagaagatgcagcctctagtgatggtttcttctggttctactaaggccgtggcagggcagggtgagcttacccgaaaagtggaggagctacagcgaaagctggatgaagaggtgaagaagcggcagaagctagagccatcccaagttgggctggagcggcagctggaggagaaaacagaagagtgcagccgactgcaggagctgctggagaggaggaagggggaggcccagcagagcaacaaggagctccagaacatgaagcgcctcttggaccagggtgaagatttacgacatgggctggagacccaggtgatggagctgcagaacaagctgaaacatgtccagggtcctgagcctgctaaggaggtgttactgaaggacctgttagagacccgggaacttctggaagaggtcttggaggggaaacagcgagtagaggagcagctgaggctgcgggagcgggagttgacagccctgaagggggccctgaaagaggaggtagcctcccgtgaccaggaggtggaacatgtccggcagcagtaccagcgagacacagagcagctccgcaggagcatgcaagatgcaacccaggaccatgcagtgctggaggccgagaggcagaagatgtcagcccttgtgcgagggctgcagagggagctggaggagacttcagaggagacagggcattggcagagtatgttccagaagaacaaggaggatcttagagccaccaagcaggaactcctgcagctgcgaatggagaaggaggagatggaagaggagcttggagagaagatagaggtcttgcagagggaattagagcaggcccgagctagtgctggagatactcgccaggttgaggtgctcaagaaggagctgctccggacacaggaggagcttaaggaactgcaggcagaacggcagagccaggaggtggctgggcgacaccgggaccgggagttggagaagcagctggcggtcctgagggtcgaggctgatcgaggtcgggagctggaagaacagaacctccagctacaaaagaccctccagcaactgcgacaggactgtgaagaggcttccaaggctaagatggtggccgaggcagaggcaacagtgctggggcagcggcgggccgcagtggagacgacgcttcgggagacccaggaggaaaatgacgaattccgccggcgcatcctgggtttggagcagcagctgaaggagactcgaggtctggtggatggtggggaagcggtggaggcacgactacgggacaagctgcagcggctggaggcagagaaacagcagctggaggaggccctgaatgcgtcccaggaagaggaggggagtctggcagcagccaagcgggcactggaggcacgcctagaggaggctcagcgggggctggcccgcctggggcaggagcagcagacactgaaccgggccctggaggaggaagggaagcagcgggaggtgctccggcgaggcaaggctgagctggaggagcagaagcgtttgctggacaggactgtggaccgactgaacaaggagttggagaagatcggggaggactctaagcaagccctgcagcagctccaggcccagctggaggattataaggaaaaggcccggcgggaggtggcagatgcccagcgccaggccaaggattgggccagtgaggctgagaagacctctggaggactgagccgacttcaggatgagatccagaggctgcggcaggccctgcaggcatcccaggctgagcgggacacagcccggctggacaaagagctactggcccagcgactgcaggggctggagcaagaggcagagaacaagaagcgttcccaggacgacagggcccggcagctgaagggtctcgaggaaaaagtctcacggctggaaacagagttagatgaggagaagaacaccgtggagctgctaacagatcgggtgaatcgtggccgggaccaggtggatcagctgaggacagagctcatgcaggaaaggtctgctcggcaggacctggagtgtgacaaaatctccttggagagacagaacaaggacctgaagacccggttggccagctcagaaggcttccagaagcctagtgccagcctctctcagcttgagtcccagaatcagttgttgcaggagcggctacaggctgaagagagggagaagacagttctgcagtctaccaatcgaaaactggagcggaaagttaaagaactatccatccagattgaagacgagcggcagcatgtcaatgaccagaaagaccagctaagcctgagggtgaaggctttgaagcgtcaggtggatgaagcagaagaggaaattgagcgactggacggcctgaggaagaaggcccagcgtgaggtggaggagcagcatgaggtcaatgaacagctccaggcccggatcaagtctctggagaaggactcctggtatgggctacccttttgcccttgctccatagggacactagagcagggagggaatggtctctcctgtgctggataaggaggagaatctctaacatggtactgtgtagtcacttgtttctggttggaagccagtatatttatttattagtatctcagccaccatcctgtacctccccaaatctgattagttggggattttgtgaataaactttaggccttagaagaattggggtttcctttgtacaaaaagggtggctgtcttaatatttctattttcccctccccaaccattattcttctctctgagtcaggcgcaaagcttcccgctcagctgctgagtcagctctcaaaaacgaagggctgagctcagatgaggaattcgacagtgtctacgatccctcgtccattgcatcactgcttacggagagcaacctacagaccagctcctgttagctcgtggtcctcaaggactcagaaaccaggctcgaggcctatcccagcaagtgctgctctgctctgcccaccctgggttctgcattcctatgggtgacccaattattcagacctaagacagggaggggtcagagtgatggtgataaaaaaaaaaaaatcatcagcaataagctgatagatggactttccactgtaggagtggacgtttcaagccaactgagccttttcctcaagtgccgacacctccctcatctctcttatagtggaaggatggtcagcattaggctgatggggactgagaaggataggaagggatagaaattgccatgtgtataaagctttattctttagcccttaaccctaaggctcagggaaataccctatgttattgtgctccctggattcctgcaactcattttccttccactctggagcagggtgaggggaatgttatgggtaacagacatgcaggcatggctctacccatttctttgcacaagtatggggcccatgtggtagtccccatacccctccagttcctatatttttgtcttcttcctttcccctctttgccattcctaccttgcatttttcctgtcagtgccttagccaaggcaaggagataaggatgctcttcttgctttttatatctgcacattcatacctctccaaagaccagcttttccccagccagggccctcagccttccctgctgccccagtgattgattgagagagctgttggggtttctctgccaatgacccctgggagagggactttggtagggtcatgataaagtggcgggggtctggtcctgctcagggttttcatccttcctcctctccctcctctgtgactgtggatatggttataaggtggttgcacctgggagccctgacaactggctgcacaaattccaaaagtaaaggtgtcagtccctgtggccttccttggggcttctctgaccacatgtgcccaacttcaataagagaaccaagggaccctcattttctgaggtgcttggctctgattcagggctttgcaaggggttagaagctgactgtaaaaatgggaagaggcaacggaagacatttatttctcctttggattttggggagaaccaagccctggtagggaagaggtaagggggatgattcacctccatatttcctaagcaggttgtatagggagccggtggcaggaggaaggctgttttcacaaatgacttgtaatgtcgtgattaaaaaaattcctatattcttctgcaaatcaaacgttctttcccaatccaatccagccttggttttattttaaattaaatattaaaattacacatttatattgaaaaaaaaagt

SEQ ID NO: 37933 - DNA, 2157 bp, Homo sapiens
gttctgtaagtattacacatgtgttaatacatttaatccctaagacaaccatgtgaggttaaggaacttgcccaaggccacatttttccagcggcaattataccttgtcaagattgttatgggggagggtcccaggccatggtagtagatgctattcagatgtgtggacttggtatcctgcccagctaagcctgagggtgaaggctttgaagcgtcaggtggatgaagcagaagaggaaattgagcgactggacggcctgaggaagaaggcccagcgtgaggtggaggagcagcatgaggtcaatgaacagctccaggcccggatcaagtctctggagaaggactcctggtatgggctacccttttgcccttgctccatagggacactagagcagggagggaatggtctctcctgtgctggataaggaggagaatctctaacatggtactgtgtagtcacttgtttctggttggaagccagtatatttatttattagtatctcagccaccatcctgtacctccccaaatctgattagttggggattttgtgaataaactttaggccttagaagaattggggtttcctttgtacaaaaagggtggctgtcttaatatttctattttcccctccccaaccattattcttctctctgagtcaggcgcaaagcttcccgctcagctgctgagtcagctctcaaaaacgaagggctgagctcagatgaggaattcgacagtgtctacgatccctcgtccattgcatcactgcttacggagagcaacctacagaccagctcctgttagctcgtggtcctcaaggactcagaaaccaggctcgaggcctatcccagcaagtgctgctctgctctgcccaccctgggttctgcattcctatgggtgacccaattattcagacctaagacagggaggggtcagagtgatggtgataaaaaaaaaaaaatcatcagcaataagctgatagatggactttccactgtaggagtggacgtttcaagccaactgagccttttcctcaagtgccgacacctccctcatctctcttatagtggaaggatggtcagcattaggctgatggggactgagaaggataggaagggatagaaattgccatgtgtataaagctttattctttagcccttaaccctaaggctcagggaaataccctatgttattgtgctccctggattcctgcaactcattttccttccactctggagcagggtgaggggaatgttatgggtaacagacatgcaggcatggctctacccatttctttgcacaagtatggggcccatgtggtagtccccatacccctccagttcctatatttttgtcttcttcctttcccctctttgccattcctaccttgcatttttcctgtcagtgccttagccaaggcaaggagataaggatgctcttcttgctttttatatctgcacattcatacctctccaaagaccagcttttccccagccagggccctcagccttccctgctgccccagtgattgattgagagagctgttggggtttctctgccaatgacccctgggagagggactttggtagggtcatgataaagtggcgggggtctggtcctgctcagggttttcatccttcctcctctccctcctctgtgactgtggatatggttataaggtggttgcacctgggagccctgacaactggctgcacaaattccaaaagtaaaggtgtcagtccctgtggccttccttggggcttctctgaccacatgtgcccaacttcaataagagaaccaagggaccctcattttctgaggtgcttggctctgattcagggctttgcaaggggttagaagctgactgtaaaaatgggaagaggcaacggaagacatttatttctcctttggattttggggagaaccaagccctggtagggaagaggtaagggggatgattcacctccatatttcctaagcaggttgtatagggagccggtggcaggaggaaggctgttttcacaaatgacttgtaatgtcgtgattaaaaaaattcctatattcttctgcaaatcaaacgttctttcccaatccaatccagccttggttttattttaaattaaatattaaaattacacatttatattgaaaaaaaaagt

SEQ ID NO: 37934 - DNA, 4262 bp, Homo sapiens
  misc_feature (2)..(2): n is a, c, g, or t
  misc_feature (4)..(7): n is a, c, g, or t
  misc_feature (10)..(12): n is a, c, g, or t
gnannnngcnnngaggacgagggggagggccagagctgcgcgtgctgctttgcccgagcccgagcccgagcccgagcccgagcccgagcccgagcccgagcccgaacgcaagcctgggagcgcggagcccggctagggactcctcctatttatggagcaggcacccaacatggctgagccccggggccccgtagaccatggagtccagattcgcttcatcacagagccagtgagtggtgcagagatgggcactctacgtcgaggtggacgacgcccagctaaggatgcaagagccagtacctacggggttgctgtgcgtgtgcagggaatcgctgggcagccctttgtggtgctcaacagtggggagaaaggcggtgactcctttggggtccaaatcaagggggccaatgaccaaggggcctcaggagctctgagctcagatttggaactccctgagaacccctactctcaggtcaagggatttcctgccccctcgcagagcagcacatctgatgaggagcctggggcctactggaatggaaagctactccgttcccactcccaggcctcactggcaggccctggcccagtggatcctagtaacagaagcaacagcatgctggagctagccccgaaagtggcttccccaggtagcaccattgacactgctcccctgtcttcagtggactcactcatcaacaagtttgacagtcaacttggaggccaggcccggggtcggactggccgccgaacacggatgctaccccctgaacagcgcaaacggagcaagagcctggacagccgcctcccacgggacacctttgaggaacgggagcgccagtccaccaaccactggacctctagcacaaaatatgacaaccatgtgggcacttcgaagcagccagcccagagccagaacctgagtcctctcagtggctttagccgttctcgtcagactcaggactgggtccttcagagttttgaggagccgcggaggagtgcacaggaccccaccatgctgcagttcaaatcaactccagacctccttcgagaccagcaggaggcagccccaccaggcagtgtggaccatatgaaggccaccatctatggcatcctgagggagggaagctcagaaagtgaaacctctgtgaggaggaaggttagtttggtgctggagaagatgcagcctctagtgatggtttcttctggttctactaaggccgtggcagggcagggtgagcttacccgaaaagtggaggagctacagcgaaagctggatgaagaggtgaagaagcggcagaagctagagccatcccaagttgggctggagcggcagctggaggagaaaacagaagagtgcagccgactgcaggagctgctggagaggaggaagggggaggcccagcagagcaacaaggagctccagaacatgaagcgcctcttggaccagggtgaagatttacgacatgggctggagacccaggtgatggagctgcagaacaagctgaaacatgtccagggtcctgagcctgctaaggaggtgttactgaaggacctgttagagacccgggaacttctggaagaggtcttggaggggaaacagcgagtagaggagcagctgaggctgcgggagcgggagttgacagccctgaagggggccctgaaagaggaggtagcctcccgtgaccaggaggtggaacatgtccggcagcagtaccagcgagacacagagcagctccgcaggagcatgcaagatgcaacccaggaccatgcagtgctggaggccgagaggcagaagatgtcagcccttgtgcgagggctgcagagggagctggaggagacttcagaggagacagggcattggcagagtatgttccagaagaacaaggaggatcttagagccaccaagcaggaactcctgcagctgcgaatggagaaggaggagatggaagaggagcttggagagaagatagaggtcttgcagagggaattagagcaggcccgagctagtgctggagatactcgccaggttgaggtgctcaagaaggagctgctccggacacaggaggagcttaaggaactgcaggcagaacggcagagccaggaggtggctgggcgacaccgggaccgggagttggagaagcagctggcggtcctgagggtcgaggctgatcgaggtcgggagctggaagaacagaacctccagctacaaaagaccctccagcaactgcgacaggactgtgaagaggcttccaaggctaagatggtggccgaggcagaggcaacagtgctggggcagcggcgggccgcagtggagacgacgcttcgggagacccaggaggaaaatgacgaattccgccggcgcatcctgggtttggagcagcagctgaaggagactcgaggtctggtggatggtggggaagcggtggaggcacgactacgggacaagctgcagcggctggaggcagagaaacagcagctggaggaggccctgaatgcgtcccaggaagaggaggggagtctggcagcagccaagcgggcactggaggcacgcctagaggaggctcagcgggggctggcccgcctggggcaggagcagcagacactgaaccgggccctggaggaggaagggaagcagcgggaggtgctccggcgaggcaaggctgagctggaggagcagaagcgtttgctggacaggactgtggaccgactgaacaaggagttggagaagatcggggaggactctaagcaagccctgcagcagctccaggcccagctggaggattataaggaaaaggcccggcgggaggtggcagatgcccagcgccaggccaaggattgggccagtgaggctgagaagacctctggaggactgagccgacttcaggatgagatccagaggctgcggcaggccctgcaggcatcccaggctgagcgggacacagcccggctggacaaagagctactggcccagcgactgcaggggctggagcaagaggcagagaacaagaagcgttcccaggacgacagggcccggcagctgaagggtctcgaggaaaaagtctcacggctggaaacagagttagatgaggagaagaacaccgtggagctgctaacagatcgggtgaatcgtggccgggaccaggtggatcagctgaggacagagctcatgcaggaaaggtctgctcggcaggacctggagtgtgacaaaatctccttggagagacagaacaaggacctgaagacccggttggccagctcagaaggcttccagaagcctagtgccagcctctctcagcttgagtcccagaatcagttgttgcaggagcggctacaggctgaagagagggagaagacagttctgcagtctaccaatcgaaaactggagcggaaagttaaagaactatccatccagattgaagacgagcggcagcatgtcaatgaccagaaagaccagctaagcctgagggtgaaggctttgaagcgtcaggtggatgaagcagaagaggaaattgagcgactggacggcctgaggaagaaggcccagcgtgaggtggaggagcagcatgaggtcaatgaacagctccaggcccggatcaagtctctggagaaggactcctggcgcaaagcttcccgctcagctgctgagtcagctctcaaaaacgaagggctgagctcagatgaggaattcgacagtgtctacgatccctcgtccattgcatcactgcttacggagagcaacctacagaccagctcctgttagctcgtggtcctcaaggactcagaaaccaggctcgaggcctatcccagcaagtgctgctctgctctgcccaccctgggttctgcattcctatgggtgacccaattattcagacctaagacagggaggggtcagagtgatggtgataaaaaaaaaaaaatcatcagcaataagctgatagatggactttccactgtaggagtggacgtttcaagccaactgagccttttcctcaagtgccgacacctccctcatctctcttatagtggaaggatggtcagcattaggctgatggggactgagaaggataggaagggatagaaattgccatgtgtataaagctttattctttagcccttaaccctaaggctcagggaaataccctatgttattgtgctccctggattacatttgaggtgaggggatgttatggtaacagacaatcagcatcacacaagtatgcccatgtggtagtccccatacccctccaattcctcatcct

SEQ ID NO: 37935 - DNA, 3480 bp, Homo sapiens
  misc_feature (2)..(2): n is a, c, g, or t
  misc_feature (4)..(7): n is a, c, g, or t
  misc_feature (10)..(12): n is a, c, g, or t
gnannnngcnnngaggacgagggggagggccagagctgcgcgtgctgctttgcccgagcccgagcccgagcccgagcccgagcccgagcccgagcccgagcccgaacgcaagcctgggagcgcggagcccggctagggactcctcctatttatggagcaggcacccaacatggctgagccccggggccccgtagaccatggagtccagattcgcttcatcacagagccagtgagtggtgcagagatgggcactctacgtcgaggtggacgacgcccagctaaggatgcaagagccagtacctacggggttgctgtgcgtgtgcagggaatcgctgggcagccctttgtggtgctcaacagtggggagaaaggcggtgactcctttggggtccaaatcaagggggccaatgaccaaggggcctcaggagctctgagctcagatttggaactccctgagaacccctactctcaggtcaagggatttcctgccccctcgcagagcagcacatctgatgaggagcctggggcctactggaatggaaagctactccgttcccactcccaggcctcactggcaggccctggcccagtggatcctagtaacagaagcaacagcatgctggagctagccccgaaagtggcttccccaggtagcaccattgacactgctcccctgtcttcagtggactcactcatcaacaagtttgacagtcaacttggaggccaggcccggggtcggactggccgccgaacacggatgctaccccctgaacagcgcaaacggagcaagagcctggacagccgcctcccacgggacacctttgaggaacgggagcgccagtccaccaaccactggacctctagcacaaaatatgacaaccatgtgggcacttcgaagcagccagcccagagccagaacctgagtcctctcagtggctttagccgttctcgtcagactcaggactgggtccttcagagttttgaggagccgcggaggagtgcacaggaccccaccatgctgcagttcaaatcaactccagacctccttcgagaccagcaggaggcagccccaccaggcagtgtggaccatatgaaggccaccatctatggcatcctgagggagggaagctcagaaagtgaaacctctgtgaggaggaaggttagtttggtgctggagaagatgcagcctctagtgatggtttcttctggttctactaaggccgtggcagggcagggtgagcttacccgaaaagtggaggagctacagcgaaagctggatgaagaggtgaagaagcggcagaagctagagccatcccaagttgggctggagcggcagctggaggagaaaacagaagagtgcagccgactgcaggagctgctggagaggaggaagggggaggcccagcagagcaacaaggagctccagaacatgaagcgcctcttggaccagggtgaagatttacgacatgggctggagacccaggtgatggagctgcagaacaagctgaaacatgtccagggtcctgagcctgctaaggaggtgttactgaaggacctgttagagacccgggaacttctggaagaggtcttggaggggaaacagcgagtagaggagcagctgaggctgcgggagcgggagttgacagccctgaagggggccctgaaagaggaggtagcctcccgtgaccaggaggtggaacatgtccggcagcagtaccagcgagacacagagcagctccgcaggagcatgcaagatgcaacccaggaccatgcagtgctggaggccgagaggcagaagatgtcagcccttgtgcgagggctgcagagggagctggaggagacttcagaggagacagggcattggcagagtatgttccagaagaacaaggaggatcttagagccaccaagcaggaactcctgcagctgcgaatggagaaggaggagatggaagaggagcttggagagaagatagaggtcttgcagagggaattagagcaggcccgagctagtgctggagatactcgccaggttgaggtgctcaagaaggagctgctccggacacaggaggagcttaaggaactgcaggcagaacggcagagccaggaggtggctgggcgacaccgggaccgggagttggagaagcagctggcggtcctgagggtcgaggctgatcgaggtcgggagctggaagaacagaacctccagctacaaaagaccctccagcaactgcgacaggactgtgaagaggcttccaaggctaagatggtggccgaggcagaggcaacagtgctggggcagcggcgggccgcagtggagacgacgcttcgggagacccaggaggaaaatgacgaattccgccggcgcatcctgggtttggagcagcagctgaaggagactcgaggtctggtggatggtggggaagcggtggaggcacgactacgggacaagctgcagcggctggaggcagagaaacagcagctggaggaggccctgaatgcgtcccaggaagaggaggggagtctggcagcagccaagcgggcactggaggcacgcctagaggaggctcagcgggggctggcccgcctggggcaggagcagcagacactgaaccgggccctggaggaggaagggaagcagcgggaggtgctccggcgaggcaaggctgagctggaggagcagaagcgtttgctggacaggactgtggaccgactgaacaaggagttggagaagatcggggaggactctaagcaagccctgcagcagctccaggcccagctggaggattataaggaaaaggcccggcgggaggtggcagatgcccagcgccaggccaaggattgggccagtgaggctgagaagacctctggaggactgagccgacttcaggatgagatccagaggctgcggcaggccctgcaggcatcccaggctgagcgggacacagcccggctggacaaagagctactggcccagcgactgcaggggctggagcaagaggcagagaacaagaagcgttcccaggacgacagggcccggcagctgaagggtctcgaggaaaaagtctcacggctggaaacagagttagatgaggagaagaacaccgtggagctgctaacagatcgggtgaatcgtggccgggaccaggtggatcagctgaggacagagctcatgcaggaaaggtctgctcggcaggacctggagtgtgacaaaatctccttggagagacagaacaaggacctgaagacccggttggccagctcagaaggcttccagaagcctagtgccagcctctctcagcttgagtcccagaatcagttgttgcaggagcggctacaggctgaagagagggagaagacagttctgcagtctaccaatcgaaaactggagcggaaagttaaagaactatccatccagattgaagacgagcggcagcatgtcaatgaccagaaagaccaggtgaggacatggcaccctggagc

SEQ ID NO: 37936 - DNA, 1251 bp, Homo sapiens
  misc_feature (2)..(2): n is a, c, g, or t
  misc_feature (4)..(7): n is a, c, g, or t
  misc_feature (10)..(12): n is a, c, g, or t
gnannnngcnnngaggacgagggggagggccagagctgcgcgtgctgctttgcccgagcccgagcccgagcccgagcccgagcccgagcccgagcccgagcccgaacgcaagcctgggagcgcggagcccggctagggactcctcctatttatggagcaggcacccaacatggctgagccccggggccccgtagaccatggagtccagattcgcttcatcacagagccagtgagtggtgcagagatgggcactctacgtcgaggtggacgacgcccagctaaggatgcaagagccagtacctacggggttgctgtgcgtgtgcagggaatcgctgggcagccctttgtggtgctcaacagtggggagaaaggcggtgactcctttggggtccaaatcaagggggccaatgaccaaggggcctcaggagctctgagctcagatttggaactccctgagaacccctactctcaggtcaagggatttcctgccccctcgcagagcagcacatctgatgaggagcctggggcctactggaatggaaagctactccgttcccactcccaggcctcactggcaggccctggcccagtggatcctagtaacagaagcaacagcatgctggagctagccccgaaagtggcttccccaggtagcaccattgacactgctcccctgtcttcagtggactcactcatcaacaagtttgacagtcaacttggaggccaggcccggggtcggactggccgccgaacacggatgctaccccctgaacagcgcaaacggagcaagagcctggacagccgcctcccacgggacacctttgaggaacgggagcgccagtccaccaaccactggacctctagcacaaaatatgacaaccatgtgggcacttcgaagcagccagcccagagccagaacctgagtcctctcagtggctttagccgttctcgtcagactcaggactgggtccttcagagttttgaggagccgcggaggagtgcacaggaccccaccatgctgcagttcaaatcaactccagacctccttcgagaccagcaggaggcagccccaccaggcagtgtggaccatatgaaggccaccatctatggcatcctgagggagggaagctcagaaagtgaaacctctgtgaggaggaaggttagtttggtgctggagaagatgcagcctctagtgatggtggccttcatatggtccacactgcctggtggggctgcctcctgctggtctcg

SEQ ID NO: 37937 - DNA, 378 bp, Homo sapiens
cagaacttcacataattaactaatgtaattctcacaacaccttgtgatatagttactatttttaatcccattttacagatgggggactgagacccagagagataagtaacttgcacatggtcaccagtaagtggtagagccaggatttgaacccagacatctgtatataactattagctatactaggaacctaggcccaggaaagagcaagagagggctgccttgtcaggaaggagacccttaggggagagtcttgggagtctgggcctggagagggtcatttatgtacagtgctgaagacccttttctctgtgtttcagttggagaagatcggggaggactctaagcaagccctgcagcagctccaggcccagctgg

SEQ ID NO: 37938 - DNA, 611 bp, Homo sapiens
tccacattcaggtatcttagtctggctctgggtgccccatcaccattcccgtttccttccaggagctgctccggacacaggaggagcttaaggaactgcaggcagaacggcagagccaggaggtggctgggcgacaccgggaccgggagttggagaagcagctggcggtcctgagggtcgaggctgatcgaggtcgggagctggaagaacagaacctccagctacaaaagaccctccagcaactgcgacaggactgtgaagaggcttccaaggctaagatggtggccgaggcagaggcaacagtgctggggcagcggcgggccgcagtggagacgacgcttcgggagacccaggaggaaaatgacgaattccgccggcgcatcctgggtttggagcagcagctgaaggagactcgaggtctggtggatggtggggaagcggtggaggcacgactacgggacaagctgcagcggctggaggtcagtggttctgccctcccagccctctctgctcagccctggtgaaatactcctatgctaagtagttagccatcagtttcactttgcccttagtgtgcatctgttttgcctccccaaacctgctctgttaac

SEQ ID NO: 37939 - DNA, 2446 bp, Homo sapiens
catactcttagcctctacgtggtactgcctccagtacctcagtttctgagtctcttcacctcagccttggcccaggtacttgggtttctctctcttttcccattagagaaataaggttttccaatgaagagtagattctggggtttgcctttctgtcaaagggccgtcaccagagcatggccccgacctgcccatgatgccacatctggtcagtagagggcgctggctccatagtggctctgggtccaggcaagtaccaaaaggttactgggatgtgcaagagagaaaagtctgttaatgctggagtttgagaggctcctggtctgagtttggcattctggtgtccagcatttgggacagaattacttgttcttctgtcctaggaaaaagtctcacggctggaaacagagttagatgaggagaagaacaccgtggagctgctaacagatcgggtgaatcgtggccgggaccaggtggatcagctgaggacagagctcatgcaggaaaggtctgctcggcaggacctggagtgtgacaaaatctccttggagagacagaacaaggacctgaagacccggttggccagctcagaaggcttccagaagcctagtgccagcctctctcagcttgagtcccagaatcagttgttgcaggagcggctacaggctgaagagagggagaagacagttctgcagtctaccaatcgaaaactggagcggaaagttaaagaactatccatccagattgaagacgagcggcagcatgtcaatgaccagaaagaccagctaagcctgagggtgaaggctttgaagcgtcaggtggatgaagcagaagaggaaattgagcgactggacggcctgaggaagaaggcccagcgtgaggtggaggagcagcatgaggtcaatgaacagctccaggcccggatcaagtctctggagaaggactcctggcgcaaagcttcccgctcagctgctgagtcagctctcaaaaacgaagggctgagctcagatgaggaattcgacagtgtctacgatccctcgtccattgcatcactgcttacggagagcaacctacagaccagctcctgttagctcgtggtcctcaaggactcagaaaccaggctcgaggcctatcccagcaagtgctgctctgctctgcccaccctgggttctgcattcctatgggtgacccaattattcagacctaagacagggaggggtcagagtgatggtgataaaaaaaaaaaaatcatcagcaataagctgatagatggactttccactgtaggagtggacgtttcaagccaactgagccttttcctcaagtgccgacacctccctcatctctcttatagtggaaggatggtcagcattaggctgatggggactgagaaggataggaagggatagaaattgccatgtgtataaagctttattctttagcccttaaccctaaggctcagggaaataccctatgttattgtgctccctggattcctgcaactcattttccttccactctggagcagggtgaggggaatgttatgggtaacagacatgcaggcatggctctacccatttctttgcacaagtatggggcccatgtggtagtccccatacccctccagttcctatatttttgtcttcttcctttcccctctttgccattcctaccttgcatttttcctgtcagtgccttagccaaggcaaggagataaggatgctcttcttgctttttatatctgcacattcatacctctccaaagaccagcttttccccagccagggccctcagccttccctgctgccccagtgattgattgagagagctgttggggtttctctgccaatgacccctgggagagggactttggtagggtcatgataaagtggcgggggtctggtcctgctcagggttttcatccttcctcctctccctcctctgtgactgtggatatggttataaggtggttgcacctgggagccctgacaactggctgcacaaattccaaaagtaaaggtgtcagtccctgtggccttccttggggcttctctgaccacatgtgcccaacttcaataagagaaccaagggaccctcattttctgaggtgcttggctctgattcagggctttgcaaggggttagaagctgactgtaaaaatgggaagaggcaacggaagacatttatttctcctttggattttggggagaaccaagccctggtagggaagaggtaagggggatgattcacctccatatttcctaagcaggttgtatagggagccggtggcaggaggaaggctgttttcacaaatgacttgtaatgtcgtgattaaaaaaattcctatattcttctgcaaatcaaacgttctttcccaatccaatccagccttggttttattttaaattaaatattaaaattacacatttatattgaaaaaaaaagt

SEQ ID NO: 37940 - DNA, 1846 bp, Homo sapiens
gttctgtaagtattacacatgtgttaatacatttaatccctaagacaaccatgtgaggttaaggaacttgcccaaggccacatttttccagcggcaattataccttgtcaagattgttatgggggagggtcccaggccatggtagtagatgctattcagatgtgtggacttggtatcctgcccagctaagcctgagggtgaaggctttgaagcgtcaggtggatgaagcagaagaggaaattgagcgactggacggcctgaggaagaaggcccagcgtgaggtggaggagcagcatgaggtcaatgaacagctccaggcccggatcaagtctctggagaaggactcctggcgcaaagcttcccgctcagctgctgagtcagctctcaaaaacgaagggctgagctcagatgaggaattcgacagtgtctacgatccctcgtccattgcatcactgcttacggagagcaacctacagaccagctcctgttagctcgtggtcctcaaggactcagaaaccaggctcgaggcctatcccagcaagtgctgctctgctctgcccaccctgggttctgcattcctatgggtgacccaattattcagacctaagacagggaggggtcagagtgatggtgataaaaaaaaaaaaatcatcagcaataagctgatagatggactttccactgtaggagtggacgtttcaagccaactgagccttttcctcaagtgccgacacctccctcatctctcttatagtggaaggatggtcagcattaggctgatggggactgagaaggataggaagggatagaaattgccatgtgtataaagctttattctttagcccttaaccctaaggctcagggaaataccctatgttattgtgctccctggattcctgcaactcattttccttccactctggagcagggtgaggggaatgttatgggtaacagacatgcaggcatggctctacccatttctttgcacaagtatggggcccatgtggtagtccccatacccctccagttcctatatttttgtcttcttcctttcccctctttgccattcctaccttgcatttttcctgtcagtgccttagccaaggcaaggagataaggatgctcttcttgctttttatatctgcacattcatacctctccaaagaccagcttttccccagccagggccctcagccttccctgctgccccagtgattgattgagagagctgttggggtttctctgccaatgacccctgggagagggactttggtagggtcatgataaagtggcgggggtctggtcctgctcagggttttcatccttcctcctctccctcctctgtgactgtggatatggttataaggtggttgcacctgggagccctgacaactggctgcacaaattccaaaagtaaaggtgtcagtccctgtggccttccttggggcttctctgaccacatgtgcccaacttcaataagagaaccaagggaccctcattttctgaggtgcttggctctgattcagggctttgcaaggggttagaagctgactgtaaaaatgggaagaggcaacggaagacatttatttctcctttggattttggggagaaccaagccctggtagggaagaggtaagggggatgattcacctccatatttcctaagcaggttgtatagggagccggtggcaggaggaaggctgttttcacaaatgacttgtaatgtcgtgattaaaaaaattcctatattcttctgcaaatcaaacgttctttcccaatccaatccagccttggttttattttaaattaaatattaaaattacacatttatattgaaaaaaaaagt

SEQ ID NO: 37941 - DNA, 5055 bp, Homo sapiens
  misc_feature (2)..(2): n is a, c, g, or t
  misc_feature (4)..(7): n is a, c, g, or t
  misc_feature (10)..(12): n is a, c, g, or t
gnannnngcnnngaggacgagggggagggccagagctgcgcgtgctgctttgcccgagcccgagcccgagcccgagcccgagcccgagcccgagcccgagcccgaacgcaagcctgggagcgcggagcccggctagggactcctcctatttatggagcaggcacccaacatggctgagccccggggccccgtagaccatggagtccagattcgcttcatcacagagccagtgagtggtgcagagatgggcactctacgtcgaggtggacgacgcccagctaaggatgcaagagccagtacctacggggttgctgtgcgtgtgcagggaatcgctgggcagccctttgtggtgctcaacagtggggagaaaggcggtgactcctttggggtccaaatcaagggggccaatgaccaaggggcctcaggagctctgagctcagatttggaactccctgagaacccctactctcaggtcaagggatttcctgccccctcgcagagcagcacatctgatgaggagcctggggcctactggaatggaaagctactccgttcccactcccaggcctcactggcaggccctggcccagtggatcctagtaacagaagcaacagcatgctggagctagccccgaaagtggcttccccaggtagcaccattgacactgctcccctgtcttcagtggactcactcatcaacaagtttgacagtcaacttggaggccaggcccggggtcggactggccgccgaacacggatgctaccccctgaacagcgcaaacggagcaagagcctggacagccgcctcccacgggacacctttgaggaacgggagcgccagtccaccaaccactggacctctagcacaaaatatgacaaccatgtgggcacttcgaagcagccagcccagagccagaacctgagtcctctcagtggctttagccgttctcgtcagactcaggactgggtccttcagagttttgaggagccgcggaggagtgcacaggaccccaccatgctgcagttcaaatcaactccagacctccttcgagaccagcaggaggcagccccaccaggcagtgtggaccatatgaaggccaccatctatggcatcctgagggagggaagctcagaaagtgaaacctctgtgaggaggaaggttagtttggtgctggagaagatgcagcctctagtgatggtttcttctggttctactaaggccgtggcagggcagggtgagcttacccgaaaagtggaggagctacagcgaaagctggatgaagaggtgaagaagcggcagaagctagagccatcccaagttgggctggagcggcagctggaggagaaaacagaagagtgcagccgactgcaggagctgctggagaggaggaagggggaggcccagcagagcaacaaggagctccagaacatgaagcgcctcttggaccagggtgaagatttacgacatgggctggagacccaggtgatggagctgcagaacaagctgaaacatgtccagggtcctgagcctgctaaggaggtgttactgaaggacctgttagagacccgggaacttctggaagaggtcttggaggggaaacagcgagtagaggagcagctgaggctgcgggagcgggagttgacagccctgaagggggccctgaaagaggaggtagcctcccgtgaccaggaggtggaacatgtccggcagcagtaccagcgagacacagagcagctccgcaggagcatgcaagatgcaacccaggaccatgcagtgctggaggccgagaggcagaagatgtcagcccttgtgcgagggctgcagagggagctggaggagacttcagaggagacagggcattggcagagtatgttccagaagaacaaggaggatcttagagccaccaagcaggaactcctgcagctgcgaatggagaaggaggagatggaagaggagcttggagagaagatagaggtcttgcagagggaattagagcaggcccgagctagtgctggagatactcgccaggttgaggtgctcaagaaggagctgctccggacacaggaggagcttaaggaactgcaggcagaacggcagagccaggaggtggctgggcgacaccgggaccgggagttggagaagcagctggcggtcctgagggtcgaggctgatcgaggtcgggagctggaagaacagaacctccagctacaaaagaccctccagcaactgcgacaggactgtgaagaggcttccaaggctaagatggtggccgaggcagaggcaacagtgctggggcagcggcgggccgcagtggagacgacgcttcgggagacccaggaggaaaatgacgaattccgccggcgcatcctgggtttggagcagcagctgaaggagactcgaggtctggtggatggtggggaagcggtggaggcacgactacgggacaagctgcagcggctggaggcagagaaacagcagctggaggaggccctgaatgcgtcccaggaagaggaggggagtctggcagcagccaagcgggcactggaggcacgcctagaggaggctcagcgggggctggcccgcctggggcaggagcagcagacactgaaccgggccctggaggaggaagggaagcagcgggaggtgctccggcgaggcaaggctgagctggaggagcagaagcgtttgctggacaggactgtggaccgactgaacaaggagttggagaagatcggggaggactctaagcaagccctgcagcagctccaggcccagctggaggattataaggaaaaggcccggcgggaggtggcagatgcccagcgccaggccaaggattgggccagtgaggctgagaagacctctggaggactgagccgacttcaggatgagatccagaggctgcggcaggccctgcaggcatcccaggctgagcgggacacagcccggctggacaaagagctactggcccagcgactgcaggggctggagcaagaggcagagaacaagaagcgttcccaggacgacagggcccggcagctgaagggtctcgaggaaaaagtctcacggctggaaacagagttagatgaggagaagaacaccgtggagctgctaacagatcgggtgaatcgtggccgggaccaggtggatcagctgaggacagagctcatgcaggaaaggtctgctcggcaggacctggagtgtgacaaaatctccttggagagacagaacaaggacctgaagacccggttggccagctcagaaggcttccagaagcctagtgccagcctctctcagcttgagtcccagaatcagttgttgcaggagcggctacaggctgaagagagggagaagacagttctgcagtctaccaatcgaaaactggagcggaaagttaaagaactatccatccagattgaagacgagcggcagcatgtcaatgaccagaaagaccagctaagcctgagggtgaaggctttgaagcgtcaggtggatgaagcagaagaggaaattgagcgactggacggcctgaggaagaaggcccagcgtgaggtggaggagcagcatgaggtcaatgaacagctccaggcccggatcaagtctctggagaaggactcctggcgcaaagcttcccgctcagctgctgagtcagctctcaaaaacgaagggctgagctcagatgaggaattcgacagtgtctacgatccctcgtccattgcatcactgcttacggagagcaacctacagaccagctcctgttagctcgtggtcctcaaggactcagaaaccaggctcgaggcctatcccagcaagtgctgctctgctctgcccaccctgggttctgcattcctatgggtgacccaattattcagacctaagacagggaggggtcagagtgatggtgataaaaaaaaaaaaatcatcagcaataagctgatagatggactttccactgtaggagtggacgtttcaagccaactgagccttttcctcaagtgccgacacctccctcatctctcttatagtggaaggatggtcagcattaggctgatggggactgagaaggataggaagggatagaaattgccatgtgtataaagctttattctttagcccttaaccctaaggctcagggaaataccctatgttattgtgctccctggattcctgcaactcattttccttccactctggagcagggtgaggggaatgttatgggtaacagacatgcaggcatggctctacccatttctttgcacaagtatggggcccatgtggtagtccccatacccctccagttcctatatttttgtcttcttcctttcccctctttgccattcctaccttgcatttttcctgtcagtgccttagccaaggcaaggagataaggatgctcttcttgctttttatatctgcacattcatacctctccaaagaccagcttttccccagccagggccctcagccttccctgctgccccagtgattgattgagagagctgttggggtttctctgccaatgacccctgggagagggactttggtagggtcatgataaagtggcgggggtctggtcctgctcagggttttcatccttcctcctctccctcctctgtgactgtggatatggttataaggtggttgcacctgggagccctgacaactggctgcacaaattccaaaagtaaaggtgtcagtccctgtggccttccttggggcttctctgaccacatgtgcccaacttcaataagagaaccaagggaccctcattttctgaggtgcttggctctgattcagggctttgcaaggggttagaagctgactgtaaaaatgggaagaggtaagggggatgattcacctccatatttcctaagcaggttgtatagggagccggtggcaggaggaaggctgttttcacaaatgacttgtaatgtcgtgattaaaaaaattcctatattcttctgcaaatcaaacgttctttcccaatccaatccagccttggttttattttaaattaaatattaaaattacacatttatattgaaaaaaaaagt

SEQ ID NO: 37942 - DNA, 2007 bp, Homo sapiens
  misc_feature (2)..(2): n is a, c, g, or t
  misc_feature (4)..(7): n is a, c, g, or t
  misc_feature (10)..(12): n is a, c, g, or t
gnannnngcnnngaggacgagggggagggccagagctgcgcgtgctgctttgcccgagcccgagcccgagcccgagcccgagcccgagcccgagcccgagcccgaacgcaagcctgggagcgcggagcccggctagggactcctcctatttatggagcaggcacccaacatggctgagccccggggccccgtagaccatggagtccagattcgcttcatcacagagccagtgagtggtgcagagatgggcactctacgtcgaggtggacgacgcccagctaaggatgcaagagccagtacctacggggttgctgtgcgtgtgcagggaatcgctgggcagccctttgtggtgctcaacagtggggagaaaggcggtgactcctttggggtccaaatcaagggggccaatgaccaaggggcctcaggagctctgagctcagatttggaactccctgagaacccctactctcaggtcaagggatttcctgccccctcgcagagcagcacatctgatgaggagcctggggcctactggaatggaaagctactccgttcccactcccaggcctcactggcaggccctggcccagtggatcctagtaacagaagcaacagcatgctggagctagccccgaaagtggcttccccaggtagcaccattgacactgctcccctgtcttcagtggactcactcatcaacaagtttgacagtcaacttggaggccaggcccggggtcggactggccgccgaacacggatgctaccccctgaacagcgcaaacggagcaagagcctggacagccgcctcccacgggacacctttgaggaacgggagcgccagtccaccaaccactggacctctagcacaaaatatgacaaccatgtgggcacttcgaagcagccagcccagagccagaacctgagtcctctcagtggctttagccgttctcgtcagactcaggactgggtccttcagagttttgaggagccgcggaggagtgcacaggaccccaccatgctgcagttcaaatcaactccagacctccttcgagaccagcaggaggcagccccaccaggcagtgtggaccatatgaaggccaccatctatggcatcctgagggagggaagctcagaaagtgaaacctctgtgaggaggaaggttagtttggtgctggagaagatgcagcctctagtgatggtttcttctggttctactaaggccgtggcagggcagggtgagcttacccgaaaagtggaggagctacagcgaaagctggatgaagaggtgaagaagcggcagaagctagagccatcccaagttgggctggagcggcagctggaggagaaaacagaagagtgcagccgactgcaggagctgctggagaggaggaagggggaggcccagcagagcaacaaggagctccagaacatgaagcgcctcttggaccagggtgaagatttacgacatgggctggagacccaggtgatggagctgcagaacaagctgaaacatgtccagggtcctgagcctgctaaggaggtgttactgaaggacctgttagagacccgggaacttctggaagaggtcttggaggggaaacagcgagtagaggagcagctgaggctgcgggagcgggagttgacagccctgaagggggccctgaaagaggaggtagcctcccgtgaccaggaggtggaacatgtccggcagcagtaccagcgagacacagagcagctccgcaggagcatgcaagatgcaacccaggaccatgcagtgctggaggccgagaggcagaagatgtcagcccttgtgcgagggctgcagagggagctggaggagacttcagaggagacagggcattggcagagtatgttccagaagaacaaggaggatcttagagccaccaagcaggaactcctgcagctgcgaatggagaagtgcgcctgggtgcgcaccagcgcacttctgcacccaggcgcacttctgcacccaggcgcacttctgca

SEQ ID NO: 37943 - DNA, 426 bp, Homo sapiens
tgaatgaaaggtttactcacggcagggacaacaatatcccagagtcaggactctcaccctcacagtcgggatcaggcaactagagatggagtctcccttatgtttgttatgctgttccaaacctgattcacatcacaggagttatcagaaatgggttttcactggtgaaaagagttgcttgttaatttgtgtaatggattttagaaaagggctgtcattgtcaaaatttatggcagtcaatgactctgaattactttgttgtagtcactttctgagtagaatatttactaaccactcttggaatggaaattgctgattaaaacacaagctgcacctaggtgtgtaaataactggtgcctacaaatgtcatcctgtctttcccaaaagatttaatatgcccaagtattttttttttttttttgagat

SEQ ID NO: 37944 - DNA, 1446 bp, Homo sapiens
agaaagtctcctggagtagaaataaaaagtttgagagaattggatagtggattggaagtgcataaaatagctgaaggtttttcagaatccaagaaaaggtcatcagaagatgaaaatgaaaataaaatagagtttaggaagaaaggaggatttgaagggggaggattccttggaagaaagaaagttccctatctggcatcatcaccaagtacttccgatggaggaactgactcacctggtactgcgtccccatctcctacaaagactactccatctcctcggcataaaaaaagtgattcttcaggtcaggagtacagcttgtgaaaactcaccaaaatgaatagttgtttcgttacatttagatgaaagttaaactttactgaatttcagtacattagtttttacactaaaactttacaagataaaattggacttcatttagtatctttttaacagaattacttggaataatgagatacaataatcatatctcttttgacattttggaaatttttttaattttacaagtacatttaacagatcatttataaagcaggagtccattttaacacttaccgacttttttggtttggaaacatattaccacgtcttaataggatggtgcccatataggtgagcatccctttagatcatgggaaccagcagactgcattcctaatcttcattatgcctgagacttgtcttacaatgttacctttaagtgaatcacataattgtctttggaacttggtctcccaacacttattgtgattgcaaagtgtttaccagatatttgatgaggtgctatgtttgtgaaaaacatatcatgtaattcaaaaacactattgatattgaataccagataccactatgtagtaagtcttttaggatgattttaatttagtcgtgcgtcattttctgattctcatcattgggagatcttaaatcttagcaagcattagcaatattaaatgccaaaattcccattgaaactttcaagttggagcaattgtctggtgtttgaaaagatgaaataaaaataataatcaagggcaaagctttgagtgcccagaagggaaagctgtaccagttgctaacctgtcttgtttcaggagccaccatgtttttttttcagtgttaacaacaatcatgataattaaattaaaacactagtttgttcacttgtaggactgcagttctgaattttgggttaaaggttttggctgctgtaagaatgtgaatttgaatgtattttgaattgtaagagcaaaagaacgtttttgtacaattttttttcatttaattggaatgatcttcaggtttctacaaatagggtaattgtaaatttaaagcattagcatttattggtgaataatgtatatatccccattccaagaaatataagtgagtgaagttgaaataaaatctttaaaatttactatattg

SEQ ID NO: 37945 - DNA, 1179 bp, Homo sapiens
cgacccacgcgtccgcggacggcgtgggtccggacgcgtgggtcgacccacgcgtccgaactcaccaaaatgaatagttgtttcgttacatttagatgaaagttaaactttactgaatttcagtacattagtttttacactaaaactttacaagataaaattggacttcatttagtatctttttaacagaattacttggaataatgagatacaataatcatatctcttttgacattttggaaatttttttaattttacaagtacatttaacagatcatttataaagcaggagtccattttaacacttaccgacttttttggtttggaaacatattaccacgtcttaataggatggtgcccatataggtgagcatccctttagatcatgggaaccagcagactgcattcctaatcttcattatgcctgagacttgtcttacaatgttacctttaagtgaatcacataattgtctttggaacttggtctcccaacacttattgtgattgcaaagtgtttaccagatatttgatgaggtgctatgtttgtgaaaaacatatcatgtaattcaaaaacactattgatattgaataccagataccactatgtagtaagtcttttaggatgattttaatttagtcgtgcgtcattttctgattctcatcattgggagatcttaaatcttagcaagcattagcaatattaaatgccaaaattcccattgaaactttcaagttggagcaattgtctggtgtttgaaaagatgaaataaaaataataatcaagggcaaagctttgagtgcccagaagggaaagctgtaccagttgctaacctgtcttgtttcaggagccaccatgtttttttttcagtgttaacaacaatcatgataattaaattaaaacactagtttgttcacttgtaggactgcagttctgaattttgggttaaaggttttggctgctgtaagaatgtgaatttgaatgtattttgaattgtaagagcaaaagaacgtttttgtacaattttttttcatttaattggaatgatcttcaggtttctacaaatagggtaattgtaaatttaaagcattagcatttattggtgaataatgtatatatccccattccaagaaatataagtgagtgaagttgaaataaaatctttaaaatttactatattg

SEQ ID NO: 37946 - DNA, 213 bp, Homo sapiens
tcagcccctctccaggacaaggccaacatgccattatgaacctaagaagaagctagttaactgatgctcaattcttcattctaaaactgctagtggccagctgccgtggctcacacctgtaatcccagcactttgggaggccgaggcgtgtggatcatctgaggtcaggagttcgagaccagcctggccaacacagtgaaaccctgtctctac

SEQ ID NO: 37947 - DNA, 319 bp, Homo sapiens
taccttgtaactatccgaagcgtatttaaaagacaggtaataactggaaaagtaggaacaagctaaacaacaccatgattaagcaatcaggcaaatcctgaaggtgagatattccactggacaactgtcctggactcttagcaaatcagcatcatagaaacagtgaatttatagagtaaaaccaatttaagtgacccaaccatcagatgtattataacatgtggtcctagattagattccagtttatgtagatttaaatagctataaaaatgattttgggaaacgttatggaaattggaatatggcttgggtcataaat

SEQ ID NO: 37948 - DNA, 397 bp, Homo sapiens
agactctgcctctctaaaaaaaaacacacacacacaacaacaacaacaaaaattgtaatcagtctcgtagacagtgatcgtgtacaaagttctatttaggaaagaaaacatcagtatttaagtctacttttattaagaatgtgggttcctaaaccaattcgtctggttaggaatcagctctgccacttttatctgggtggcaagcaagttatttaatcattcgacacctcaatttccatacctgtaaaataagaataataatagtaaattatcggccaggtgcagtggctcatgcctgtaatcccagcactttgggaggccgaggcgggcagatcatgatgtcaggagttcgagacaagcctggccaacatagtgaaaccccgcctctactaaaaaa

SEQ ID NO: 37949 - DNA, 397 bp, Homo sapiens
ttaaatttcacagaggtcaattgagcaaacaatgatttgcaaattgggcagttccctgaaccagagagactctggtgctgttgggtgattggggaagatttaaggactgaaaaagggccgggtgcagtggctcacacttgtgatctcagcactttgggaggccgagggggacagatcacttgagatcgggagtttgagaccagcctggccaacatggttaaaccccatctctactaaaaatacaaaaattagtggggcatggtggtgggtgcctatagtcccagctactcttgagtctaaagcaagagaatcgcttgaacccgggaggcagagattgcggtgagccgagatcatgctactgcattccagcctgggcgacagagcgagactccatctc

SEQ ID NO: 37950 - DNA, 632 bp, Homo sapiens
cagcctccgcctgctcccacagtggaacagccaccatccaggagctcacccccagctcagctgcatgtgtcccctcacaggacccacgcatcagatggggagcagagaagggccctgaatgcaggaagcctccgcgactcggtatgcaccccaggaccaacagagatttgcacagaaagctgcaactcagtggtcaaaaaagagagggcaatgctttttcacgggtggtccatggcattttgcttggatgactcagagaagagaaacctaacgaccccctccccaccacaatgtttaacacagactgtctaccaccacactggagactctattttcatagacacaattccacagatggggaaactgaggcagcaggtgctatggaactcggcaacgcaaagcttgcctgatcctggggtcctcgccacaagcagggccctctgagcaggacctacaggccaggccagggcagctcctggctgagcgccacatagactaccacagtgacacatgggttaacgtgctggacccagtcagttttatatcaggaatgatggacacaccactttctgcactgaatgcttgtatcatctttgaatgctacaactagcatcaatgtttctacatcggaa

SEQ ID NO: 37951 - DNA, 443 bp, Homo sapiens
  misc_feature (441)..(442): n is a, c, g, or t
caaagtttttaccaaaaatatatacttcaatgtaacatggatgttaaatgtttgcaaaatagttcacttgaaaacagtattgttttagtctgcttgcattgctataaaggaatacctaggctgagtaatttataaggaagagttttatttggctaatggttctgcaggctttatcagaagcataaagccagcatctgcttctgatgaggacctcagagagcttccagtcatggcagaaggggaaggggagctgacatgtcacatggggagagaaggagcaagagagagagaaaggaagtgccaaagtttttggggtttttttgttttgttttgttttgtttgagatggagtctctctctggtatccagactggaggttgcaatgagccgaggttggccattgcactccagccagggaaacaagagcaaaacaccatctcgnnt

SEQ ID NO: 37952 - DNA, 437 bp, Homo sapiens
ccgggtcgactactactactaaattcgcggccgcgtcgacagaacaaccttttctacccacttttgtttcttctggtgatacctatttacattttgctttcaaagggtgcccaaccactggatgccatacttgtgttattagctatctctatctgcctaagcctctggtttgcttcctcttgggaattaaaaataagatttctcttgatttcattgaaaaatcatcattctttcagctttgaccatattgttttgataaaaacagctgatttgtattattgaacatctttctcatttttctctctccataaggagaaattcatcacgatttattacctgaacatttgtgaaaccaatttgagagaatcccaaaagaatcattttaattgaagccacctaattacttgtaattaagaagacttaaaatgccaaaaaaa

SEQ ID NO: 37953 - DNA, 995 bp, Homo sapiens
gtcactttgtcgcgggacgtcgcgtggtacaattggcctgtgggagtaccattgatcccgccctcatctgaggtgacgggaaagggccgggaaatttccacttctgaataaaatgactgctgaagtgatgacccgcaagaattggtcaaatttggagtagacttcaccctgcgcttggtgaaacttctacgtcaaggatgcaagaggcgccgaagtaacgcagctcccacctgtcgctctccgctgggcgccgagactatggccggagaatagctgcaccgggattggagaaaggaagccatcagtcttaggaaggctccaccttcctgccattgcctggttggaggagcgtagcgtcagtcactagagcagtcaccacctctgggacaggtgaagatgtgtaacctatttgccgggggctatttgggagggaatagaggacggggagcgatgaggggacagtcgaggggcaaggccgatctcgcttcgcgcctcccgcctttctgagttgagcctagcgcgcgggtctgagggacatccggggagctgcttgggatggccgccttggggagactcgacccgcccgccaggacccggccgcgcgccgcagttcgggcgccttcgggcaggatcgcccagcggggccgcgttctcctgcttgcggacggctgcgggcctgagggctggacagcgccatgcctcagtaccgggaactgtcccacgtaggaaggtgggaatgccgcgaacggcgtgcggaatccgacctcaaggtggaacggggtggtgaagagtgcatgctccgaggcagtttcgagttctggtgctgccacttacttgctgcctgacttcggcgcgtttgctgtttcatttttgtgactttcaactcgctcctctgtgaaatgggagtaatattagtaccttcctcattgggttgttgttatgaataaattagatgataatatagcgcttagcaaagtcccaaacttaaaaaaaaa

SEQ ID NO: 37954 - DNA, 659 bp, Homo sapiens
gtcactttgtcgcgggacgtcgcgtggtacaattggcctgtgggagtaccattgatcccgccctcatctgaggtgacgggaaagggccgggaaatttccacttctgaataaaatgactgctgaagtgatgacccgcaagaattggtcaaatttggagtagacttcaccctgcgcttggtgaaacttctacgtcaaggatgcaagaggcgccgaagtaacgcagctcccacctgtcgctctccgctgggcgccgagactatggccggagaatagctgcaccgggattggagaaaggaagccatcagtcttaggaaggctccaccttcctgccattgcctggttggaggagcgtagcgtcagtcactagagcagtcaccacctctgggacaggaaggtgggaatgccgcgaacggcgtgcggaatccgacctcaaggtggaacggggtggtgaagagtgcatgctccgaggcagtttcgagttctggtgctgccacttacttgctgcctgacttcggcgcgtttgctgtttcatttttgtgactttcaactcgctcctctgtgaaatgggagtaatattagtaccttcctcattgggttgttgttatgaataaattagatgataatatagcgcttagcaaagtcccaaacttaaaaaaaaa

SEQ ID NO: 37955 - DNA, 4965 bp, Homo sapiens
gacggcgccagcagccagcccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgctaaattatctgttgtcagttttgccccctcctccaatgaggttgaaacaacaagcctcaatgatgttactttaagcttactcccttcaaacgaaacagaaaaaactaaaatcactatagtaaaaaccttcaatgcttcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgcaatagccgctttggaaagagtaaagattcgaccaatggaacactgctgctgttctgtcaggataccctgcccttcctccccagaagagttgggaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggtcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaagatctttaagtttggtaattttcacaaagaaaaaacatctgcagtctctttccctggtggcctggcatggaagtggtgtaggacatgctgattaagacaaacacaattggctgggcatggtggctcacacctgtaatcccagcactttgggaggctgacgcaggtggattgcttgagtgcaggagttggagaccagcccgggcagcacagggagacccctgtctctacaaaaaattaaaaattagttagtcatagtgttgtgtgcctgtactcctagctactcaggagg

SEQ ID NO: 37956 - DNA, 627 bp, Homo sapiens
cgctcaaggttacgcactccagactcatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaagatctttaagtttggtaattttcacaaagaaaaaacatctgcagtctctttccctggtggcctggcatggaagtggtgtaggacatgctgattaagacaaacacaattggctgggcatggtggctcacacctgtaatcccagcactttgggaggctgacgcaggtggattgcttgagtgcaggagttggagaccagcccgggcagcacagggagacccctgtctctacaaaaaattaaaaattagttagtcatagtgttgtgtgcctgtactcctagctactcaggagg

SEQ ID NO: 37957 - DNA, 4680 bp, Homo sapiens
gacggcgccagcagccagcccgaggacgcgagcggcaggtgtgcacagaggttctccactttgttttctgaactcgcggtcaggatggttttctctgtcaggcagtgtggccatgttggcagaactgaagaagttttactgacgttcaagatattccttgtcatcatttgtcttcatgtcgttctggtaacatccctggaagaagatactgataattccagtttgtcaccaccacctgctaaattatctgttgtcagttttgccccctcctccaatgaggttgaaacaacaagcctcaatgatgttactttaagcttactcccttcaaacgaaacagaaaaaactaaaatcactatagtaaaaaccttcaatgcttcaggcgtcaaaccccagagaaatatctgcaatttgtcatctatttgcaatgactcagcattttttagaggtgagatcatgtttcaatatgataaagaaagcactgttccccagaatcaacatataacgaatggcaccttaactggagtcctgtctctaagtgaattaaaacgctcagagctcaacaaaaccctgcaaaccctaagtgagacttactttataatgtgtgctacagcagaggcccaaagcacattaaattgtacattcacaataaaactgaataatacaatgaatgcatgtgctgcaatagccgctttggaaagagtaaagattcgaccaatggaacactgctgctgttctgtcaggataccctgcccttcctccccagaagagttgggaaagcttcagtgtgacctgcaggatcccattgtctgtcttgctgaccatccacgtggcccaccattttcttccagccaatccatcccagtggtgcctcgggccactgtgctttcccaggtccccaaagctacctcttttgctgagcctccagattattcacctgtgacccacaatgttccctctccaataggggagattcaacccctttcaccccagccttcagctcccatagcttccagccctgccattgacatgcccccacagtctgaaacgatctcttcccctatgccccaaacccatgtctccggcaccccacctcctgtgaaagcctcattttcctctcccaccgtgtctgcccctgcgaatgtcaacactaccagcgcacctcctgtccagacagacatcgtcaacaccagcagtatttctgatcttgagaaccaagtgttgcagatggagaaggctctgtccttgggcagcctggagcctaacctcgcaggagaaatgatcaaccaagtcagcagactccttcattccccgcctgacatgctggcccctctggctcaaagattgctgaaagtagtggatgacattggcctacagctgaacttttcaaacacgactataagtctaacctccccttctttggctctggctgtgatcagagtgaatgccagtagtttcaacacaactacctttgtggcccaagaccctgcaaatcttcaggtttctctggaaacccaagctcctgagaacagtattggcacaattactcttccttcatcgctgatgaataatttaccagctcatgacatggagctagcttccagggttcagttcaatttttttgaaacacctgctttgtttcaggatccttccctggagaacctctctctgatcagctacgtcatatcatcgagtgttgcaaacctgaccgtcaggaacttgacaagaaacgtgacagtcacattaaagcacatcaacccgagccaggatgagttaacagtgagatgtgtattttgggacttgggcagaaatggtggcagaggaggctggtcagacaatggctgctctgtcaaagacaggagattgaatgaaaccatctgtacctgtagccatctaacaagcttcggcgttctgctggacctatctaggacatctgtgctgcctgctcaaatgatggctctgacgttcattacatatattggttgtgggctttcatcaatttttctgtcagtgactcttgtaacctacatagcttttgaaaagatccggagggattacccttccaaaatcctcatccagctgtgtgctgctctgcttctgctgaacctggtcttcctcctggactcgtggattgctctgtataagatgcaaggcctctgcatctcagtggctgtatttcttcattattttctcttggtctcattcacatggatgggcctagaagcattccatatgtacctggcccttgtcaaagtatttaatacttacatccgaaaatacatccttaaattctgcattgtcggttggggggtaccagctgtggttgtgaccatcatcctgactatatccccagataactatgggcttggatcctatgggaaattccccaatggttcaccggatgacttctgctggatcaacaacaatgcagtattctacattacggtggtgggatatttctgtgtgatatttttgctgaacgtcagcatgttcattgtggtcctggttcagctctgtcgaattaaaaagaagaagcaactgggagcccagcgaaaaaccagtattcaagacctcaggagtatcgctggccttacatttttactgggaataacttggggctttgccttctttgcctggggaccagttaacgtgaccttcatgtatctgtttgccatctttaataccttacaaggatttttcatattcatcttttactgtgtggccaaagaaaatgtcaggaagcaatggaggcggtatctttgttgtggaaagttacggctggctgaaaattctgactggagtaaaactgctactaatggtttaaagaagcagactgtaaaccaaggagtgtccagctcttcaaattccttacagtcaagcagtaactccactaactccaccacactgctagtgaataatgattgctcagtacacgcaagcgggaatggaaatgcttctacagagaggaatggggtctcttttagtgttcagaatggagatgtgtgccttcacgatttcactggaaaacagcacatgtttaacgagaaggaagattcctgcaatgggaaaggccgtatggctctcagaaggacttcaaagcggggaagcttacactttattgagcaaatgtgattcctttcttctaaaatcaaagcatgatgcttgacagtgtgaaatgtccaattttaccttttacacaatgtgagatgtatgaaaatcaactcattttattctcggcaacatctggagaagcataagctaattaagggcgatgattattattacaagaagaaaccaagacattacaccatggtttttagacatttctgatttggtttcttatctttcattttataagaaggttggttttaaacaatacactaagaatgactcctataaagaaaacaaaaaaaggtagtgaactttcagctaccttttaaagaggctaagttatctttgataacatcatataaagcaactgttgacttcagcctgttggtgagtttagttgtgcatgcctttgttgtatataagctaaattctagtgacccatgtgtcaaaaatcttacttctacatttttttgtatttattttctactgtgtaaatgtattcctttgtagaatcatggttgttttgtctcacgtgataattcagaaaatccttgctcgttccgcaaatcctaaagctccttttggagatgatataggatgtgaaatacagaaacctcagtgaaatcaagaaataatgatcccagccagactgagaaaatgtaagcagacagtgccacagttagctcatacagtgcctttgagcaagttaggaaaagatgcccccactgggcagacacagccctatgggtcatggtttgacaaacagagtggagagaccatattttagccccactcaccctcttgggtgcacgacctgtacagccaaacacagcatccaatatgaatacccatcccctgaccgcatccccagtagtcagattatagaatctgcaccaagatgtttagctttataccttggccacagagagggatgaactgtcatccagaccatgtgtcaggaaaattgtgaacgtagatgaggtacatacactgccgcttctcaaatccccagagcctttaggaacaggagagtagactaggattccttctcttaaaaaggtacatatatatggaaaaaaatcatattgccgttctttaaaaggcaactgcatggtacattgttgattgttatgactggtacactctggcccagccagagctataattgttttttaaatgtgtcttgaagaatgcacagtgacaaggggagtagctattgggaacagggaactgtcctacactgctattgttgctacatgtatcgagccttgattgctcctagttatatacagggtctatcttgcttcctacctacatctgcttgagcagtgcctcaagtacatccttattaggaacatttcaaaccccttttagttaagtctttcactaaggttctcttgcatatatttcaagtgaatgttggatctcagactaaccatagtaataatacacatttctgtgagtgctgacttgtctttgcaatatttcttttctgatttatttaattttcttgtatttatatgttaaaatcaaaaatgttaaaatcaatgaaataaatttgcagttaagatc

SEQ ID NO: 37958 - DNA, 441 bp, Homo sapiens
accattaacaagctctgtggcttcaagcaatgcatttatacattttgaagcttagttttcttatttgtaagaaaagacttatttctagccctagaatcccatgattctgatttcacctcttatcaactaataattgtagaaatcagaagatcagggtgtgtgtgctcggttaataatccaagagcataggcacatgtgcagcagagattttaaccgaggtttgcaatagtacatcgttcaaagattaaatgccagggagccgctgcagaataggaagaagactgagatactcaagttagggattttgtcttgcatcatgttttattaataaaagattttaatgttctcttaatgttaagcttttaaaaaataaaaacattttttctttgtaaagtaaaaggtaattaaatcagctttccatttgatttattaatatcgtct

SEQ ID NO: 37959 - DNA, 121 bp, Homo sapiens
cattccccatccttctgcctccatgctccagggttagacagcttgaatgtctccttcctgtttggtgttcccagcctcagcattcatgagtcttgtgtccatatggtgctctactcagagc

SEQ ID NO: 37960 - DNA, 773 bp, Homo sapiens
aatgaagatgaagtattgctgaagccaaccagagatcttgatctctctctgaggaaaaaacctagaaatgatggttagaatcaggagacttgagaactacgaggaacatggcagcctctagctcatacttgtcgttgtacaattgagatcaagtgaattggccccggtctcacattttcagtgaagtcagactcagaactaggtcctgggtttcatgtttcctgctgctcttctcactgtgtacacaccatgcccacatacaacatacctatcagaaatggttttcattaagggagtagaatagtcacttaactggggctcttaacattgctaataacctgtggctcaatttcctcaactgtataatgaggttactactagtatctacctcaaagcgttgtcatgtggattgagatgatatgtatgaatcacataaaagagtgcctggcacatagtaggtgccattaataatattactattgttaacaccttaagggtctaacttgtaatgaagacagaaatatgtatgaggatgatcactgaaatatttatgacagtgcataatttgcaaaataaaaaatgtacactagcataatatttgtggcatatccgtgtaatggaagattatgcaggcattaaaatatgtacacaaaaagtttggtaaaggaaaaatgctgtcatgtgttacaaaagcatgataaataattgttaatatggaataagctcaaatatgtcaaaataaatgtaaaaaatgagtgttgcccaaaactaag

SEQ ID NO: 37961 - DNA, 633 bp, Homo sapiens
tcccctttttttttttgggaaaacacaacagaacagtagacatgatacgattcgagctcgtaccccctcattggacatcaaaagacccatactggtgaggaaccctatgaatgtaaagaatgtggaaaatccttcagctggttctctcaccttgttactcatcagagaactcatacaggagacaaactgtacacatgtaatcagtgtgggaaatcttttgttcatagctctaggcttattagacaccagaggacacatactggagagaaaccctatgaatgtcctgaatgtgggaaatctttcagacagagcacacatctcattagtgaactcccattcacaattgcttcaaagagagtaaaatacctaggaatccaacttacaagggatgtgaaggaactcttcaaggagaactacaaatcactgctcaatgaaataaaagagaacacaaacaaatgaaagaaccattccatgcttatggataggaagaatcaatatcgtgaaaatggccatactgcccaaggtaatttatagattcaatgccatccccatcaagctaccaatgactttcttcacagaattggaaaaaactttaaagttcatgtggaaccaaaaaagggcccgcattgccaa

SEQ ID NO: 37962 - DNA, 3428 bp, Homo sapiens
ggcctcagactcacctctgacgccgctcttcgcgctccgctggtgaatggagtcgcgttctctgttttgctgttgctgctgcctttgtgacgggatcgctttctcccatcgaaccttctagttgcttattgcaggtatatacgaaagtgctgaattttgtgtttgcatcgtcatcaggcgcgtgttgagccctttagtaatgtagcagtgtattagcttcgtatttctaggtagacggtaatttcgtcaatgaaaaaatttaacggtgatcgtcaccccttgcctcagtcactttctgtccctcgcgcggccccggcgttcacggcggacgttcttgttctgtggagaataacggctgcacctggagattgacgcagagtgggcggcggtggtgctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagtttccagcaggagcatttttaaagataagcaatcctgtgacattaaaatggaaggaatggcaaggaatgatctctggtatttgtcattagaagaagtctggaaatgtagagaccagttagacaagtatcaggaaaacccagagagacatttgaggcatcagcttattcatactggagaaaaaccctatgagtgtaaagaatgtggaaagtctttcagccggagttctcacctcattggacatcaaaagacccatactggtgaggaaccctatgaatgtaaagaatgtggaaaatccttcagctggttctctcaccttgttactcatcagagaactcatacaggagacaaactgtacacatgtaatcagtgtgggaaatcttttgttcatagctctaggcttattagacaccagaggacacatactggagagaaaccctatgaatgtcctgaatgtgggaaatctttcagacagagcacacatctcattctgcatcagagaacccatgtgagagtgaggccctatgaatgcaatgaatgtggaaagtcttacagccagagatctcaccttgttgtgcatcatagaattcacactggactaaaaccttttgagtgtaaggattgtggaaaatgttttagtcgaagctctcacctttattcacatcaaagaacccacactggagagaaaccatatgagtgtcatgattgtggaaaatctttcagccagagttctgcccttattgtgcatcagaggatacacactggagagaaaccatatgaatgctgtcagtgtgggaaagccttcatccggaagaatgacctcattaagcaccagagaattcatgttggagaagagacctataaatgtaatcaatgtggcattatcttcagccagaactctccatttatagttcatcaaatagctcacactggagagcagttcttaacatgcaatcaatgtgggacagcgcttgttaatacctctaaccttattggataccagacaaatcatattagagaaaatgcttactaataaatatgggaatttttcacaaagagcaatgactttattttgcattggagaactcctggagataagctgtacaaattgaatctatgtggaaatgctttcagtcttgttactatcctattgcacattagagaattggtcctggaagggaaagaaaccacagattttatttcagtacacaaatccatcagattttcttcttttcatgaattcctacagaagtaattggcctgagagcattcttgaccaagtcttaaatgctagaatctgagaaggaattattaaataggtgagttgttgagcgagaaccccttcatttgaaaagaaatgagtatgctactatagggagagttgttgctgagaattaagaaatgatacagttaatgcaacaaaagatggaaaataatatttcagtcaatatgtcattgttttcttgactatgtctctcttctgggacatttagtagtgtttggtatgttttatgtgtctggtagaaaccatattttggttaacagcaagaaaaatgcttataatgtagtacaattaaaaacaacacatctccactaccagtgctaacccatttttaagtacatttgcatgtgggcaagaattgaaagtatacagataattgaacagaattgatttgttagataaggagattttgactgagttttatagtctgtttaatgttgctgtaataattattttaagaaacttttaaatattgtaagaggatatctagtttctctattctaccatcaaagaagcttttgagtaccacctgttaatgagctttcctattctaaattgttttgggtcacagagttccactttttccactcttattagcactgcaaaagctcctgagaatttaaaaacacagtaattctctggatgttaggacctaggggaacattgggcatttgaacatatcagggagggtccccattttagtgggaacaagtatttaaaccaatatttagagcaagtgtcctcatgtgataaacagagcacagtccaaagataccctctttctcaaggtagtcttttatctttataaagaaagattagtgtttaagagcgtagacttgagctagactacccaggttgaaaccccactagctgggtgatcttgaacatgctgcttagcttctctgtgccaaacttactgatatcctcatctgtaaattagcgataataatagtacttacctggtaggattatggtgagtattaaatgagtaaatggaaacagcttagaatagtgcctgacatatattatgttctctgtagttactggctgtgattattaataatattgccgcaccctaatatctgttatttaattgaaatctgcttgtgtgcttataagaatttactgagttctcacttcccttacagtcatacatggtttttcccttttgcctaaatcagaactcaacagcctgggaaaatcactgacaaatagtggatataggtttcatttctgaggatcaataaacagcttgtaatgttgtatacacatttattctgtttgtacaaaggttttccattctatggagaggatcccagtcttcagattctctggtaagttaataacccactctgttgtatatagggactgaccatgattctccattttctggcataatattagct

SEQ ID NO: 37963 - DNA, 3570 bp, Homo sapiens
ggcctcagactcacctctgacgccgctcttcgcgctccgctggtgaatggagtcgcgttctctgttttgctgttgctgctgcctttgtgacgggatcgctttctcccatcgaaccttctagttgcttattgcagctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagtttccagcaggagcatttttaaagataagcaatcctgtgacattaaaatggaaggaatggcaaggaatgatctctggtatttgtcattagaagaagtctggaaatgtagagaccagttagacaagtatcaggaaaacccagagagacatttgaggcaagtggcattcacccaaaagaaagtacttactcaggagagagtctctgaaagtggtaaatatgggggaaactgtcttcttcctgctcagctagtactgagagagtatttccataaacgtgactcacatactaaaagtttaaaacatgatttagttcttaatggtcatcaggacagttgtgcaagtaacagtaatgaatgtggtcaaactttctgtcaaaacattcaccttattcagtttgcaagaactcacacaggtgataaatcctacaaatgccctgataatgacaactctcttactcatggttcatctcttggtatatcaaagggcatacatagagagaaaccctatgaatgtaaggaatgtggaaaattcttcagctggcgctctaatcttactaggcatcagcttattcatactggagaaaaaccctatgagtgtaaagaatgtggaaagtctttcagccggagttctcacctcattggacatcaaaagacccatactggtgaggaaccctatgaatgtaaagaatgtggaaaatccttcagctggttctctcaccttgttactcatcagagaactcatacaggagacaaactgtacacatgtaatcagtgtgggaaatcttttgttcatagctctaggcttattagacaccagaggacacatactggagagaaaccctatgaatgtcctgaatgtgggaaatctttcagacagagcacacatctcattctgcatcagagaacccatgtgagagtgaggccctatgaatgcaatgaatgtggaaagtcttacagccagagatctcaccttgttgtgcatcatagaattcacactggactaaaaccttttgagtgtaaggattgtggaaaatgttttagtcgaagctctcacctttattcacatcaaagaacccacactggagagaaaccatatgagtgtcatgattgtggaaaatctttcagccagagttctgcccttattgtgcatcagaggatacacactggagagaaaccatatgaatgctgtcagtgtgggaaagccttcatccggaagaatgacctcattaagcaccagagaattcatgttggagaagagacctataaatgtaatcaatgtggcattatcttcagccagaactctccatttatagttcatcaaatagctcacactggagagcagttcttaacatgcaatcaatgtgggacagcgcttgttaatacctctaaccttattggataccagacaaatcatattagagaaaatgcttactaataaatatgggaatttttcacaaagagcaatgactttattttgcattggagaactcctggagataagctgtacaaattgaatctatgtggaaatgctttcagtcttgttactatcctattgcacattagagaattggtcctggaagggaaagaaaccacagattttatttcagtacacaaatccatcagattttcttcttttcatgaattcctacagaagtaattggcctgagagcattcttgaccaagtcttaaatgctagaatctgagaaggaattattaaataggtgagttgttgagcgagaaccccttcatttgaaaagaaatgagtatgctactatagggagagttgttgctgagaattaagaaatgatacagttaatgcaacaaaagatggaaaataatatttcagtcaatatgtcattgttttcttgactatgtctctcttctgggacatttagtagtgtttggtatgttttatgtgtctggtagaaaccatattttggttaacagcaagaaaaatgcttataatgtagtacaattaaaaacaacacatctccactaccagtgctaacccatttttaagtacatttgcatgtgggcaagaattgaaagtatacagataattgaacagaattgatttgttagataaggagattttgactgagttttatagtctgtttaatgttgctgtaataattattttaagaaacttttaaatattgtaagaggatatctagtttctctattctaccatcaaagaagcttttgagtaccacctgttaatgagctttcctattctaaattgttttgggtcacagagttccactttttccactcttattagcactgcaaaagctcctgagaatttaaaaacacagtaattctctggatgttaggacctaggggaacattgggcatttgaacatatcagggagggtccccattttagtgggaacaagtatttaaaccaatatttagagcaagtgtcctcatgtgataaacagagcacagtccaaagataccctctttctcaaggtagtcttttatctttataaagaaagattagtgtttaagagcgtagacttgagctagactacccaggttgaaaccccactagctgggtgatcttgaacatgctgcttagcttctctgtgccaaacttactgatatcctcatctgtaaattagcgataataatagtacttacctggtaggattatggtgagtattaaatgagtaaatggaaacagcttagaatagtgcctgacatatattatgttctctgtagttactggctgtgattattaataatattgccgcaccctaatatctgttatttaattgaaatctgcttgtgtgcttataagaatttactgagttctcacttcccttacagtcatacatggtttttcccttttgcctaaatcagaactcaacagcctgggaaaatcactgacaaatagtggatataggtttcatttctgaggatcaataaacagcttgtaatgttgtatacacatttattctgtttgtacaaaggttttccattctatggagaggatcccagtcttcagattctctggtaagttaataacccactctgttgtatatagggactgaccatgattctccattttctggcataatattagct

SEQ ID NO: 37964 - DNA, 2195 bp, Homo sapiens
ggcctcagactcacctctgacgccgctcttcgcgctccgctggtgaatggagtcgcgttctctgttttgctgttgctgctgcctttgtgacgggatcgctttctcccatcgaaccttctagttgcttattgcaggtatatacgaaagtgctgaattttgtgtttgcatcgtcatcaggcgcgtgttgagccctttagtaatgtagcagtgtattagcttcgtatttctaggtagacggtaatttcgtcaatgaaaaaatttaacggtgatcgtcaccccttgcctcagtcactttctgtccctcgcgcggccccggcgttcacggcggacgttcttgttctgtggagaataacggctgcacctggagattgacgcagagtgggcggcggtggtgctttgtctcctcagcactctgctgtcactcaaggaagtatcatcaagaacaaggagggcatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccctggctggtggagagagaaattcaccaagagacccatcctgattcagagactgcatttgaaatcaaatcatcagtttccagcaggagcatttttaaagataagcaatcctgtgacattaaaatggaaggaatggcaaggaatgatctctggtatttgtcattagaagaagtctggaaatgtagagaccagttagacaagtatcaggaaaacccagagagacatttgaggcaagtggcattcacccaaaagaaagtacttactcaggagagagtctctgaaagtggtaaatatgggggaaactgtcttcttcctgctcagctagtactgagagagtatttccataaacgtgactcacatactaaaagtttaaaacatgatttagttcttaatggtcatcaggacagttgtgcaagtaacagtaatgaatgtggtcaaactttctgtcaaaacattcaccttattcagtttgcaagaactcacacaggtgataaatcctacaaatgccctgataatgacaactctcttactcatggttcatctcttggtatatcaaagggcatacatagagagaaaccctatgaatgtaaggaatgtggaaaattcttcagctggcgctctaatcttactaggcatcagcttattcatactggagaaaaaccctatgagtgtaaagaatgtggaaagtctttcagccggagttctcacctcattggacatcaaaagacccatactggtgaggaaccctatgaatgtaaagaatgtggaaaatccttcagctggttctctcaccttgttactcatcagagaactcatacaggagacaaactgtacacatgtaatcagtgtgggaaatcttttgttcatagctctaggcttattagacaccagaggacacatactggagagaaaccctatgaatgtcctgaatgtgggaaatctttcagacagagcacacatctcattctgcatcagagaacccatgtgagagtgaggccctatgaatgcaatgaatgtggaaagtcttacagccagagatctcaccttgttgtgcatcatagaattcacactggactaaaaccttttgagtgtaaggattgtggaaaatgttttagtcgaagctctcacctttattcacatcaaagaacccacactggagagaaaccatatgagtgtcatgattgtggaaaatctttcagccagagttctgcccttattgtgcatcagaggatacacactggagagaaaccatatgaatgctgtcagtgtgggaaagccttcatccggaagaatgacctcattaagcaccagagaattcatgttggagaagagacctataaatgtaatcaatgtggcattatcttcagccagaactctccatttatagttcatcaaatagctcacactggagagcagttcttaacatgcaatcaatgtgggacagcgcttgttaatacctctaaccttattggataccagacaaatcatattagagaaaatgcttactaataaatatgggaatttttcac

SEQ ID NO: 37965 - DNA, 782 bp, Homo sapiens
gataccctctttctcaaggtagtcttttatctttataaagaaagattagtgtttaagagcgtagacttgagctagactacccaggttgaaaccccactagctgggtgatcttgaacatgctgcttagcttctctgtgccaaacttactgatatcctcatctgtaaattagcgataataatagtacttacctggtaggattatggtgagtattaaatgagtaaatggaaacagcttagaatagtgcctgacatatattatgttctctgtagttactggctgtgattattaataatattgccgcaccctaatatctgttatttaattgaaatctgcttgtgtgcttataagaatttactgagttctcacttcccttacagtcatacatggtttttcccttttgcctaaatcagaactcaacagcctgggaaaatcactgacaaatagtggatataggtttcatttctgaggatcaataaacagcttgtaatgttgtatacacatttattctgtttgtacaaaggttttccattctatggagaggatcccagtcttcagattctctggtaagttaataacccacaaaagattcaggaagaggatctattttaattttctctttcattctataaatcagtctgttgtatatagggactgaccatgattctccattttctggcataatattagctgctcaatgattgattgttgaatgaagatgaagtattgctgaagccaaccagagatcttgatctctctctgaggaaaaaacctagaaatgatg

SEQ ID NO: 37966 - DNA, 254 bp, Homo sapiens
gtccctcgcgcggccccggcgttcacggcggacgttcttgttctgtggagaataacggctgcacctggagattgacgcagagtgggcggcggtggtggtaagtttgaaccagatattttcagtaatacaaaataaggtttcttctagtctaacttccatttttccccccagctgggatagatgtttaaaattttgcatatggcctttctagtatttgttgaaatagtgacgccgattcgtgtgtggtcttttaa

SEQ ID NO: 37967 - DNA, 606 bp, Homo sapiens
aaactatagttgtaaaaataacaatagctaacaaaatttcatcaaaacttaaactctaatgtgtattcgcattcatttatttcatttgatcatcacattgactgtgtagaatattaggattaaatgtacgattaagatttctataccagtttttgaggtgtagtaacagagatccagtcatatagcaaatagcttgttctactaggattaaaatcttaaatatatgcgtaagagcttagtgcttgttcctttaaaatatgcctaatcttttaaatgattgatctgcattgatgtattggcaatcttttaatttgtcctaggtttcccaaaatttaacttgaatcggtcttaaccaatttcttatcagatgttaagaaaatttaaaaagaagggaaacatagatgatagaggaaaagcataggggatagccaagtttttttaataaagattaaaaaattgaataatggataacccttttaatcttttagttgtctgatgtgtttcaaactttttttaaaaagccaagtgacttatttaagaagatttgattgtcagaaaataaaagctgtacttttaaagagcttatatgtttctgaaaataatgat

SEQ ID NO: 37968 - DNA, 127 bp, Homo sapiens
caatttagggcaatgaaaaaggtcagaactatccaattcattctgtagcagttaggccacaaaatacttgtatggctttgatcatgtctttgatcttttctgagctgctttttccttctcaaataag

SEQ ID NO: 37969 - DNA, 258 bp, Homo sapiens
cccctgtctctacaataaaagtaaacaacttagctgggcataatggcatgtgcctgtagtcccagctactcaagaggtggagatgggaggatcacttgagcccaggagtttgaggctgcagtcagccgtgactgcaccaccatactccagcctgggtgacagagcgagatcttgtcttaaaacaaaacaaaacaaaacccagacttcctataattcctaaaaataaatgtgggtttgagaggcctaccttgaaatgta

SEQ ID NO: 37970 - DNA, 273 bp, Homo sapiens
acatgagataggagatatttttgtggtcatctttgaaaaatataatctgccacaggcagacacatccattcctaaaaacagaatggcaaaaatcactttaactctcagcccactggttaaagcctagtctcatggccccacttagctgcaaggacaacctatgagacatctttagctgagtgtctgcaggcccatcgcaagctctttgtttttaaaaatatttttatttataaatggattttttttgttgttatataacaaacctacatatgt

SEQ ID NO: 37971 - DNA, 406 bp, Homo sapiens
aagttttaacttgattctgaaggaagagtaggaaattacaaatgagttgtcaggaataaaaacaaagtcactaagcagaataaacaaaacatatgaaggtaataaattagaaaataaaagataataacatcaacaaaagtgaactcaacacacgatagtaatgagaatttcattatatctgcaaaatacagtatgatgaataggcaaggaatggagatgtcattataacttgagacaagattttaaaagtacttagttttaagagagccagtataaagttttattcctaaaactaataacatcaactttctctttatgatataaaaatatatgcttttaacaacttgccagctgctctgcctacgaagtagctattcttttattcctttgctttcttaatgaaaaa

SEQ ID NO: 37972 - DNA, 362 bp, Homo sapiens
tgagtatgtatgttcaaatttattgaaaacctatttttatgaattgcgaagtacaccaaatatggcattaatagaactacagccttaactacatgcttattgtcaggcctctgagcccaagctaaaccatcataatcccctgtgacctgcatgtatacatccagatggcctgaagcaagtgaagaatcacaaaagaagtggaaacggccggttcctgccttaactgatgacattgcgccattgtgatttgtttctgccccaccttaactgagcgattaaccttgtgaaattccttctcctggctcagaacctcccccactgagcaccttgggacccccacccctacccgcaagagaacaacc

SEQ ID NO: 37973 - DNA, 330 bp, Homo sapiens
gcagcctcccacaatggctgtgacattcatcctgttctgatagaaactccctgctttctgtgtggcctgggatttgaatctggaggtctttgatccttagcctctcccgtggctggttaccggatggaacggacctgatctttcatttcccaaagaaggcctattaccatcagaagcaaaccgcatccttgcttttatagcagttgcgcttgataattattggtgatactgacatctgcccatgcttacttcatattcatgagcctgaagtggaattttttttttaagctaacatccccagttttggggaatagagtatttcctccaaag

SEQ ID NO: 37974 - DNA, 432 bp, Homo sapiens
tcgtatatcctatgtctttttcactccatttacatgatctaaatgaaaagattttgtattagtatgtgtcactttgataacattaaatctcttttcattgtatgcgcagcctgtaaataatttagaactaatcttaaaaactggaaaaaggcagggcgtggtggctcacacctataatcccagcactttgggaggctgaggcaggcggatcacctgaggtcaggagttcgagatcagcctggccaacatggtgaaaccccgtctctactaaaaacacaaaaattagccgggcgtggtggcggacgcttgtaatcccagctactcgggaggctgaggtaggagaattgcttgaacccaggaggcagaggttgcagtgagccaagattgcgccactgcactccagcctgggtgtcagatcgagactcggtctca

SEQ ID NO: 37975 - DNA, 674 bp, Homo sapiens
ggtttaggacagtggttcttaaagcgtggtccgccagcaggtagcactggcattacctgagaacttgctagacatgcacattcttgagcaccacccctgacttactgaaccagcattctgctttagcatgacttgcaggtgattctgatgttggttcaagtttgagaaacactgggttaggaagtttatttgaggaatgagcccttgactagctagaccctctacagaaagggctggccttgccgtcctgatatgtcctccagtgaggaatccctcataccatcagatcaggatagagcctttctcttttacattgcaaaactctgaaaatgttacatgatagttatttctatcagtctagaaaggcccaaacaagctgacccatccaacctccccagtaacccccattggtgagtccttatggcaactgtctgtcttggaatttgcagatggtagaacatgaatcaaaagctccatattttgatagccgtggctgagaatcagcacatctccagaattcagcatcacagctggccagagaagagaagcagtgagttccctatccttggagacaagcagaggcttcagaatcactgatggggatgttgaggggaacacttagggaactgatggggctggttgagatggctgtagcccccctaactctgtgcgtc

SEQ ID NO: 37976 - DNA, 608 bp, Homo sapiens
gacgggctttgccaaggcgcacggcattcgggcctgtgctgcgcgctgtcagatgtccgaggcagatacctgtttcttcatgtgaatctgaatggcttgggtggacttagcacactgtgctgtctgctgtttctgtcgacgagaagccagagtggtgcttctctaaggagatgtcagaaaaatgtttttcctttttcccaggggggagaaattcaaggctggtttggcctatttttttttccttagtgatataaaatacactgaggccgcatcttttggtttatttgtttattttgtttggagccatccatgctggtatctaaatacaataggaaaacagatggcaaactttgaacttctggaccaaatttgtgtttgcctttgtctccttaacagccaaactgtaaattatggagtataaatattcaacagaggagctctttatggaaatcaccatagctgaatagactctgattaaccaaatatgcactgaaaagtacttggtaaacacttccgctccccctttccccaatccttttcaagttcccattatggactaaggttagagttctctttacagcatttatactttttctcttctcttacct

SEQ ID NO: 37977 - DNA, 478 bp, Homo sapiens
tacttctttttcactttcttaatggagtctttctttaaaaatttttttagaatatcttaaattcattccgttaacatggagtcttctgatgaacaaaagtgcttaattttaacataggatcaaatttaccaatctttttctttatggtgaagactgaattctgcctaagaatttttgcctgtccccaaggtcgtgaagatacaagttatcttctagaagcttgattattcagtctttcacatttaattgtataattcacctagaattggtttcgtatgtggtatgaggtaagagtcaagatttttttccttatttgaagtatccagttgacccagcaccatttattgaaaagatcatcctttcctactattctgtagtgccatctttgtcatatatcaagtgtctgtatatattttccaatctgtttgccgctcagaaacttaaaccctgcttaaatagttcttgggtcaaaaaaaaa

SEQ ID NO: 37978 - DNA, 338 bp, Homo sapiens
aagagaatgtggaatccgtgcagccacgagaagaaatgtaccaaacaacagggagaaataaaaagtgtcaaatgctgctgctaggccaaataaaaagatactcaagtaaccaccactgggcttagcaatgcagaggtcactggtgacattaaacaaagaagtttcggtagagcagtgtgaggtgaaagcaacttccgaatgttcggcaacatacgatacattttctgatctggttattgccaaccttgaattcaaaaattaaactaaaaatcatatatggctataaccatagcatagtgaatcagctactctctgacatcctaatcaaataggtaatt

SEQ ID NO: 37979 - DNA, 605 bp, Homo sapiens
atagaggacaattggtggtggcctctcccagccctatctagaggaatgaagcctgtgaaaacctcttagagacaagtcctctctccagctctggtcctcacctcaactccccctccaagggggtggcaggaaggataatttgtaaaatgtaaataaagtctgtagattagaaaatagtaggcatcaacgttaaacttcccaattctgataattgtgctatggtgtcctaagataatttccttagttttagcaggtatttagagttaaaagggcatgatgtttataacttactctcatatggtttgcaaatgacataataataatatgtatatatgcaaacaaacacatacagagaatgagaaaagaaatatggtaaaatgttaacaattggtgaatccaggtgaggggtatgggaattatttgcactattacaactttttggtaaacctgagattaatttagaacaaaatataaaaaggaatttataggtctgcctgaggagctcttccaagaaaacgtacaatttactcaaccttgaagacttagtggtcctttgccaccaattttatttttccacttcaactcttagaaacagaatccaactc

SEQ ID NO: 37980 - DNA, 853 bp, Homo sapiens
tcacagcccgccgggcggctctatggggggcccccccagttttagaaagttccaaagccccccaaaaaaaaaaaaaaaagttaacttgctgtatacctcagtgtaatgtccattcaaggagtattaaatgaggatttccctgcgaggacatttactgtattgctacttaaattatggaagacaatatatcttcaactttaataaaacctattcagaaaattaccaattcagaattcggagttcttatccaggtgctctaactaacttcagggaaattggaacaataagttatgttacatgcacactcaaattctttattttctccactttaagcaggaaagggtaaaaactgttttggtactcaagcccagccttacatactgtgtttctctctctgtctgcatgcatattaaagtggaaaaattgtatttatatcttagttattaccatagtacctatgaaccttatcaaaattgcttatttgactggtgttacagctgctattaatctaagtctattgtttttctattttagtagataatttagttttaaaatacgtagggtttgagagcagatatatttatttaatctgttttctctagtaactattgctgaagggttaggcattcagtattcctatttgtcctaattttgaagttaaaaattttggttacagatagatagagggagaaaagttcaaaatgagtgagagagaactttatgcaggttgagataatgcctaaaataatgagctggccagactgtggaggtactctttgtattttgtaacattgactttgggtaaatgctttttcactgttaataaatatatatcctgtatacaaaaaaaaat

SEQ ID NO: 37981 - DNA, 485 bp, Homo sapiens
taacagtaatcatagttatttttaaagtcctgtctcttgttctcatatgctgatctcctccagcttctcatctatggtctgttattttctcttagcttttggtcatatgattctctcacttcacattcctaggattttacgattttttttttcttttctttttttttaagatgacaccttcttctcctaagcagatagatagagtaaacggctggacaccttaatcttttcacagactcaagtgagctaagattggtgtgtagttttaatcacagtgtaccttggactcacctctgttctaagaatatgactttaaaattctctgttgagacccccacaggcaagagtctcttcaccactggggcttgcaggaaatttgttctgattcacagatctctttggttttgatctttagccttccattttgagattccttcacatttggcaaaggtcccaggtagcgacagtgtgtgggtttgatgttg

SEQ ID NO: 37982 - DNA, 425 bp, Homo sapiens
gcgatcaaagtcagtttccttcccttgcaaagcagcccctctgtttacttgtctgtctccctccctgagcgccttgctcagcgctgtctccccagggcctgcagtgtgctacatcaaagtcggggttccttcccttgtgggttgtgcccagtgcctgaaaacacagtgtcttcctgccaagtagagccttgtaagaacgtcccactgacctgcaaagtgtgtgggcgaaaaccttcccatcctccctcttaggccctggacttccctctgttacaacattagcattctgcacagtgattatttgtttgacttactcatatttgtagcctttcactggagaatttctatccaagtaattcagcctattttgccttctttgcacataagaacgtcaccatgctctagaccaagctaaagctttggct

SEQ ID NO: 37983 - DNA, 348 bp, Homo sapiens
acatgaaaaacattttcagtacccccttgttcacctaccaacatcgggaaataaaaccttctatttatgtccattttctagaagcaatgccataccaacttgatcatgagaagcattttttcctctaattggagatgtattaatttaactgttttggtgactaagtcatacccctctcaacttgagtgacagtgtttttttaaagctaaaaccagagatgtcctcaggggctgtcgaggcgtggtaacattttgcccctttgcagaatggcccgaggtgactgtgacttccagattcttgtacctactttaaaattttgtgtgtgtgttcttcctcctggacaaatct

SEQ ID NO: 37984 - DNA, 571 bp, Homo sapiens
tctgcaggccacaccccatggtctatgccttcccatcatcccctaaatataagctcactcagcctgtggacaaaagatctgaaagacctatgtccatggcagaatcaatggggactaatacctattatgaaaataaagggctccttctcttccaggaatcagcacttggaacaggggtcaacataatatccatcaattggtcaaccaacaaatgatttattgagaacccattgtgtgctcagcatttaactcaaagaatcaaaacacagacatcaagtatgggtttttagagagacatgggatatgtggtgaggggttctctcaaatcgtgttactgcaactactgtatttccaagcctacctttgggccctgaagcaatctatctgtagctgttcttgcactagctcctctttcccccacccctgatcccttggcctccagactgaatgtttggctcaacaagacaaaatgtttggctcctaagtctcagctggagacagattacattcaactgagcaacagaatttgttctatggggcagcaataaaaatactagtttgtaataacctt

SEQ ID NO: 37985 - DNA, 327 bp, Homo sapiens
cagtgcctgcttagggaggctggaccatggtgtgggtgtcctgagaccagtggtgtgccacgatcactgagataagatcctgagtacatggtaggatccaatcaggtacaaatttgctttgttgatcaaaagagtatcctagcctggcatggtggcatgcacctgtagtcccagctacttcgaaagctgaggcaggaggattgcttgagcccaggagttcagggctagcaacttagcaggaccttgtctctaacaacattttttttttaagaaagaatattccatgttggcttacagagaatttttaaaatcctgaatgatataaag

SEQ ID NO: 37986 - DNA, 235 bp, Homo sapiens
ggtacagtgataatacattcatataattgtaaagatcaaatcagtgtattgggggtatctgttaccttaaatatttgtctttatgctggaaacatttgaattactctcttctagctattttgaaatgtgcaatagaatattgtgaactatagtcatcttactgatctaacactaggtcttatttcttctattaagctgtgtatgtacattcattaatcagcttctatatacactt

SEQ ID NO: 37987 - DNA, 615 bp, Homo sapiens
ttgagaaagtgacctgtggattaagacctcagagataagtgggacagagcttggtagaagcaccagtgtgggcaaaggtcctgagtctgaacagaacatggcatgtgaggaatgaagcagcctggccctaggtgaagctgagaaaaccctgcaggcccttgtaagccatagagaaggctccgagacacaagctgagccatggtctactagtaagaacaataaaccagacatttactcaaagttaactatgtgccatgcacaattctaagacctttacatgtattaatttgaatcctcatggtattcttttgaaataaggacattttgggccagatgcagtggctgacgcctgtaatctcagcactttggggggccgaggtgggtggatcatttgaggtcaggagtttgagaccagcctgaccaacatggtgaaatccagtctctactaaaaatacaaaaaaattagccaggcatggtggtgcatgcctgtagtcccaattacttgggaggctgaggcagaagaatcacttgaacgtgggaggcagaggttgcagtgagccaagattgtgccactgcactccagcctgggcgacagagtgagactctgtctcaaaa

SEQ ID NO: 37988 - DNA, 416 bp, Homo sapiens
gtatgggtaatacaaaacaatctgattgatacacatcaagagtaattatccctagaggaaaagagagtggtgttagaggagggcagtatagttttactttttctctgtacaattctatattatatattataatttacaattacaattttgatagtaggtatgcagattactattatagcaaaatacaattactattttgatagtaggtatgcagattactaatattaaacatttgcacactggaggatgcttataataggattccttcattctacaacaacactctactgtaaatgtaattaatgccttgtactgaacactcaggtttttaaaaaaatgatgttttctgctatcgatgaagtattggtattttctaaatttttgacaccaaaaatataagtataaaaaagaataaa

SEQ ID NO: 37989 - DNA, 217 bp, Homo sapiens
aatgtttccatggcttctcattgccttaggatttaagttctttatgatccctatgatcttttccatttcgtatttgaatggatcacaatatttgcactgtgtgctattgttattttcagcatcaaatctgctaacgcaccatgctccctcttgcctctgagcatcattatgcctttccaaggccagggacatttttccatcagccactccctcttct

SEQ ID NO: 37990 - DNA, 447 bp, Homo sapiens
cgagccatgatcacaccaccgtactctagcttggatgacagagtgagaccctgtctcggtaggtaggtaggtaggtaggtaggtaggtaggtaggtaggtaggtagattatagatagatagatagatagatacagacaggcaataatttcatcaaaaaacaccctcacagaaacataataaggataatatttgaccaaatacctgggcactatggcccagccaaggtgacacacaaaattaaccgtcacatcatacagcccagcagttgcatcccttgccatttattccagagcagtgaaaacttttttccgtacaaaaacccttgcatgattgttcatagcagctttatttgtaattgctaacaattggaaaaactaacatgtccgtcagtaggtgagtggttcagcaaagcagtacacatttcctggagcactgctcccacatta

SEQ ID NO: 37991 - DNA, 180 bp, Homo sapiens
aatgaaatggcagtcgtagacataactgatgtgtaactgcacaccacctctccatccaccatcaaatgaaagaaagaaagagaatgaaaggaaaccagaagaaatatccaacagaaggaaaatagttaaccaaattatggctcagactagtttggtttaaccattgctcaaaaacaaaac

SEQ ID NO: 37992 - DNA, 498 bp, Homo sapiens
caccgcgcccagcctagaatatataggatctttagacgtgtttctttttagaggtaggaatgtagctaccacctagagcccactgagattcagctttcagaatctagagacatctcaggagccagggagccacatttcatctttcccttgaacagaacacaagatcagtggctttgcttcattctcattactctgtattagttaagcagtgccgccacatcactgtacaagcatgttttcaggaaggcatatgacgcactcctggtaagatggggcaggaagcactttggggctgggccttccaaccaggtgttcaggctgttcagggcccgcatgctgcaatgagaatttagcagtgactcctcatggagcaggaatatgatgcgcttaacgtattcttaaggacttctcagttttaattataagtttagtaatataagcagaatttaacatccagaattaaggctatttccatttccattctctacaaataaaaac

SEQ ID NO: 37993 - DNA, 649 bp, Homo sapiens
gcgcatgcctgtaatcccagctactcaggtggcatgtaccagtagtcccagctacttgggatgctgaggtggtaggattgtttgagcccagaaattcgagtccaacctgggcaacataaagagaccctgcctccaaataaaaataattaaaaaaaatcaaatatataaaatacctaatgaatgtgcaatgcagatgacttcagcagactccaattctactaggaaacttgtggagctaagatagtagttattcatttgtctctctttaatatctcaacacagtttagaaatcaaaagatgaggagcaatattaaatttggtattcaaaattaaggtttacattaatgctatcaaatgacttttattaatttaatacttatatgcttggtttttcatagatcaacttccctcttattattttaaatttttatagacttagagagtacaagtgaatttttgcttgtttctttggttggttggttggtttttttgagacaggatcttgccctgttgccaggctggagtgcagtgctggagtgcagggcttacagtaacttcgagctcccaggctcaagcaatcctctcaccttggcctcttgagtaggtgagaccacaagtgcacatcaccacacacagctaattgttaaaa

SEQ ID NO: 37994 - DNA, 381 bp, Homo sapiens
gcagctttggcaaaagtgatttgtttcttctccacttttaagtaggttcaggatgaagggaggccataaaacaaagtccacatcttcaaggtaaaaacctacttttaaaggaagcaggccaattagaaactccaaacacagcagttagagatgagagaggaagaatgaactcctcaaagcattgaaggtcaagactaaccttaggaattcaggtcacagccctcccagccccaatacatgaaggtcgttttgcagaaagactggccaatttcattaattgcctttgtgaggctttagaattttggagattatctgaaagagctttttaatctcaagtttggctgtggagcatacagatacaagctgattttcctatctttt

SEQ ID NO: 37995 - DNA, 317 bp, Homo sapiens
agaacactgtgaaaattttattccaatattacaaataaaaattgaagataagaatttaggtagctttctcaacatagtacacttggtagctagtagagatagaattcaaataaaaatgcaccacatattaaagactttactctttgctgaaatactactctgacttccttttgatttcacttgactttgcaatcacttattgaacttttattatgtacataacttgaagcttaggtatttactattgcttatgggcttcaaaaagtgccccaaattgtctaattcaacccaactttatttatcatccagtactttaa

SEQ ID NO: 37996 - DNA, 173 bp, Homo sapiens
tcaaggttctcttggaggagggtttgagtgtgacttgagggctgcctctgaattggccagtggacacaagagtaggggaaggatttggtgggaaacagcaggtcccttcatccctccgagcctcagtttacccccatctgtaaaatggaggaaatagtagtgcctgccttaca

SEQ ID NO: 37997 - DNA, 449 bp, Homo sapiens
gttcacaaccccaaagcaaaattttcgcatgcaaaaacatagcatcaaccttttggaaaagcttcccctgagttctcagcttttgtttctgttcataaaatcaaattaatctttttatggtaggtgggaatctcccatcaatggcattgatctggtcttaaagaaagaagcctgcaagtggccatctcctcacatacctgattcattctaactgcagatcagctgataagtggaaagtatgggcagcacaaaggaaatagaagaaatgattccacagaaatgtggtagattggctggtgaatcctagccaaaagaggcactgaaaaggggcttgggttaccacaatcatgtgtgataataagtaatctttttttttttttttttgacaagtctcactcagtcgcccaggccagagtgcagtggcgcaatcttggctcactgcaagctcc

SEQ ID NO: 37998 - DNA, 2178 bp, Homo sapiens
ccaaatccagttttcatatttaaagcgaatgagccccctcctctcagtgggaaagatgagctgaagctttactccctcgatagtgttgggaaaagaaatcagacaaaaatctaaggaaggaccaaatattgtacagagtgtgccagtagcttttgcaactggactgaaaatacctgccttttctctccacaggggaaagtggaagttgaagctgggaaagaaggtatgaagtttgaagcgagcgccttctcatactatggcgtgatggccctgacagcctctccaggtgaaaataagtcccctcctcgcccatgtggcttgaatcactcagactctctcagtcgaagcgaccggattgacgccgtcacaccaacactggggagcagcaataaccagctcaattcttcgctcctccaagtctacatccccgattactcggtgcgagccctttcggatctgcagtttgttaagatctcaagacagcaataccaaaatgccttgatggcatcccggatggacaaaaccccccagtcttcagacagtgaaaacactaaaatcgaattgactcttacggagctgcatgacgggttgccagacgagacagccaacctgctcaacgaacagaactgtgtgacgcacagtaaggccaaccacagcctgcacaacgaaggcgccatctaggccgcgctggctgcacccgcccaggcccgcacccgcccagtcccgagggcccggccctgtctgcccatgacttcactggtgtgagcttgtccgccatgctgtaccctgcaacatcctgagaccaaagaccttgtgcccttcccaggagccgcggaggaggacagtgagggaggaatggaaacgagagatgtgaagttggcagccggggcatggcgttcaagattttggagatgaactgattccgcccaaatagaatcatgtttattttttcagctctcccttttatcattattcacactcctctgccctcgatttgcatgaagttgaaaattgttgcgatttattttttcaagagatcatgtttttaaagtgtcttttgcagagttttaagttgttctgtctgaactctgctgtgatcccatgatgtgaccctgatgggctggacttgcccctccggtagccttccttggccctcccagcgaggggcacccttcctctgtgccccagtgggcatcaccgtcgatctcgctggctgaatgaagaagaccgtgttactgcagaacctgccaagtctgtcatcactgtggggtgtagcctgcctcagagggacctgcaatcacctctctgagctcagtggtattttgagaatttaatgtttaactgtacccctttccctcaggaagatttaacatttgcttgggaatgtgattttgctcccaccctaaggaatttttatcaccaaaatgaatgttaatgaatttaaaacccatggtttatcattggcaagaggcaagttgacttcatcctgtcattccagcctggggtctgccagccagccctcctccccgacccagcgcctaagctcacagagtgtcgtcgcccacctccctggtccttgctcttgttaacccaagatgctgctacacagatgccaaatggaaatcttccacagggctttttcagtaaacacgtgatgtggagtgcaagctcctccccttcccactagaacatactttaacagaaaacgagtcggaccttctagctgcactctgtactgtgtgccgagaaggcatttctagacccgtgtttttaaaggagggaactttggggattgccagcccctgctcctcctcccagggagccaactgtccctcctcccctgtccctgggcccatggggcccggcagtggctgtgtcccctgcctgagggctctgtgcctcctgcctcagatgcggcctgtgccagagaggctgcctgtacagccagggtcagtttggccccaaacagggattcagaaaccaaatgtgtgttgtggccattttatgtgtgtctccgtcttattttaataccaaattcatcatgtagtgaaattatgtcaggaggtatatgagtgactgaattcttaactatagcttatctgtgttttgttagcccgagggatatgtgcaggttgttggcgctattcatgcactgaaatgaaatcatactgaccagtg

SEQ ID NO: 37999 - DNA, 4232 bp, Homo sapiens
ctcccgcgagcctcggggttcctcagctggctgaggtggagtcagtgtcagtcagggaggcgaactgctgagcactggccgcggacgctccgttgcagtctcgcccaggggccggtacctgcgctcgcgccgccgggttgaaaggatgaagccgcagctggagcagccaccctatgattggctgtggcgcttgtgaacccaaagtaaagatggcgggcgggcaggcagccgccgcactgcccacttggaagatggcggcgcgccgcagcctcagcgctcgcggccgggggatcctgcaggcggctgcggggcggctgctgccgctgctcctgctgagctgctgctgcggtgcgggcggctgcgcagcggtgggcgagaatgaggagacggtgatcatcgggctgcgactggaggacacgaacgacgtgtcgttcatggaagggggggcgctgcgggtgagcgaacggacccgggtcaagctgcgggtgtacgggcagaacatcaataacgagacgtggtcccgcatcgccttcaccgagcacgagcggcggcgccacagcccgggggagcgcgggctggggggccccgcgccgccagagccggacagcggcccccagcgatgcggcatccgcacctcagacatcatcatcttgccccacatcattctcaaccgccgcacctcgggcatcatcgagatcgagatcaaaccgctacgcaagatggagaagagcaagtcctattacctgtgcacgtcgctctccacgcccgccctgggcgccggcggctcggggtccacgggtggcgccgtcgggggcaagggtggctcgggggtggccgggctcccgccgcccccgtgggccgagaccacctggatttaccacgacggcgaggacaccaagatgatcgtaggcgaagagaagaagttcctgctgcccttctggctgcaggtgatcttcatttcgctgctgctgtgcctgtcgggcatgttcagcggcctcaacctggggctcatggccctggacccgatggagctgcgcatcgtgcagaactgcggcacggagaaggagaagaattacgccaagcgcatcgagccggtgcgcaggcagggcaactacctgctgtgctcactgctgctgggcaacgtgctggtcaacaccacgctcaccatcctgctcgacgacatcgccggctcgggcctcgtggccgtggtagtctccaccatcggtatcgtcatcttcggagagatcgtgccccaggccatctgctcccggcatggcctggctgtgggggccaacaccatcttcctcaccaagtttttcatgatgatgaccttccccgcttcctacccggtcagcaagctgctggactgcgtcctgggccaggagataggcaccgtctataaccgggaaaaactgctggagatgctccgggtcaccgatccctacaacgacctcgttaaggaggagctgaacatcatccaaggggcgctggagctccgcaccaagacggtggaggacgtgatgaccccactccgggactgcttcatgatcaccggcgaagccatcctggacttcaacaccatgtctgagatcatggagagcggctacacccgcattccagtgtttgaaggggagcgctccaatatcgtggacctgctgtttgtcaaagacttggccttcgtggatcccgatgactgtacccccctgaaaaccatcaccaaattttataaccaccccttgcactttgttttcaatgacaccaagttggacgctatgctggaagaatttaagaaaggtaaatctcacctggctatcgtgcagcgggtaaacaatgagggagaaggggatccattttatgaagttctgggaatcgtcaccttagaagatgtgattgaagaaatcatcaaatctgagattcttgatgaaacagatttatacactgacaacagaacgaaaaagaaagtggctcaccgggaacgaaagcaagatttttctgcctttaagcagacagacagtgagatgaaggttaaaatatcaccacagctcctcctggccatgcaccgtttcctagcaacagaagtagaagcatttagcccatcccagatgtcagagaagatccttctaaggctgctaaagcaccccaatgtcatccaggaactgaaatatgatgagaagaacaagaaagcccccgaatactacctctaccagcgcaacaagccagtagactacttcgttctcattctgcaggggaaagtggaagttgaagctgggaaagaaggtatgaagtttgaagcgagcgccttctcatactatggcgtgatggccctgacagcctctccaggtgaaaataagtcccctcctcgcccatgtggcttgaatcactcagactctctcagtcgaagcgaccggattgacgccgtcacaccaacactggggagcagcaataaccagctcaattcttcgctcctccaagtctacatccccgattactcggtgcgagccctttcggatctgcagtttgttaagatctcaagacagcaataccaaaatgccttgatggcatcccggatggacaaaaccccccagtcttcagacagtgaaaacactaaaatcgaattgactcttacggagctgcatgacgggttgccagacgagacagccaacctgctcaacgaacagaactgtgtgacgcacagtaaggccaaccacagcctgcacaacgaaggcgccatctaggccgcgctggctgcacccgcccaggcccgcacccgcccagtcccgagggcccggccctgtctgcccatgacttcactggtgtgagcttgtccgccatgctgtaccctgcaacatcctgagaccaaagaccttgtgcccttcccaggagccgcggaggaggacagtgagggaggaatggaaacgagagatgtgaagttggcagccggggcatggcgttcaagattttggagatgaactgattccgcccaaatagaatcatgtttattttttcagctctcccttttatcattattcacactcctctgccctcgatttgcatgaagttgaaaattgttgcgatttattttttcaagagatcatgtttttaaagtgtcttttgcagagttttaagttgttctgtctgaactctgctgtgatcccatgatgtgaccctgatgggctggacttgcccctccggtagccttccttggccctcccagcgaggggcacccttcctctgtgccccagtgggcatcaccgtcgatctcgctggctgaatgaagaagaccgtgttactgcagaacctgccaagtctgtcatcactgtggggtgtagcctgcctcagagggacctgcaatcacctctctgagctcagtggtattttgagaatttaatgtttaactgtacccctttccctcaggaagatttaacatttgcttgggaatgtgattttgctcccaccctaaggaatttttatcaccaaaatgaatgttaatgaatttaaaacccatggtttatcattggcaagaggcaagttgacttcatcctgtcattccagcctggggtctgccagccagccctcctccccgacccagcgcctaagctcacagagtgtcgtcgcccacctccctggtccttgctcttgttaacccaagatgctgctacacagatgccaaatggaaatcttccacagggctttttcagtaaacacgtgatgtggagtgcaagctcctccccttcccactagaacatactttaacagaaaacgagtcggaccttctagctgcactctgtactgtgtgccgagaaggcatttctagacccgtgtttttaaaggagggaactttggggattgccagcccctgctcctcctcccagggagccaactgtccctcctcccctgtccctgggcccatggggcccggcagtggctgtgtcccctgcctgagggctctgtgcctcctgcctcagatgcggcctgtgccagagaggctgcctgtacagccagggtcagtttggccccaaacagggattcagaaaccaaatgtgtgttgtggccattttatgtgtgtctccgtcttattttaataccaaattcatcatgtagtgaaattatgtcaggaggtatatgagtgactgaattcttaactatagcttatctgtgttttgttagcccgagggatatgtgcaggttgttggcgctattcatgcactgaaatgaaatcatactgaccagtg

SEQ ID NO: 38000 - DNA, 4298 bp, Homo sapiens
ctcccgcgagcctcggggttcctcagctggctgaggtggagtcagtgtcagtcagggaggcgaactgctgagcactggccgcggacgctccgttgcagtctcgcccaggggccggtacctgcgctcgcgccgccgggttgaaaggatgaagccgcagctggagcagccaccctatgattggctgtggcgcttgtgaacccaaagtaaagatggcgggcgggcaggcagccgccgcactgcccacttggaagatggcggcgcgccgcagcctcagcgctcgcggccgggggatcctgcaggcggctgcggggcggctgctgccgctgctcctgctgagctgctgctgcggtgcgggcggctgcgcagcggtgggcgagaatgaggagacggtgatcatcgggctgcgactggaggacacgaacgacgtgtcgttcatggaagggggggcgctgcgggtgagcgaacggacccgggtcaagctgcgggtgtacgggcagaacatcaataacgagacgtggtcccgcatcgccttcaccgagcacgagcggcggcgccacagcccgggggagcgcgggctggggggccccgcgccgccagagccggacagcggcccccagcgatgcggcatccgcacctcagacatcatcatcttgccccacatcattctcaaccgccgcacctcgggcatcatcgagatcgagatcaaaccgctacgcaagatggagaagagcaagtcctattacctgtgcacgtcgctctccacgcccgccctgggcgccggcggctcggggtccacgggtggcgccgtcgggggcaagggtggctcgggggtggccgggctcccgccgcccccgtgggccgagaccacctggatttaccacgacggcgaggacaccaagatgatcgtaggcgaagagaagaagttcctgctgcccttctggctgcaggtgatcttcatttcgctgctgctgtgcctgtcgggcatgttcagcggcctcaacctggggctcatggccctggacccgatggagctgcgcatcgtgcagaactgcggcacggagaaggagaagaattacgccaagcgcatcgagccggtgcgcaggcagggcaactacctgctgtgctcactgctgctgggcaacgtgctggtcaacaccacgctcaccatcctgctcgacgacatcgccggctcgggcctcgtggccgtggtagtctccaccatcggtatcgtcatcttcggagagatcgtgccccaggccatctgctcccggcatggcctggctgtgggggccaacaccatcttcctcaccaagtttttcatgatgatgaccttccccgcttcctacccggtcagcaagctgctggactgcgtcctgggccaggagataggcaccgtctataaccgggaaaaactgctggagatgctccgggtcaccgatccctacaacgacctcgttaaggaggagctgaacatcatccaaggggcgctggagctccgcaccaagacggtggaggacgtgatgaccccactccgggactgcttcatgatcaccggcgaagccatcctggacttcaacaccatgtctgagatcatggagagcggctacacccgcattccagtgtttgaaggggagcgctccaatatcgtggacctgctgtttgtcaaagacttggccttcgtggatcccgatgactgtacccccctgaaaaccatcaccaaattttataaccaccccttgcactttgttttcaatgacaccaagttggacgctatgctggaagaatttaagaaaggtaaatctcacctggctatcgtgcagcgggtaaacaatgagggagaaggggatccattttatgaagttctgggaatcgtcaccttagaagatgtgattgaagaaatcatcaaatctgagattcttgatgaaacagatttatacactgacaacagaacgaaaaagaaagtggctcaccgggaacgaaagcaagatttttctgcctttaagcagacagacagtgagatgaaggttaaaatatcaccacagctcctcctggccatgcaccgtttcctagcaacagaagtagaagcatttagcccatcccagatgtcagagaagatccttctaaggctgctaaagcaccccaatgtcatccaggaactgaaatatgatgagaagaacaagaaagcccccgaatactacctctaccagcgcaacaagccagtagactacttcgttctcattctgcaggggaaagtggaagttgaagctgggaaagaaggtatgaagtttgaagcgagcgccttctcatactatggcgtgatggccctgacagcctctccagttcctttgtccctgtctcgtacctttgttgtcagcagaacagagttgttagcagcaggttctccaggtgaaaataagtcccctcctcgcccatgtggcttgaatcactcagactctctcagtcgaagcgaccggattgacgccgtcacaccaacactggggagcagcaataaccagctcaattcttcgctcctccaagtctacatccccgattactcggtgcgagccctttcggatctgcagtttgttaagatctcaagacagcaataccaaaatgccttgatggcatcccggatggacaaaaccccccagtcttcagacagtgaaaacactaaaatcgaattgactcttacggagctgcatgacgggttgccagacgagacagccaacctgctcaacgaacagaactgtgtgacgcacagtaaggccaaccacagcctgcacaacgaaggcgccatctaggccgcgctggctgcacccgcccaggcccgcacccgcccagtcccgagggcccggccctgtctgcccatgacttcactggtgtgagcttgtccgccatgctgtaccctgcaacatcctgagaccaaagaccttgtgcccttcccaggagccgcggaggaggacagtgagggaggaatggaaacgagagatgtgaagttggcagccggggcatggcgttcaagattttggagatgaactgattccgcccaaatagaatcatgtttattttttcagctctcccttttatcattattcacactcctctgccctcgatttgcatgaagttgaaaattgttgcgatttattttttcaagagatcatgtttttaaagtgtcttttgcagagttttaagttgttctgtctgaactctgctgtgatcccatgatgtgaccctgatgggctggacttgcccctccggtagccttccttggccctcccagcgaggggcacccttcctctgtgccccagtgggcatcaccgtcgatctcgctggctgaatgaagaagaccgtgttactgcagaacctgccaagtctgtcatcactgtggggtgtagcctgcctcagagggacctgcaatcacctctctgagctcagtggtattttgagaatttaatgtttaactgtacccctttccctcaggaagatttaacatttgcttgggaatgtgattttgctcccaccctaaggaatttttatcaccaaaatgaatgttaatgaatttaaaacccatggtttatcattggcaagaggcaagttgacttcatcctgtcattccagcctggggtctgccagccagccctcctccccgacccagcgcctaagctcacagagtgtcgtcgcccacctccctggtccttgctcttgttaacccaagatgctgctacacagatgccaaatggaaatcttccacagggctttttcagtaaacacgtgatgtggagtgcaagctcctccccttcccactagaacatactttaacagaaaacgagtcggaccttctagctgcactctgtactgtgtgccgagaaggcatttctagacccgtgtttttaaaggagggaactttggggattgccagcccctgctcctcctcccagggagccaactgtccctcctcccctgtccctgggcccatggggcccggcagtggctgtgtcccctgcctgagggctctgtgcctcctgcctcagatgcggcctgtgccagagaggctgcctgtacagccagggtcagtttggccccaaacagggattcagaaaccaaatgtgtgttgtggccattttatgtgtgtctccgtcttattttaataccaaattcatcatgtagtgaaattatgtcaggaggtatatgagtgactgaattcttaactatagcttatctgtgttttgttagcccgagggatatgtgcaggttgttggcgctattcatgcactgaaatgaaatcatactgaccagtg

SEQ ID NO: 38001 - DNA, 1817 bp, Homo sapiens
ctcccgcgagcctcggggttcctcagctggctgaggtggagtcagtgtcagtcagggaggcgaactgctgagcactggccgcggacgctccgttgcagtctcgcccaggggccggtacctgcgctcgcgccgccgggttgaaaggatgaagccgcagctggagcagccaccctatgattggctgtggcgcttgtgaacccaaagtaaagatggcgggcgggcaggcagccgccgcactgcccacttggaagatggcggcgcgccgcagcctcagcgctcgcggccgggggatcctgcaggcggctgcggggcggctgctgccgctgctcctgctgagctgctgctgcggtgcgggcggctgcgcagcggtgggcgagaatgaggagacggtgatcatcgggctgcgactggaggacacgaacgacgtgtcgttcatggaagggggggcgctgcgggtgagcgaacggacccgggtcaagctgcgggtgtacgggcagaacatcaataacgagacgtggtcccgcatcgccttcaccgagcacgagcggcggcgccacagcccgggggagcgcgggctggggggccccgcgccgccagagccggacagcggcccccagcgatgcggcatccgcacctcagacatcatcatcttgccccacatcattctcaaccgccgcacctcgggcatcatcgagatcgagatcaaaccgctacgcaagatggagaagagcaagtcctattacctgtgcacgtcgctctccacgcccgccctgggcgccggcggctcggggtccacgggtggcgccgtcgggggcaagggtggctcgggggtggccgggctcccgccgcccccgtgggccgagaccacctggatttaccacgacggcgaggacaccaagatgatcgtaggcgaagagaagaagttcctgctgcccttctggctgcaggtgatcttcatttcgctgctgctgtgcctgtcgggcatgttcagcggcctcaacctggggctcatggccctggacccgatggagctgcgcatcgtgcagaactgcggcacggagaaggagaagaattacgccaagcgcatcgagccggtgcgcaggcagggcaactacctgctgtgctcactgctgctgggcaacgtgctggtcaacaccacgctcaccatcctgctcgacgacatcgccggctcgggcctcgtggccgtggtagtctccaccatcggtatcgtcatcttcggagagatcgtgccccaggccatctgctcccggcatggcctggctgtgggggccaacaccatcttcctcaccaagtttttcatgatgatgaccttccccgcttcctacccggtcagcaagctgctggactgcgtcctgggccaggagataggcaccgtctataaccgggaaaaactgctggagatgctccgggtcaccgatccctacaacgacctcgttaaggaggagctgaacatcatccaaggggcgctggagctccgcaccaagacggtggaggacgtgatgaccccactccgggactgcttcatgatcaccggcgaagccatcctggacttcaacaccatgtctgagatcatggagagcggctacacccgcattccagtgtttgaaggggagcgctccaatatcgtggacctgctgtttgtcaaagacttggccttcgtggatcccgatgactgtacccccctgaaaaccatcaccaaattttataaccaccccttgcactttgttttcaatgacaccaagttggacgctatgctggaagaatttaagaaaggtgggaaattttggtctctttca

SEQ ID NO: 38002 - DNA, 2059 bp, Homo sapiens
ctcccgcgagcctcggggttcctcagctggctgaggtggagtcagtgtcagtcagggaggcgaactgctgagcactggccgcggacgctccgttgcagtctcgcccaggggccggtacctgcgctcgcgccgccgggttgaaaggatgaagccgcagctggagcagccaccctatgattggctgtggcgcttgtgaacccaaagtaaagatggcgggcgggcaggcagccgccgcactgcccacttggaagatggcggcgcgccgcagcctcagcgctcgcggccgggggatcctgcaggcggctgcggggcggctgctgccgctgctcctgctgagctgctgctgcggtgcgggcggctgcgcagcggtgggcgagaatgaggagacggtgatcatcgggctgcgactggaggacacgaacgacgtgtcgttcatggaagggggggcgctgcgggtgagcgaacggacccgggtcaagctgcgggtgtacgggcagaacatcaataacgagacgtggtcccgcatcgccttcaccgagcacgagcggcggcgccacagcccgggggagcgcgggctggggggccccgcgccgccagagccggacagcggcccccagcgatgcggcatccgcacctcagacatcatcatcttgccccacatcattctcaaccgccgcacctcgggcatcatcgagatcgagatcaaaccgctacgcaagatggagaagagcaagtcctattacctgtgcacgtcgctctccacgcccgccctgggcgccggcggctcggggtccacgggtggcgccgtcgggggcaagggtggctcgggggtggccgggctcccgccgcccccgtgggccgagaccacctggatttaccacgacggcgaggacaccaagatgatcgtaggcgaagagaagaagttcctgctgcccttctggctgcaggtgatcttcatttcgctgctgctgtgcctgtcgggcatgttcagcggcctcaacctggggctcatggccctggacccgatggagctgcgcatcgtgcagaactgcggcacggagaaggagaagaattacgccaagcgcatcgagccggtgcgcaggcagggcaactacctgctgtgctcactgctgctgggcaacgtgctggtcaacaccacgctcaccatcctgctcgacgacatcgccggctcgggcctcgtggccgtggtagtctccaccatcggtatcgtcatcttcggagagatcgtgccccaggccatctgctcccggcatggcctggctgtgggggccaacaccatcttcctcaccaagtttttcatgatgatgaccttccccgcttcctacccggtcagcaagctgctggactgcgtcctgggccaggagataggcaccgtctataaccgggaaaaactgctggagatgctccgggtcaccgatccctacaacgacctcgttaaggaggagctgaacatcatccaaggggcgctggagctccgcaccaagacggtggaggacgtgatgaccccactccgggactgcttcatgatcaccggcgaagccatcctggacttcaacaccatgtctgagatcatggagagcggctacacccgcattccagtgtttgaaggggagcgctccaatatcgtggacctgctgtttgtcaaagacttggccttcgtggatcccgatgactgtacccccctgaaaaccatcaccaaattttataaccaccccttgcactttgttttcaatgacaccaagttggacgctatgctggaagaatttaagaaaggtaaatctcacctggctatcgtgcagcgggtaaacaatgagggagaaggggatccattttatgaagttctgggaatcgtcaccttagaagatgtgattgaagaaatcatcaaatctgagattcttgatgaaacagatttatacagtaagtagcattgtctgagtgtatttcccgaaacctttgctttttttgttgtgctgtttgtgagtcttctgacgtttctccagttgctgcctctgtttataatgacacatgatgtgtgtag

SEQ ID NO: 38003 - DNA, 636 bp, Homo sapiens
ccatatcacatataacatgtcattcagaaaattcagaaagtcacttcctaaactttttcttgtctctaaaggtaaatctcacctggctatcgtgcagcgggtaaacaatgagggagaaggggatccattttatgaagttctgggaatcgtcaccttagaagatgtgattgaagaaatcatcaaatctgagattcttgatgaaacagatttatacagtaagtagcattgtctgagtgtatttcccgaaacctttgctttttttgttgtgctgtttgtgagtcttctgacgtttctccagttgctgcctctgtttataatgacacatgatgtgtgtaggccgtgcacaacctgttggtatattccagtccttttatcagaaggagcagaccctgtaatgtcaagcgacagcattcttctgaacagccagctgcttctaaccactgatgagggcattacttgccctaaacagaaaactgctgttggttttaaattttattttacatatgtaaaaaaatctctactaaaatttcattttatacaactaggtatattgttttcagataaacttctgtttgtacttttcataactcaagtactctttaaagtgaatgggaggccgggcgtggtggctcacgt

SEQ ID NO: 38004 - DNA, 335 bp, Homo sapiens
ttttttttaatagagatggggtcttactatgttgcctaggctggtctcaagcgatcatctggcctagggttcccaaagtgctgggattacaggtgtgagccactgcacccagaccctgagaacctgctatgctggtatgttctataaaaataaaggcaaagccactaaaaattattagatatagatagatagatagatagtagggcagaaaattacttgctgactcataagaaatctgactttcaggctttatagagctttctggtctgcttacggtagaaccactgctcagttttctgtctttctgtttaggtttactagcaatatctcttgta

SEQ ID NO: 38005 - DNA, 460 bp, Homo sapiens
gtcttcacaagagcctgtaactctctctcccaccccagctagcaggtgaggccaggcagcaaaaacccctccatgggagggggctgcaaactgtgcctgtgggaacagtgcgtatgagactgccctcacttcagagagaggccatgaatttggggttcccagactagattgtaagtcattagagtgacttacagaactcagagaagcacctcatttacagtcacacttttactctaacaaatgcatgaaggctggaactaacccacgaagagacacacagggtgaggtctgggaaggtcccaaatgtgaagcttctgtgtcctcagagtgtgtcaccccacagggcacgtcaccccgcaacacatcagtgtgtgttgccaaccgggaaagcacccctgagtctctgtgtccagagttcgtagtgaggctgcattacagaggcatggctgggggagcactg

SEQ ID NO: 38006 - DNA, 348 bp, Homo sapiens
tctgtgcccttggccaggtgctacttactgacattagttaatcttgctgagtctctattctcttatcagtgggatgtgactaataatagtaattgcctcacagagttgtgaagaatcaataaagtagtgtatgtgaatggctcagtgcagagcctggcgcctgagtacatgctcaggagttattcactattaatgtttttgttgtgtttgtgttctgacatgttttcaagatttataatttagttgtgtttctgtgatatgtaaacaggaagtagaggagggatattataaagaggagcttgggcacagcttcacctaccccaccatgaccccagttcacccacggaa

SEQ ID NO: 38007 - DNA, 730 bp, Homo sapiens
attgtaaaatagggtagtaacagtgagtcctgggggaggacgtgttctgttagccagatccactctccaacctgctgtctgtcctttggagccttaactcaagagactttctttccctctagcttccagttgagtgaaggcactaggaagcaacagcgatggaacaaagaggaaggagtatggttatttattcccccctggctcccttactatggcgccattgcaggctggttgcctccctcaaccaaaggaagcagccagtatccctccctagggtgacccagagtaaacccctatggtttcccttcattttgcacatacctttgcagatagtctttttataaaactctactcacattatccagtaggaatgaacatctcattccttcacagaattgttttgagagttaactgagaaaatactgtattattattattagaatgacctataatttctgtccaaactgagaaacttttgaggctgggaaaagggggtttgtgctgatagtaatgatgtcaggacaataggaaaaacaaggacttatggccaccccagctattattgccagtaaactctgctttagacatattaagcaatcaagaagtggtcgtactatcacgcttctgtcactagactgtgaatgtctcaaggtaagagtgcttttttgtctattagcttctgtcacatggtctggtatattcaataaattttgagttggagatgagggta

SEQ ID NO: 38008 - DNA, 1017 bp, Homo sapiens
gacagggtctctctctgtcacccaggctggagtgcagtgacgcaatctcagctcactgtaacctctacccccagcttcaggcaattctcctacctcagcctcccaagaagctgggattacaggcacatgccaccacacctggctaatttttatatttttagtagtagagacaaagtcttaatatgttgcccaggctagtcttgaactccctggcttgaacaataaatcatatggtcatcctacctcatagagttactaagataaagtaagctaatacacacaaagcatttttaagagtatctggcatatggtaagagttcagttagtattagttcttgttcatgttagtcactgtcagtgactttttatagattttgaactgtataatgaacagtgcgtcccacaatattccttcttataaataaaatgatgcatttaatgtcccacattaaattctttcaaacaactaagcagcactaactgcttgaaatcaacactaaccaatttatcccacagcaatagcagtatcaacagcattcacattgtatcacgaattttaatagaggccatattagagttactaacaggaaagtgacagtgaaaagtaaaactttatttagtgccaaaccaagtcccttaatattctagcagcctttctcaaccagtgttcctcatgttaactacagaactcagaaaatgacttgactacagaactcagaaaatgacttcagtgactattcctgaagtctcccaagaatgatacctaactaatatctttctagatgtgcaggggagaaactaatttataatatacaatggatgcctcggggaataattctgtcatggaacaccagttcttggttttcttggaatacaaagggggaaatatggatgaaaagactcctcaatgaacaaagagtctgagtataagactgctgttcatcacctgggaaaaaagtatttcctacatgttaaagcttaaaggaatgatcaatataaacatataaatttgactca

SEQ ID NO: 38009 - DNA, 791 bp, Homo sapiens
gacagggtctctctctgtcacccaggctggagtgcagtgacgcaatctcagctcactgtaacctctacccccagcttcaggcaattctcctacctcagcctcccaagaagctgggattacaggcacatgccaccacacctggctaatttttatatttttagtagtagagacaaagtcttaatatgttgcccaggctagtcttgaactccctggcttgaacaataaatcatatggtcatcctacctcatagagttactaagataaagtaagctaatacacacaaagcatttttaagagtatctggcatatggtaagagttcagttagtattagttcttgttcatgttagtcactgtcagtgactttttatagattttgaactgtataatgaacagtgcgtcccacaatattccttcttataaataaaatgatgcatttaatgtcccacattaaattctttcaaacaactaagcagcactaactgcttgaaatcaacactaaccaatttatcccacagcaatagcagtatcaacagcattcacattgtatcacgaattttaatagaggccatattagagttactaacaggaaagtgacagtgaaaagcaactttcctgagggccacctaagttaaaacaaaactctaagataacgacatctgagtttgtctcccgtatgtattattcaggttccctttaccattttcttaggcagaaatgtggatcgtagaaatttttactgagaagacagtagaaagaagatgaatacttatgtgactagggagaagtgtta

SEQ ID NO: 38010 - DNA, 312 bp, Homo sapiens
gaggcatggttggtcatgcatctgtagttccagctacttgggagactgaggcaggaggattacttgagcccaggaagtcaagattgcagtcagccatgattgcaccactgcactccagcctgggcaatagagtgagaccctgttaatgaaaaaaaaaaaaaaaaaaaaaaaaaaaaaaaaggagttctggagatatgtgctagtgatgactcacgctaatgtgaatgtacttaatgccacagaaccgtacacttaaaaatggttagtgttctgtgtattgtactatataaataaacacaaaatggtgaatca

SEQ ID NO: 38011 - DNA, 286 bp, Homo sapiens
tcagaattgctaataattagcaaaatggaccaatgtaagttccatttccataaataaaagtatgattagggcaacagcttcttattaagggcagaagaaaagagctcctgcttgccatgtgtcaccctctgctcggagttccatattctcacctgacttggtttttcatggcagcatgcagtgctagtaagtagatgatttcatagacgagatgagctgagctggcacaggcacataacgtgcccagacattttgaagctgggattgggatcctggcctgactgca

SEQ ID NO: 38012 - DNA, 571 bp, Homo sapiens
actccttgtgatttttaggtctgcttctccaaagcatggattcaccattatgaataggctgagcatggaaaataggacagaacctattactaaagacttggatttccaactccaggaccctttccttctctacagaaatgccagattgtccatctatggaatttggttttatgataaggaagaatgccaaagaattgcagagcttatgaaaaacctaactcagtatgaacagttgaaagcccatacagagcccggagccctccgtgatcaccagcagcccactcaccaagctccagctccaggaggcactgctgtacctcattcagaatgatgacaacttcttaaatataatctatgaagcctatctcttcagcatgactcaagcagccatgaaaaagactatgtgacagcaaggccttttaaaactgattttcaaggtccttctagaactccggcacaaggttctttcatgttgagtgttgtttccttcaatgtttctgccttttttaaaaaaaaagtatgtgtaatatgaagtaaaatgtttcagacttttttttataaaaaaaaaaat

SEQ ID NO: 38013 - DNA, 695 bp, Homo sapiens
catattttattttatgtttccgtattttataatgattttcatttattttaccatgtttaataatcacaattttgtggagtagacattttcattgccattttgcagatgaggaaactgagactccagtgaggaggcagactgtgtaaaaacccacagattctgatttcacttccgttgctttttccacaccacctgtactgctctactattaaacatggatgcaaattaaaggtagcctttgggatgcatattaaaatgtttctaatgaatttccatacaaaagaaatagaatcagttgaacaacaaagagtgaaagggaatggatctatttacttttctggattcattttgcctttttttttttttttttgtcctttctatctgatactgattgcctttgcacccagagtcatttggttttatgttgtttgcaaaagccttttcaatcccgggcatcaaaggtacacagaagggtttaccacaggtgctgtcagagtctcagatacctcttaaacgttttaatagaattcaaatatgttatataataattatgtatggtttacatgttctttggtggcatatagattggttggcctttctttgggcaaggaactcagctttactcaggattgtttttgtaagactatttcctcaagatattctgtatagtcaagaatctctctgtctggtctttg

SEQ ID NO: 38014 - DNA, 2101 bp, Homo sapiens
tgcgaggcagctcgctcgttctgcgatctattgagagtggcttccaagagccccgtgcctatgtctgggagggagggaagatggcagccgtggcggcaggcggcctggtgggaaaggggcgcgacatcagcctagcggccctgcagcgccacgacccctatatcaaccgcatcgtggacgtggccagccaggtggctctgtacaccttcggccatcgggccaacgagtgggagaaaactgatgtggaaggaaccttatttgtttatacaaggtctgcttctccaaagcatggattcaccattatgaataggctgagcatggaaaataggacagaacctattactaaagacttggatttccaactccaggaccctttccttctctacagaaatgccagattgtccatctatggaatttggttttatgataaggaagaatgccaaagaattgcagagcttatgaaaaacctaactcagtatgaacagttgaaagcccatcagggaactggagcaggaatttccccagtgatcctcaattcaggagagggcaaagaagtagacattttacgaatgctcatcaaggccaaagacgaatacacaaagtgtaaaacctgttctgagccaaaaaagataaccagttcctctgccatctatgacaatccaaatctcatcaaaccaattccagtgaaacccagtgaaaaccagcaacagcgtatacctcagcccaaccagaccttagaccctgaaccccaacacttatccttgacagctctgtttgggaagcaggacaaagctacatgtcaggaaactgtggagcctccgcagactctccaccagcagcagcagcagcagcagcagcagcagcaagagaagcttccaattaggcagggggttgtacgctccctgtcctatgaggaacccagaagacactcaccccccattgagaagcagctctgtccagccattcagaaactcatggtcaggagcgcagacctccacccattgtcagagctgcctgaaaaccggccttgtgaaaatggcagtacccattctgcgggagaattttttacaggacctgtccagccagggtctcctcacaacattggaacttctcgtggtgtacaaaatgcttccagaactcagaacctgttcgagaaacttcagagtaccccaggggcagcaaacaagtgtgaccctagtacaccagcacctgccagctcagctgccctgaaccgcagcagagctcccacttctgtcacccctgtggctccaggaaagggtctggctcagccaccacaggcctatttcaatggctcccttccacctcagacagtaggacatcaggctcatggaagagaacagtccacactcccaagacaaacactccccatctctggtagtcagactggcagctctggagtgatctcccctcaagagttactgaagaagcttcagattgtacagcaggagcagcagctgcatgcctctaaccggccagccttggccgctaagtttcctgtgctcgctcagagctctggaacagggaaacccttggaatcctggatcaacaagacacccaacacagaacagcagactcctcttttccaggtcatctcacctcagcgcatccctgctacagcagctccgtctctgcttatgtcccccatggtgttcgcacaacccacctccgtcccgccaaaggaaagggagagcggcctcttgcctgtgggaggccaggagccacctgctgctgccaccagcctcctcctgcccatacagagcccggagccctccgtgatcaccagcagcccactcaccaagctccagctccaggaggcactgctgtacctcattcagaatgatgacaacttcttaaatataatctatgaagcctatctcttcagcatgactcaagcagccatgaaaaagactatgtgacagcaaggccttttaaaactgattttcaaggtccttctagaactccggcacaaggttctttcatgttgagtgttgtttccttcaatgtttctgccttttttaaaaaaaaagtatgtgtaatatgaagtaaaatgtttcagacttttttttataaaaaaaaaaat

SEQ ID NO: 38015 - DNA, 1697 bp, Homo sapiens
agagcatcctttagaatgcactgtgtgaggagttggcaaactcttctcaaagggaccagagacctaactcagtatgaacagttgaaagcccatcagggaactggagcaggaatttccccagtgatcctcaattcaggagagggcaaagaagtagacattttacgaatgctcatcaaggccaaagacgaatacacaaagtgtaaaacctgttctgagccaaaaaagataaccagttcctctgccatctatgacaatccaaatctcatcaaaccaattccagtgaaacccagtgaaaaccagcaacagcgtatacctcagcccaaccagaccttagaccctgaaccccaacacttatccttgacagctctgtttgggaagcaggacaaagctacatgtcaggaaactgtggagcctccgcagactctccaccagcagcagcagcagcagcagcagcagcagcaagagaagcttccaattaggcagggggttgtacgctccctgtcctatgaggaacccagaagacactcaccccccattgagaagcagctctgtccagccattcagaaactcatggtcaggagcgcagacctccacccattgtcagagctgcctgaaaaccggccttgtgaaaatggcagtacccattctgcgggagaattttttacaggacctgtccagccagggtctcctcacaacattggaacttctcgtggtgtacaaaatgcttccagaactcagaacctgttcgagaaacttcagagtaccccaggggcagcaaacaagtgtgaccctagtacaccagcacctgccagctcagctgccctgaaccgcagcagagctcccacttctgtcacccctgtggctccaggaaagggtctggctcagccaccacaggcctatttcaatggctcccttccacctcagacagtaggacatcaggctcatggaagagaacagtccacactcccaagacaaacactccccatctctggtagtcagactggcagctctggagtgatctcccctcaagagttactgaagaagcttcagattgtacagcaggagcagcagctgcatgcctctaaccggccagccttggccgctaagtttcctgtgctcgctcagagctctggaacagggaaacccttggaatcctggatcaacaagacacccaacacagaacagcagactcctcttttccaggtcatctcacctcagcgcatccctgctacagcagctccgtctctgcttatgtcccccatggtgttcgcacaacccacctccgtcccgccaaaggaaagggagagcggcctcttgcctgtgggaggccaggagccacctgctgctgccaccagcctcctcctgcccatacagagcccggagccctccgtgatcaccagcagcccactcaccaagctccagctccaggaggcactgctgtacctcattcagaatgatgacaacttcttaaatataatctatgaagcctatctcttcagcatgactcaagcagccatgaaaaagactatgtgacagcaaggccttttaaaactgattttcaaggtccttctagaactccggcacaaggttctttcatgttgagtgttgtttccttcaatgtttctgccttttttaaaaaaaaagtatgtgtaatatgaagtaaaatgtttcagacttttttttataaaaaaaaaaat

SEQ ID NO: 38016 - DNA, 1933 bp, Homo sapiens
catattttattttatgtttccgtattttataatgattttcatttattttaccatgtttaataatcacaattttgtggagtagacattttcattgccattttgcagatgaggaaactgagactccagtgaggaggcagactgtgtaaaaacccacagattctgatttcacttccgttgctttttccacaccacctgtactgctctactattaaacatggatgcaaattaaagtgtccatctatggaatttggttttatgataaggaagaatgccaaagaattgcagagcttatgaaaaacctaactcagtatgaacagttgaaagcccatcagggaactggagcaggaatttccccagtgatcctcaattcaggagagggcaaagaagtagacattttacgaatgctcatcaaggccaaagacgaatacacaaagtgtaaaacctgttctgagccaaaaaagataaccagttcctctgccatctatgacaatccaaatctcatcaaaccaattccagtgaaacccagtgaaaaccagcaacagcgtatacctcagcccaaccagaccttagaccctgaaccccaacacttatccttgacagctctgtttgggaagcaggacaaagctacatgtcaggaaactgtggagcctccgcagactctccaccagcagcagcagcagcagcagcagcagcagcaagagaagcttccaattaggcagggggttgtacgctccctgtcctatgaggaacccagaagacactcaccccccattgagaagcagctctgtccagccattcagaaactcatggtcaggagcgcagacctccacccattgtcagagctgcctgaaaaccggccttgtgaaaatggcagtacccattctgcgggagaattttttacaggacctgtccagccagggtctcctcacaacattggaacttctcgtggtgtacaaaatgcttccagaactcagaacctgttcgagaaacttcagagtaccccaggggcagcaaacaagtgtgaccctagtacaccagcacctgccagctcagctgccctgaaccgcagcagagctcccacttctgtcacccctgtggctccaggaaagggtctggctcagccaccacaggcctatttcaatggctcccttccacctcagacagtaggacatcaggctcatggaagagaacagtccacactcccaagacaaacactccccatctctggtagtcagactggcagctctggagtgatctcccctcaagagttactgaagaagcttcagattgtacagcaggagcagcagctgcatgcctctaaccggccagccttggccgctaagtttcctgtgctcgctcagagctctggaacagggaaacccttggaatcctggatcaacaagacacccaacacagaacagcagactcctcttttccaggtcatctcacctcagcgcatccctgctacagcagctccgtctctgcttatgtcccccatggtgttcgcacaacccacctccgtcccgccaaaggaaagggagagcggcctcttgcctgtgggaggccaggagccacctgctgctgccaccagcctcctcctgcccatacagagcccggagccctccgtgatcaccagcagcccactcaccaagctccagctccaggaggcactgctgtacctcattcagaatgatgacaacttcttaaatataatctatgaagcctatctcttcagcatgactcaagcagccatgaaaaagactatgtgacagcaaggccttttaaaactgattttcaaggtccttctagaactccggcacaaggttctttcatgttgagtgttgtttccttcaatgtttctgccttttttaaaaaaaaagtatgtgtaatatgaagtaaaatgtttcagacttttttttataaaaaaaaaaat

SEQ ID NO: 38017 - DNA, 2027 bp, Homo sapiens
tgcgaggcagctcgctcgttctgcgatctattgagagtggcttccaagagccccgtgcctatgtctgggagggagggaagatggcagccgtggcggcaggcggcctggtgggaaaggggcgcgacatcagcctagcggccctgcagcgccacgacccctatatcaaccgcatcgtggacgtggccagccaggtggctctgtacaccttcggccatcgggccaacgagtgggagaaaactgatgtggaaggaaccttatttgtttatacaaggtctgcttctccaaagcatggattcaccattatgaataggctgagcatggaaaataggacagaacctattactaaagacttggatttccaactccaggaccctttccttctctacagaaatgccagattgtccatctatggaatttggttttatgataaggaagaatgccaaagaattgcagagcttatgaaaaacctaactcagtatgaacagttgaaagcccatcagggaactggagcaggaatttccccagtgatcctcaattcaggagagggcaaagaagtagacattttacgaatgctcatcaaggccaaagacgaatacacaaagtgtaaaacctgttctgagccaaaaaagataaccagttcctctgccatctatgacaatccaaatctcatcaaaccaattccagtgaaacccagtgaaaaccagcaacagcgtatacctcagcccaaccagaccttagaccctgaaccccaacacttatccttgacagctctgtttgggaagcaggacaaagctacatgtcaggaaactgtggagcctccgcagactctccaccagcagcagcagcagcagcagcagcagcagcaagagaagcttccaattaggcagggggttgtacgctccctgtcctatgaggaacccagaagacactcaccccccattgagaagcagctctgtccagccattcagaaactcatggtcaggagcgcagacctccacccattgtcagagctgcctgaaaaccggccttgtgaaaatggcagtacccattctgcgggagaattttttacaggacctgtccagccagggtctcctcacaacattggaacttctcgtggtgtacaaaatgcttccagaactcagaacctgttcgagaaacttcagagtaccccaggggcagcaaacaagtgtgaccctagtacaccagcacctgccagctcagctgccctgaaccgcagcagagctcccacttctgtcacccctgtggctccaggaaagggtctggctcagccaccacaggcctatttcaatggctcccttccacctcagacagtaggacatcaggctcatggaagagaacagtccacactcccaagacaaacactccccatctctggtagtcagactggcagctctggagtgatctcccctcaagagttactgaagaagcttcagattgtacagcaggagcagcagctgcatgcctctaaccggccagccttggccgctaagtttcctgtgctcgctcagagctctggaacagggaaacccttggaatcctggatcaacaagacacccaacacagaacagcagactcctcttttccaggtcatctcacctcagcgcatccctgctacagcagctccgtctctgcttatgtcccccatggtgttcgcacaacccacctccgtcccgccaaaggaaagggagagcggcctcttgcctgtgggaggccaggagccacctgctgctgccaccagcctcctcctgcccatacagagcccggagccctccgtgatcaccagcagcccactcaccaagctccagctccaggaggcactgctgtacctcattcagtatgtgacagcaaggccttttaaaactgattttcaaggtccttctagaactccggcacaaggttctttcatgttgagtgttgtttccttcaatgtttctgccttttttaaaaaaaaagtatgtgtaatatgaagtaaaatgtttcagacttttttttataaaaaaaaaaat

SEQ ID NO: 38018 - DNA, 1710 bp, Homo sapiens
tgcgaggcagctcgctcgttctgcgatctattgagagtggcttccaagagccccgtgcctatgtctgggagggagggaagatggcagccgtggcggcaggcggcctggtgggaaaggggcgcgacatcagcctagcggccctgcagcgccacgacccctatatcaaccgcatcgtggacgtggccagccaggtggctctgtacaccttcggccatcgggccaacgagtgggagaaaactgatgtggaaggaaccttatttgtttatacaaggtctgcttctccaaagcatggattcaccattatgaataggctgagcatggaaaataggacagaacctattactaaagacttggatttccaactccaggaccctttccttctctacagaaatgccagattgtccatctatggaatttggttttatgataaggaagaatgccaaagaattgcagagcttatgaaaaacctaactcagtatgaacagttgaaagcccatcagggaactggagcaggaatttccccagtgatcctcaattcaggagagggcaaagaagtagacattttacgaatgctcatcaaggccaaagacgaatacacaaagtgtaaaacctgttctgagccaaaaaagataaccagttcctctgccatctatgacaatccaaatctcatcaaaccaattccagtgaaacccagtgaaaaccagcaacagcgtatacctcagcccaaccagaccttagaccctgaaccccaacacttatccttgacagctctgtttgggaagcaggacaaagctacatgtcaggaaactgtggagcctccgcagactctccaccagcagcagcagcagcagcagcagcagcagcaagagaagcttccaattaggcagggggttgtacgctccctgtcctatgaggaacccagaagacactcaccccccattgagaagcagctctgtccagccattcagaaactcatggtcaggagcgcagacctccacccattgtcagagctgcctgaaaaccggccttgtgaaaatggcagtacccattctgcgggagaattttttacaggacctgtccagccagggtctcctcacaacattggaacttctcgtggtgtacaaaatgcttccagaactcagaacctgttcgagaaacttcagagtaccccaggggcagcaaacaagtgtgaccctagtacaccagcacctgccagctcagctgccctgaaccgcagcagagctcccacttctgtcacccctgtggctccaggaaagggtctggctcagccaccacaggcctatttcaatggctcccttccacctcagacagtaggacatcaggctcatggaagagaacagtccacactcccaagacaaacactccccatctctggtagtcagactggcagctctggagtgatctcccctcaagagttactgaagaagcttcagattgtacagcaaatgatgacaacttcttaaatataatctatgaagcctatctcttcagcatgactcaagcagccatgaaaaagactatgtgacagcaaggccttttaaaactgattttcaaggtccttctagaactccggcacaaggttctttcatgttgagtgttgtttccttcaatgtttctgccttttttaaaaaaaaagtatgtgtaatatgaagtaaaatgtttcagacttttttttataaaaaaaaaaat

SEQ ID NO: 38019 - DNA, 394 bp, Homo sapiens
aaagggtctggctcagccaccacaggcctatttcaatggctcccttccacctcagacagtaggacatcaggctcatggaagagaacagtccacactcccaagacaaacactccccatctctggtagtcagactggcagctctggagtgatctcccctcaagagttactgaagaagcttcagattgtacagcaggagcagcagctgcatgcctctaaccggccagccttggccgctaagtttcctgtgctcgctcagagctctggaacagggaaacccttggaatcctggatcaacaagacacccaacacagaacagcagactcctcttttccaggtaaatatgtaccaggggcaaaataaaacagcctgggcagcatagcaagatcctgtccct

SEQ ID NO: 38020 - DNA, 457 bp, Homo sapiens
cccacctcctggaagagggctggcggcatcttggactaaaggtcacgttggcttcctgggaatgctggcacacctgtgggctgccaaggccactcccaaggggctgtgagttttgactgtgctggcacacacacccctcacgtgcacacagtgggtgccccagaaaacatgacagtggcactcctgtcactacccagaccccagggcagggtgcacaaagccttgatttagagatgccacctggaaagccacagccccaatccattcctgtcaatccaaacctattggaaataagacatgggactcagcacttagcagcatcctcatcagaccttctggtaaatggaaggatttttctttaacacatgggttttctgatgtcattttgcttacagtggactgatcagggccactgaaggatgagagagagaatacatggcaggaacaacgatttcaa

SEQ ID NO: 38021 - DNA, 201 bp, Homo sapiens
ttagtacaggcctccttcagaacactggctcttccttggttcaaatttaaggacatggattataaaataatggctgaaaacttatctacttcaacctgttgatagatatatcaaatacttaggaagctcttgaatttaaaataagaaatcataatattttaaaatgctatccaaactgatagggacctatttgatctcctt

SEQ ID NO: 38022 - DNA, 447 bp, Homo sapiens
ggaaaattcttagcgttctataccccagcatcttaccttagggttaaatctaggtctaaccaggctgtgcaggttgactaagaaggaataatgaaacgacagagtttcatggagaaaccatggagatgtctgaatagctgataagcagttaacacactgacccaagcttggagggaaaccatttccccctccatcctgtgagatctctttcttgctccagtgcaacagttggccacagcatggcaggccttcctgtagggtgcctgacaattccctagatgcctctttaaaatcagaagctgcgcactgccccacccagtcacagccaaagggaaaacataaataaaaggctgtagtctcaggcttgtggttatggaaagagcctggaattgacaggagaggaagcactgccaaagtgaggatcttatttatccttcttgctttccc

SEQ ID NO: 38023 - DNA, 316 bp, Homo sapiens
gtcaagattgtgccactgcactccagcctgggtgacagagcaagactccgtctcaaaaaaaaaaaaaaaaattaaattgacagtaaggtttaatgaaatcttaaaggtctttgcatctttgggattattcacttaaatactatagaaggttattgtagttatctttagtactatgttattttaggaggcctgtgtttaaattttacaattcattaacaggactgatggcattttgtaggaactacttaggaacaagtttgcatttctgaaagtaaggaaaagctgtcacttaatactattatccccctcccccctg

SEQ ID NO: 38024 - DNA, 308 bp, Homo sapiens
tggtagagatgaggttttgccatgttgcccaggctggtctcaaactgctgggctcaggcaattcttccatttcagcttccttcttgatacttatgctctgtggcaaatattttctcccaatctggcacttgtcttttacccttgttttcaatgttctttgctgagcatattttattagacacagtttattttacttatctttaccttttgtgttagttatcttgtttaagaaacacatccatggccgggtgcggtggctcatgcctgtaatcccagcactttgggaggccgaggtgggcagattgcct

SEQ ID NO: 38025 - DNA, 1371 bp, Homo sapiens
gagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaatttaatagtaactccaattcagtaaatggtatcactgtttaccccttttaaagatatgattagactcgtacgaagtgcactctcccaacgatgggggcctcttaaattacgggcacggccacatagcagataccggctcgcgaacttctcaaacgcgcaacggcacgttcccaaacacgaaagaactcggcagggcacgactacgtcccaagagggcgaacaacagtatcatcacggcgacgaatcaaatcgcacagagatcccacagcgcgtcgacaaacacacctactgtctatttctttctgctcaccttcatcttcacgcgcgatcgcaacagcacaacagaactaatcggcgacacaacacacaacataccacacagcgcacggaagagacgcgagagaagaagaagaacagccgcgcaggcgagagcggcgaggagagcgaggaaacacacagagcgaaagaacgagaacgagagcggaccaggaacagaggacgagcgaacaggaagcaagccagaagaggagcaagggagaggaaaacgcgaacgggacgagaaataaagacagagagcggcgacgatagagagagcgagcgcgacagcgagaaggccgaagaaaggtagcgagaagcagaggacagccggagcgacgagaacccgaggagggagcgaacacgagcgacgaagaggcagacaggacgccacacgagacgagaagcaagagaggcaagacacaacgccgccaccaggcggacagcaagacacagcaggaggagaaaaagcgacaaaacga

SEQ ID NO: 38026 - DNA, 727 bp, Homo sapiens
gatttatagagctgttcggatttgcggctccggaccggtagtgtacttagtgtcatcagtatatgtagcacgaatgagatctgggtgatgtcgagagctggaatactatatcaataatagaacgtcgtgcccagtgccagagcgttcgtagaaagggaatcgccagagtgcaatactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaaaactaagactggcttgtggttaaatgaatatgttcagtttttgaatttaatagtaactccaattcagtaaatggtatcactgtttaccccttttaaagatatgattagacttcgttagtaatgttcaacttttcacaaagatggtgagtgccatcttaaaacttactggagattggtt

SEQ ID NO: 38027 - DNA, 654 bp, Homo sapiens
gagagagtggggacgtccggcttcggagcgggagtgttcgttgtgccagcgactaaaaagagaattaaatatgggtgatgttgagaaaggcaagaagatttttattatgaagtgttcccagtgccacaccgttgaaaagggaggcaagcacaagactgggccaaatctccatggtctctttgggcggaagacaggtcaggcccctggatactcttacacagccgccaataagaacaaaggcatcatctggggagaggatacactgatggagtatttggagaatcccaagaagtacatccctggaacaaaaatgatctttgtcggcattaagaagaaggaagaaagggcagacttaatagcttatctcaaaaaagctactaatgagtaataattggccactgccttatttattacaaaacagaaatgtctcatgacttttttatgtgtaccatcctttaatagatctcatacaccagaattcagatcatgaatgactgacagaatattttgttgggcagtcctgatttaataactccaattcagtaaatggtatcactgtttaccccttttaaagatatgattagacttcgttagtaatgttcaacttttcacaaagatggtgagtgccatcttaaaacttactggagattggtt

SEQ ID NO: 38028 - DNA, 368 bp, Homo sapiens
tctcaaacttttgacctcaggtgatccacccacctcggcctcccaaagtgctgggattacagtggctcatgccataatcccaactctttgggaggctgaggcagcaggattgcttgaaatcaagagttcaagaccaagcctgggcaacatagtgagaaccccgtctctacaaaaaaatatttttaaaattagctgggcatggtaactgacacatacctgtagtctgacctacttgggaggccgagccaggaggatcatttgagcccggaagctccacgttacagtgaactgtgatcataccactgtagcctaggtggcagagcaagaccctgtctctaaaaataataataaataataataaaagtgaa

SEQ ID NO: 38029 - DNA, 551 bp, Homo sapiens
gaaatgacaggtctggggttcctacctgctccccttactgctgaagtgctgtactgtgtgtctggagtgaaggttttgttttgctctgaatcttaggattggatgagacccatctaatttactgtttagaggaaggagctgcgcatcacccactaactaggagtcagtgggaacccctactcaagactcctgcctcttaatcctgtgtttcactccattactccaggcttcaggaatgaacagtctacctcagcttaatacattccagagctcaaatgcaaactaactttcagtgttatgactttcattcctgaagggaaaatgtaggagctgggtagtaatacactggaacttaaaaatgggcttagtaaggagttaagccagcatctcactgttgttattttgtactttagttaactagttgtgagtttctgtgaggtacaaatagatttatcttcatattagagaacatggttaatgacattttaccacttttaaactggagaggtgagagatttggctcagaattacaaataagatgcaaaaaaaaa

SEQ ID NO: 38030 - DNA, 345 bp, Homo sapiens
tttctttttctctcattttagcataaatttgttcacagtattttcctttatcctttaaatatctgtagtaataaattttgttttctgtatttcttggtcaatctagctaaaggtatatcagtattattaaccttttcaaaatatcaactcttggtattttctaagaacaaggatattctcctacaggtaatcataatggcattatctcacccaagaaatttaaaactgatatgataatcttgtccaatcttcagtccatattcacatttccctaattgtccacaaatgtccttcaaagttgtctttattcagttgagaatccaagcaaagaccatgcattgttgc

SEQ ID NO: 38031 - DNA, 918 bp, Homo sapiens
ttagtgtggctgtcagagggagcagagctaaatatgtgacttcagtgtttagtttttcaaagtaaagtggaatgttctttgcagaactgagaatttagacttttcagtttttccccatagtttgcatttgcctatctatatatagatagaagtatgtatatgtatatctttatgtatacatatctatatatacatatatgtgtagctatatgtctaagacatagatatatagatatacatacatttacatatgtatatgtacatagatatatatatctaagtcctatcttggctttctctaagtcctatcttgactataaatatatatttataaatatatatttaacatgtatatctgtatctatatacatttctaagtcctgtcttgactttcctattttttcaattgttttggcatcacttatttaagcttcagcttctaggtacctcagttttctcttgagctggaaggcactaataaagcttctccagtatttacccagaagagagattcagtgtcattcagtcatttgggcaaccactttgtaaaactaccattgtgtatatgacatatttctccactgtgagaagaaaacacaaaagaagtagagcttagcgtgaagaatgtatagtttcttaggcaaagtagcgttttactctcttttaacaagaaagttctttaagttttttaggggaaagtaacattgtaaattgttgatttttgttacttcatttgttgacttggtagtgctattctttgacctcttttttatctcatgtttattcataacgttttctctttatcatgcaccttcatgaaataggaaatcactttcaaaaagaaaaaaagcactcacttttgtaacttctcactaagcttttgaatcccatggtcagattcaggtgaaaaaagagaaa

SEQ ID NO: 38032 - DNA, 173 bp, Homo sapiens
actgtccgcttgctgggaagctcaacgttcatctccccacttagcaaatgcatcccgattacgtgtccacaggcctgctgagacaggaggagcaaacaggtgacctgggccctcagcaactgacggtgtagtggcacgtcccaagaaatccctgcacatccctgggaggggca

SEQ ID NO: 38033 - DNA, 481 bp, Homo sapiens
agagagaatgagggaataacatctaacattctattttgtgccatgcactcatttaaatattttatggccatttaagtgcatttaagctttgtgttgacctctaagttaaggaattattgtgagccctactttgcagatgaaaaagcagaggtcgacgaggttaagtaaaatgttcaagactacacaactaggactccgggggaactagaattgaacccgggcagcctgactgctacagtgtccccagaaagccaaggaaagagtgaaacaggccgagagaggagattcaggctgtgactcttgagagaagcagacatccacggtccgtcttgcccgggtccccctcgaagtcaaaatcagccatgtgagcagtctttcccgactcagagaccccaaatcctcaccacacattagcaggatattgatcattcactgaacacattggggcaagacagggatccacgcataatggaaataattt

SEQ ID NO: 38034 - DNA, 416 bp, Homo sapiens
gtgcaagtcgttggattttaggaaattcacggatgagtgagcccatcaccactgtgaatctcaggaagcttccatccccccaagaggaaaccccacccctgttggcagtcacttcccctttccccctctcccctccccagatgcctgctctggccatcgtcagtgatggggtggcaccgcacgtggactgagagggaagccttgtctcagttctttgcctctcctgctggagatgagcccctcccctcccacctgtgctgtgtccagtgcccactccgggcctcctgccacggaggagctttctgcactgtcaagtcacccagtccaccgagaaaggtaaaagctcttttatccacgaatgtagccgggtgcagtggtgcacaactgtaatcccagctactcagaaggctcaggca

SEQ ID NO: 38035 - DNA, 373 bp, Homo sapiens
aggaggctgcagttcctagaagccccccttaagcccacccttcggtttatttgatgggtaaaggtagtttgatacttgagctttttttggagtgaagcttatgtctgaggaaaccaccagagagaagagaaaatcctgcacaggaactcttggaaagggattgcaccataacggctagcgctgtggcatttaatctcctctgattgccctctcactgtgcatgcatcagtcaatattttagcagctccgcaaataaatggacttgaatgccatcttctacataaagcagaggttgaagggctcccctgaacctcctggctgcctgtcagtggtgtaggttttcggtgcacttactccagtcctgatcactcat

SEQ ID NO: 38036 - DNA, 441 bp, Homo sapiens
tgctcttctccttccagataaataacgctgacccaccaccctccatgcagcccctcttggaagaagagtcataaaaatatggcaggcaaaagcatctgtaaaaggatgacaggatgacataatgccaggaaaatttacaatcgatttagcagacagaggtggctgtcagtctgggggctctccagagttcaagcatgcccataaaagaactcaacaacccaaagactctactgcgaggaagagatctccctgcaaatccacctgtcactggtgagcagaaattccctgagggagcgggaactggtgtatctgtgtctggaacagccaaggatggaaagaggaagacccctggagtggacaaaggggacttctccagtgatttagggctctggatctccccccagcaaaagtccttctggtgccctaggggtcttgaaaaag

SEQ ID NO: 38037 - DNA, 385 bp, Homo sapiens
aatggcagagagggaggggagaagggagagttaccccgctatggagggcagccccaagcctccaccccagggagagagctggaggttccctgtcccagagatgacaggaaccaaactagagctgcctctgttcctaacagtgcagaggcctccctcctctgcagaaagtgttcccttggggcccaaagcaaggggcctgggaggtggcatagaggcagggaatcagcatgggtgtccaagagaggaaagagcggaggctgcggagtcccagacctgctgctcactagccgtgtgactgggagagttactttactcccctaagcctgttttcttgcttaaaattttcaggtaagtctgcttcacaggagtggcatgatgcaatgag

SEQ ID NO: 38038 - DNA, 383 bp, Homo sapiens
ttttttttgagacaggctagagtacagtggtgtgatcatagttgacagcagcctcagcctcctggactcaaggattctcctgcctcagcctcccgattagctgggactacaggtgcacactaccacgcccagctaatttttttgtacgttttgaagagaaagggtttcaccatgttgcttaggctggtcttgaactcctggactcaagcgatcctcccaccttgggctcccaaagtgctgggattacaggtgtgagccaccatacccaggcaaatttcttaagtaccataagtttacttctaagatcttacaagttactataaatagatctatatctattattatttactcctgcgtatgtacttgcactgactctgactcca

SEQ ID NO: 38039 - DNA, 839 bp, Homo sapiens
aatattccaataacatttacatagggcaaataaaatacttgaaagaattctgaaacaattgtacctggggtggatggcctctcagggtttcttctggctttatgacttcatagtttaaagaactttttttttaagtagttacatcagatgcaggtactccattagttagggctgcactctgaaaattcaaattattattatgagctcttaaatactatttaactctggaagagatatgccagaataaagccaaaagaccatcacccctataatggagaaattgatctgcctattcttttcaaagcctatcttactaatgtttggatcttttaaaatcatcttatcatcagtataattcttgagtatgttaggtccttctttaaggataaaattgcacaagcacaggacaccatgatttgtgtgtgtatatatatatatatatatcctagtgtgttcagctttaagctttgcaatcccttaggacactgatgtgggatgaatggattcgctaggcccacacagtaactcacctgtagacctgctgaacctcagcatgtatgacagttcacacaggttaatactgaatgtaaacgaaaaactagaagacaattgttataattttttttggctgtaatttatgcaattgctttttgtgatttttagaaaatggggcacccgtgttattactgtaaaatgttcttaaccaaaatttggtgaatttcactagtctacctcacattttgttaatgattcaaaattgtcttgtgtctactgttatatttttgtcctttgatttaatttgcttaatgtattaaagttatctcccaccccctccaaaa

SEQ ID NO: 38040 - DNA, 230 bp, Homo sapiens
cttattagcatactgatatgtttcagtacacatttcatggatttatggctaaggatgttactttcaagaaggtaactatacatcgctctctactagcatgctgttctgttcctgagaaatagtggctgggcgaagggtatgcaaacatttcttaatatctcatccaataccattttcccactactaattattcaacacatggaaatgtaggtcaaagcattaaaaaaaaa

SEQ ID NO: 38041 - DNA, 173 bp, Homo sapiens
ttcttttctgtgttcccattgcagtccaatttcttgttcctgactttctagtaccaaccgcaatgtaaaactatttgtgctccactgcaagccgagcaccatagattttatgggactgacatactttttttttatttaaaattcttgctttgtggggtgactgctttttgacc

SEQ ID NO: 38042 - DNA, 137 bp, Homo sapiens
caaattatctgtaatcttgtacagtgttacaagaaaaagaatcaggaaagaattggttagaggcagatgtccaaggggatagaaagtatctgactctaacattgcttttccttcagaaagctgtctggtttctttga

SEQ ID NO: 38043 - DNA, 795 bp, Homo sapiens
gccccttggagaattactgcaaggatctggttgagttgagaatttgtttcccccaccagtattgtttttggtgtttttttgttttgttttatttgttttgttttgttttaacatctctgtttccttcccctttctgttgttgctccttcctcctcccactccaactaccacacaaatcctgacaggagcctttctgcccctctagggaaggggcccgtgtgaggaactcttactggacgcccccttccctgttgctgtgctgatcttacacatcagtttccacggatcccatgtgaatcagttgtcttcctcatttactctgagcaagggtggcagcagcaatagcagaagacgtagatgcagtgactcattttgcatgatgtctgcaagagagccgggcctcccgtgtgctgtggctctcgttcaggcattgcttcagaaacttgattcttctggaattgtgcataagagggccttttagaaaaaaaaaaaaaaaaagctggaaaagttccccttcctgagcttcagtggaagcaccaggagggtgggccacgtccaggacggtgggagagcaaggttggcccctctgtgtccacctccagtgtgtggcactgtttcccatctcatctgggacatatcatggggctacagaatgcctcagaagcctgccagaaccctagtgatggttcccagcatctgggttggggaagactgtggtgatgcgctagggatagccatctgaaaggggtggggcagagacagcaggagccgtagtcgtctcaggagcctactctg

SEQ ID NO: 38044 - DNA, 288 bp, Homo sapiens
agataacacactggtaagaaaaatgtccaaggccaatcacaggagtcaaagctcgtgatcaaatcagctctgcctggggaggccgtgctcatggcaccatttagtgacaagtgggtgactctggggcaagttccaggggtgtcacccccaaggcagcagctcaggtgcagccaccatggaggcagtttcactgaggggccctctgaggcccctactctgagattctaagacagggtttgaagaatgttccagcatttgaacacatgaaccctatgatgtcctgctgtg

SEQ ID NO: 38045 - DNA, 596 bp, Homo sapiens
cttggtttggagtaaactctattaacctaaacagatacaaggtggaaaaggtaagaatctgagcatacaaatgccttccaccttcaggctggcagaaatttcatgtgaacacacagtactttgtccagtacgtgcactcatacctgaaatgttttgtttcatgttagtggaatttcacacaccagcaagcagatggaaagatatgttgaagagcatagaggttgaatccaggaccactcaggctagtgttgccacagctcgttcctgtagctccttagcacagggggctatatctgctggagctgcttcttcacatatctggtgttcgttatgcctccacacatcttgtaagaggcctcatgcttcatatccttctcagtgcccactttcctgccctcaggatggaaacttctctccaactagcctttgcattgaaaatctttcatgtcaaatgtagaaggaaagaatttcaggcatcaccgagaatattgaaagatattcttagaggagaaagactaagtccaggacaagactgaatgtagctattggaagtacaggtgtttcctgccttggcaatataagttgttcactcttat

SEQ ID NO: 38046 - DNA, 155 bp, Homo sapiens
ttggttgttaagtataaataaataaaatctaaccaaattcgtctaaaacagactgaactctatcttttcatcaaaccaacatttttgtaagagcaatttcactttgtgttttagagtagacatttttggaaatccttgaataaaaagctcttatt

SEQ ID NO: 38047 - DNA, 350 bp, Homo sapiens
cttctatggctgtcccgatttgcgcatttcctggggtactatgaacgtgagtggggtattttgttctggcattaaaagaaaaacaagcaagcaaacaaaaacacagcctccgatgccaaacatgttcccccttcttcacttccttggagctggaagtattattcctaagtctagtgcaaaatgcttctactctctgtgtcttcctgatagggatgtttaatgtaagtaggatattaatttcagaacattgatttcttatctgtgtgtctgacgtgccatctttaatgttaaaattaaggtgttaaaattaagcctagttatatagacgaaataaaatgctaagtcactac

SEQ ID NO: 38048 - DNA, 502 bp, Homo sapiens
acccccatccctaatctgagagaagctcatgaagacaggaccagcagccacaatgccctaactctctcttcctcctgaggccttccccaaactctgtatcatttctccccagtacctgttcccaacagtggtcagggttcagggcccttgaatcctttaggctctcccagtcaagctttagatggtggtcctgttttccttaaagtagctgagactggggagtagttttcagattgaatattccaggaagcagaggcaatgctctgactaactcaactcagagtaacagcaaggcagaaaaatcaagtaaggagacttggaggttcctgcgtctctcccataagcagaccttcccatgctctgtggccatgtagctcacagcgtttttgcattctttacaggaaattttgtcttctgaaagccatcacttattgtacttaactgcatgccagatactgcagatgttttatacacgttatatttagaattcatatggcttggc

SEQ ID NO: 38049 - DNA, 371 bp, Homo sapiens
tttctttaaaggacttatgttttgagaatttagaaagggctttatggaagcctctacaaagagaggaaggagaccctggcaagacccatgagctcacccaacaccctggccatcgtggagcctgtgcctacgttggccatggcatggatgcacacctccatcacagcaggtaaacactactttataactgaggccccaccccactatcagctgagaccctgagggatgtctgtgccttattcctcttgcttcccagcgatgagcacagtgccaggtgcaggagcgccacaaacgcgtatggaacaaacaaaaggaggtccacacagcaaccccttccctaacactgctgcacagaggagagcatgtacaga

SEQ ID NO: 38050 - DNA, 470 bp, Homo sapiens
actgtggtagattcgacgtccaaagtcactagactagtagtaaggctgaggttcaatgccaaatgagtctgcctccagagcctgacaccttgaccactatgctaaactgcctcttaagagacaggcaatgattacgtgtgaccttagacatcactgagtccaaaccctcatggacaaaagaggagcctgaggcccatggcaagtaacttggccaatggcacacaaaccaagaacagaacccagttctcctgcctctcggtcgaatcctttctcagctcactccacatcagggaagttatctgagatggaagttgtcttgcaggcagcacaaacatagtgacataagagctttccaggtaagtcaaaacagcaatggaaggaggcccattatacagctggtcccagaactggcctctgtcgacgcggccgcgaatttagtagtagtagcgaccccggaattccggaccggt

SEQ ID NO: 38051 - DNA, 659 bp, Homo sapiens
  misc_feature (652)..(653): n is a, c, g, or t
  misc_feature (658)..(659): n is a, c, g, or t
gcaaccgcggcgtgactacggcgcgcgcggtctgggcgcggacgggtggggccgggcggtgccggtgcgggctggggcagtgcagtgagtagcggtcttggggtgtgcgatctcgctgagcctcctcacacggttcgtcgtctcgggttcgagcccagtgggcttagccactcgccatggactcccagaaagaagctctacagaggatcatttcaactctggcaaataaaaatgatgaaattcagaactttattgatacactacatcatacactaaaaggagttcaggaaaattcgtccaacatactctcagagttagatgaagaatttgatagtttatactctatactggatgaagtaaaagaaagtatgattaactgtatcaagcaggaacaagctcgtaaatcccaagagttacagagtcagattagtcaatgtaataatgccctggagaactctgaagaactattagaatttgcaacaaggtcattagatataaaggaacctgaagaattttcaaaggtacacaaaaactgcattaatacacttaacaagggaagttgtatttttaaaaaggcgtttttgtttttctttagttttggatttctttactgatttctaatactaataaagccttggggtttcttgataannaaaann

SEQ ID NO: 38052 - DNA, 548 bp, Homo sapiens
ggacaaatctttattccatgtttaatttatttagcttcccctgtagctaatatttcatgctgaacacattttaaatgctgtaaatgtagataatataatttatggatcattaatgcctctttagtagtttagagaaaacgtcaaaagaaatggccccagaataagcttcttgatttgtaaaattctatgtcattggctcaaatttgtatagtatctcaaaatataaatatatagacatctcagataatatatttgaaatagcaaattccctgttagaaaataatagtacttaactagatgagaataacaggtcgccattatttgaattgtctcctattcgtttttcatttgttgtgttactcatgttttacttatgagggatatatataacttccgctgttttcagaattattgtatgcagtcagtatgagaatgcaatttaagtttccttgatgctttttcacacttctattactagaaataagaatacagtaatattggcaaagaaaattgaccagttcaataaaattttttagtaaatctgattg

SEQ ID NO: 38053 - DNA, 414 bp, Homo sapiens
aaaatattaattaaaagtctttccacattgaaaatctctgaatcaaaagctttaaatgataaatcttatcaacatctaataaaatattcatgctaattcttcaaagtaacttccaaaaatagaagcaacacttcccaatttactctatgaggccaggagtgccatgataccaaagctggaaaaaagcattgcaagaagactagaaagaaaaatccgtaatgactacagacacagaaatccttattaaatactaggaaatttattccaggaacataataaacatgattatataccatagccaagtgagattttattttcataaatgcaatgttagcttaatatctaaaagtcaattaagataatacacaatattacttgaatacatgacaaaaagaacatttcgatagacacata

SEQ ID NO: 38054 - DNA, 297 bp, Homo sapiens
tcattttccctcttcccctttcttttctttctttcgctattataaaaatgctatgatacaatgatcaacatgtctgttatacatctttgcacacttgtatcctgagtttgtctgctcttctgccttatctatagaattacttctcaacatgaacacagacatgagttggcctagcctagtgaaaaatgtttgtcacacttacttgacttgccctccaatatatatgtagaagtggtaattctcatatacaagaaggcatatacaataatttcacgtacattattgagttataagacc

SEQ ID NO: 38055 - DNA, 529 bp, Homo sapiens
ggaatagtgtcaataggattggtaccaattcttcttggaatgtctgatatatattcagttgtgaattcgtctggtcgtagaccttttttttttgttggtaactttttagataccatttcaatctcactccttgttattggtctgttcagagtttctgtttcttcctggtttaatcaaggagggttgtgtatttccaggaatgtattcatctcatctaggttttctagtttatgcgtgtaaaggtgttcatagtacccttgaaggatcttttatatttctgtggtatcagtggtaatatctcctgtttcgtttctgattgagcttatttagatcttctctcttcttttgttggttaatctcactaatggtctatcaattttatttatcttttgaaccagctttttgttccatttatcttctgtattttttctgttgttgttgtttcaatttcatttagtactgctcttatcttggttatttcttttcttctgctgggttggggtttggtttgttcttatttctctagttc

SEQ ID NO: 38056 - DNA, 636 bp, Homo sapiens
ctgtaaccccagctacttgggtggctgaggtatgagaattgcttgagcctgggaggccgagtttgcagtgagttgaaatcctgccactgcactccagcctgggcaaagaacaagattctgtttggaaaaaaaaaagtaattagaggtgacttgcagttaatttagaaaactttatatattcagtactgttgaaaatgtaatttaaagtactctctttcttgttatctcattttattaaaaaattacattgtcagtccctttatagcatagtatttctgaatcactctgtggtaacatatgagtgattctcaacttctaagtgcatatgcatgtgtatgctatttcaaactagatgtctaggctgggcacagtgactcacacctataatcccagtacttttgggaggccgaggcgggtggatcacttgaggtcaggagctggagaccagcctgaccaacatagtgaaatcctgtgtctgctaaaaatacaaaaattagccgggcctgttggtgtgtgcctgtagtcccagctactggggaggctgaggcaggaaactcgctgaaacctgggaggcagagggctgcagtgagctgagatcctgctactgcactgcagccttggcgacagtgtctcaat

SEQ ID NO: 38057 - DNA, 349 bp, Homo sapiens
tgaaagtcacttgagagaaatgtttagatcttggaaaggaattctcaaagccagatcggtgggctactgttctattgtgaaaaggtcatttaatttataaagtaatgggattagtatttggagaggtggatttactggctataatgccttcaggtgaaatttcccttctgactcgtgttcataacacttatcttctcattcccattgaattttccatctattggctctgaatttcaaatctagtcatagaaaatactagactgaaaccttcagggataaaattgcttccttcattgtcctgaaatggtttgtttcactactcagcaaaatctttaattgtgatgattta

SEQ ID NO: 38058 - DNA, 411 bp, Homo sapiens
agaaaagctttgtgctataaaagactgagccagaaggtggggtttggttcctagagttgccctttactaatgagaggaaggcccttgtctttgagcttctgctttttttacctctaaagtgggattaatgaccatgtacacaactggcaagatcaaaggaaatgaactaggtgaatgtaaattcatgcaaacatactattttggcagtaatgatggcagacaccaaaatgattatattcttaccatccctttcctttctacaatgctctgatgataaggtgagctttacctcccgaagaacaagactatattctgagtatgtacctagcatgtttattactctcagtaaatagaaatcttttttagtcagtaagcatgtttcaaaaatattttgagttatttaaaagaaaa

SEQ ID NO: 38059 - DNA, 185 bp, Homo sapiens
gagttttacaagtaaaaccttcaaaagtaaatgtttaataagaaataagcacacttgagctccttcatgacattacatgtaaagggtttaaactttaaaattgcactacacatatactttgcttacatgtatctgtgtgtgcatgtaaggaagataactacttttagaatatgtcaaaacataaa

SEQ ID NO: 38060 - DNA, 707 bp, Homo sapiens
taggtagaacatttaacatgaaatctatcttcttttttaagtatgcagtattatattgttaactaagtactatgttgtacaacggatctctagaacttattcctcttgcataactaaatctttgtacccattgagcaacagttccctacctctaaacttctgttccttgatctttttaactctctattttctcttatggctgcttgtaggtgattcaatgtaacaatgacagaaaacagttacagactttattcctctgcttcctaaaatccagtcaaaattgccttctctgcccattccaggcttacttttggttacaatagtgactgcagtgtatgctgagactgatcaatggaaaagtgtcagggaacatttggaatgatagccttttagttctgtagacactaaagtactgactctaccaaatcaatgatgggagttggagctgcatgcaatgcctgctgcagaacatctgaattccatcttggagccacactgcgaagtacccatcactgattatctaccagttctaagaaggggaacattggtgagaccttgatattctgccgggggtactacaaactagacccaatcattgcttacttgcttgacatttttgtttgccaagtgttcttttagctagaagaaaaaaattctcttttggttaaagtaaaagatagttgagattgttacttttacaaacttat

SEQ ID NO: 38061 - DNA, 680 bp, Homo sapiens
aattaaagcagggaaccttctgtgcctggagagcctcagcatctaggggcagtgtcctgagccaccattccagggaagccatttgcaattttttttagatttttaaaaaatgttgctgggtctgcgtttttccacatcctctgaactttccttcctgctagctttctatattgcttcctactttttctctgctttgggtataagcttctaggaatagaattttaaatcttagatggcttccccattctatatagctcttgggagtgctcacgtcaaagacttctgggaggctttctgcccagagttgggctgctggagaagattataaaggcaccaccatttttaaggtttttgttttgttttgtttggaagtttggaagtttcattcagaaaagtaaccccatgaccactgaaacaaatcctgaaaacagagaaaagtataaaagctcaagacagaaacagaaaatcctacagaaaccactctcccagaaagtacctatcttagtagttcatactgttttctttcacggcattttggttcctctaggttaacatatactaaaattggaattataattctgaaatgcttttctcttttcgtttccaatttaacagtgtagtagatattcctccgtgttatttaaaattcttcatgatcattattaatgattgaaaacttc

SEQ ID NO: 38062 - DNA, 342 bp, Homo sapiens
tgctaaaacgtaggcatagtttctataaacccttattgctcaggagtcatgtggccagaggtctgctcctatagatcacattagtattgtagaacctaagattgatcttttgagatgtttttcagacctttgcattctgacaactgactggtcctacctgtattcattgagttgactcatgagtcaaccagttctgtggcccccatccagaggcagactcagcacatgaaggctgttttccacacccctatgattgcattcccagccagtcagaagcatccattccctagtcccctgcccaccaaactatccttgaaacaccttaacatctgagccttcggg

SEQ ID NO: 38063 - DNA, 912 bp, Homo sapiens
tgtccgcactcgcggcccctaacctgccccgggagcccgggagtgcggcttgggaaggagggaaaggagtgtgtgagcagggattggcccgaacctatctccacgctctcccccgggactggaggtgaaggggggcgtggagaaaatctcagggaacaggggcttcgacagggggctcccgcccgcccgagccccctccccaaaatgcgaggcctgcacagtatgccttctccgcaaaacctcggcaagcgggttagtgaattcaggtcactaagaagctgagcccgcggaaagctgcccaaacacccccttctctaggggactccccacgccccccgccgggacgcgttcccgaagtcgccgcctggactgcaaccgcgtggcctgcgccgcgtcctcttctccgcagcctccgaggcccgtgcgaccaagctgaaaccgcttattctccggagcccctatgaccccgggtgggggccagggctcgcctcgatcgcagcccgtgcgccctccggactccagttcgccgggactgggcgacaccagaagcggctagtgtgagtgaaacaaacgggaaatttgctctggcccgcctgcccagccacccacggctgcctgttggccaatcaccatttgaccagtccaggaagagcaactgtggcaggcctgatttcctgggaggccccagactccctttgcctacctcttcctctctgaccccatcctcgctttgatgcccgggacctgctacccaggtacgtgggtcttctctgccggatgtggacatcttggcctctcgccttggtgcctactcttgggaagcgggtccagacatctctcctgcaggaagagaggaagggttaattacaggcgttggggataattaaagcctttgaccaagaggaaaaaaaa

SEQ ID NO: 38064 - DNA, 311 bp, Homo sapiens
cctccactcgtgataccttcaggtgcgggaggaacccaggtgaatagggtctggagtggaccccctgcacactgcagcagccctatggaagaaagggcctgactgctaaaagaaaaaacagaaagcaacaacatcaatgaaaaagaccccacaaaaacccatccaaaggtcagtagcctcaaagatcaaaggtagataaatgcaagaagatgagaaagaatcagcacaaaaatgctgaaaactcaaaaagccagtgtgcctcttctcctccagatgatcttaacacatctccaacaagggcatagaactgg

SEQ ID NO: 38065 - DNA, 328 bp, Homo sapiens
tcagttgctaactaaaagcaattgtacgtgtatttgatatttccccacagtttctacctctagatttaattcagtaaaggaagatgatatttgaagatgaagtagcacttgtgtcctgagcatctctcaggcactactgcatggaatggcaaaggggatgcaagaagcacatcagatgacaacggtcttagacgcttacaagtctgctaaggtgactgacaagggaatcaaagaaggcagtcatgtcatggacctatcagcagcatagctgggcaaccctggagctgaatctggccctcagacttgtttaaattgcccagtgttttta

SEQ ID NO: 38066 - DNA, 367 bp, Homo sapiens
tttttttttgagatggagtcttgctctgtcgcccaggctggagtgcaatggtgcaatctcagctcactgcaacctctgcctcctgagttcaagtgattctgcctcagcctcccaagtagctgggattacaggtgcaggccaccaaggctggctaatttttgtgtttttagtagagatgcggtttctccatgttggccaggctggtcttgaacttcagacctcaggtgatccacctgtctcgccctcccaaagtgctgagggcatgagccactgcacccggcctagattctttatgagattgccgagctgtcacctaagaaatgtcctggttgtgcttcgatttggtggggaggtgtgggacaatgac

SEQ ID NO: 38067 - DNA, 1201 bp, Homo sapiens
aattaaaaagtaaaataataggccaggcatggtggctcatgcctataagcaccctgggaggccgaggcaggcagattatttgagctcaggagtttgagaccatcctgggcaacatggcgaaaccctatctctacaaaaaatacaaaaattagccagacatggtggcacatgcctttagtcccagctactctggaggctgaagttggaggatggcttgagcccacgagatggaagttgcagtgaactgaaattgtgccactgcacttttcagcctgggtgccacagcgagaccctagttaagagaaaaaaaaagtaaaaacaaattgtgggtcaaagtaaatgtatacagttttattacaatgtaacaaaagttgaaaatcaggcagatgtgtattcagtatccaattcaatatatcttagaaaaagcacaggaaacagaccttaaaattgtaacctaccaactaacttacatgcttataaaagtaaaggagaataactggccgggcacggtggctcatgcctataaaattccagcactttgggaggccaaggcaggaggatcacttgagcctatgagttcaagaccagcctaggcaatgtagtgacacctcatttctatttattttaaaaaaaagagagagtaactacagaagaactttaaaaaataaaaaataagcttaccttggattcttggcttagagtagaggttttttttaagttatggaggaaacatttttgtaaaagtttaatgacccactttagatgctccaagaacaagcatcccttccatgtatgtcttgagaaagaaatcacagaagcatttctcaccaatactctttggcttaaaatgttcagcagaattgggcagtgggggtgacttttcttatattaataatatttacatccaatacactgaatcttcctttagaggtaagactttaatatctatactgtaaatatttggtttatttggcactactgtaagttttgtttttcacaaagctcttattatgaagcaaaataaaaattctagtttcttgtatgattttttgtactcattcattcctgttaagctgccaaaaattaaagtgcaatattgtatatttttaagaacaaatttaaaatagaattttgatgtttctcagatcacaagaaatacaaatctatatagtataataaaatcagcaaaaagatcaaataa

SEQ ID NO: 38068 - DNA, 1302 bp, Homo sapiens
aattaaaaagtaaaataataggccaggcatggtggctcatgcctataagcaccctgggaggccgaggcaggcagattatttgagctcaggagtttgagaccatcctgggcaacatggcgaaaccctatctctacaaaaaatacaaaaattagccagacatggtggcacatgcctttagtcccagctactctggaggctgaagttggaggatggcttgagcccacgagatggaagttgcagtgaactgaaattgtgccactgcacttttcagcctgggtgccacagcgagaccctagttaagagaaaaaaaaagtaaaaacaaattgtgggtcaaagtaaatgtatacagttttattacaatgtaacaaaagttgaaaatcaggcagatgtgtattcagtatccaattcaatatatcttagaaaaagcacaggaaacagaccttaaaattgtaacctaccaactaacttacatgcttataaaagtaaaggagaataactggccgggcacggtggctcatgcctataaaattccagcactttgggaggccaaggcaggaggatcacttgagcctatgagttcaagaccagcctaggcaatgtagtgacacctcatttctatttattttaaaaaaaagagagagtaactacagaagaactttaaaaaataaaaaataagcttaccttggattcttggcttagagtagaggttttttttaagttatggaggaaacatttttgtaaaagtttaatgacccactttagatgctccaagaacaagcatcccttccatgtatgtcttgagaaagaaatcacagaagcatttctcaccaatactctttggcttaaaatgttcagcagaattgggcagtgggggtgacttttcttatattaataatatttacatccaatacactgaatcttcctttagaggtaagactttaatatctatactgtaaatatttggtttatttggcactactgtaagttttgtttttcacaaagctcttattatgaagcaaaataaaaattctagtttcttgtatgattttttgtactcattcattcctgttaagctgccaaaaattaaagtgcaatattgtatatttttaagaacaaatttaaaatagaattttgatgtttctcagatcacaagaaatacaaatctatatagtataataaaatcagcaaaaagatcaaataaatgaaaaataaagcttcgaggggggggccccgggtacccatttcgccctattagtggagtcgtgttacattactggcccggcgttttaccgccgggctggg

SEQ ID NO: 38069 - DNA, 1297 bp, Homo sapiens
aattaaaaagtaaaataataggccaggcatggtggctcatgcctataagcaccctgggaggccgaggcaggcagattatttgagctcaggagtttgagaccatcctgggcaacatggcgaaaccctatctctacaaaaaatacaaaaattagccagacatggtggcacatgcctttagtcccagctactctggaggctgaagttggaggatggcttgagcccacgagatggaagttgcagtgaactgaaattgtgccactgcacttttcagcctgggtgccacagcgagaccctagttaagagaaaaaaaaagtaaaaacaaattgtgggtcaaagtaaatgtatacagttttattacaatgtaacaaaagttgaaaatcaggcagatgtgtattcagtatccaattcaatatatcttagaaaaagcacaggaaacagaccttaaaattgtaacctaccaactaacttacatgcttataaaagtaaaggagaataactggccgggcacggtggctcatgcctataaaattccagcactttgggaggccaaggcaggaggatcacttgagcctatgagttcaagaccagcctaggcaatgtagtgacacctcatttctatttattttaaaaaaaagagagagtaactacagaagaactttaaaaaataaaaaataagcttaccttggattcttggcttagagtagaggttttttttaagttatggaggaaacatttttgtaaaagtttaatgacccactttagatgctccaagaacaagcatcccttccatgtatgtcttgagaaagaaatcacagaagcatttctcaccaatactctttggcttaaaatgttcagcagaattgggcagtgggggtgacttttcttatattaataatatttacatccaatacactgaatcttcctttagaggtaagactttaatatctatactgtaaatatttggtttatttggcactactgtaagttttgtttttcacaaagctcttattatgaagcaaaataaaaattctagtttcttgtatgattttttgtactcattcattcctgttaagctgccaaaaattaaagtgcaatattgtatatttttaagaacaaatttaaaatagaattttgatgtttctcagatcacaagaaatacaaatctatatagtataataaaatcagcaaaaagatcaaataaaaaaaatgagagtcttgaggggggggcccggccccaattcgcccttatataagtcggattccacttaattgcctggggttcccctgttggcggcgg

SEQ ID NO: 38070 - DNA, 1147 bp, Homo sapiens
aattaaaaagtaaaataataggccaggcatggtggctcatgcctataagcaccctgggaggccgaggcaggcagattatttgagctcaggagtttgagaccatcctgggcaacatggcgaaaccctatctctacaaaaaatacaaaaattagccagacatggtggcacatgcctttagtcccagctactctggaggctgaagttggaggatggcttgagcccacgagatggaagttgcagtgaactgaaattgtgccactgcacttttcagcctgggtgccacagcgagaccctagttaagagaaaaaaaaagtaaaaacaaattgtgggtcaaagtaaatgtatacagttttattacaatgtaacaaaagttgaaaatcaggcagatgtgtattcagtatccaattcaatatatcttagaaaaagcacaggaaacagaccttaaaattgtaacctaccaactaacttacatgcttataaaagtaaaggagaataactggccgggcacggtggctcatgcctataaaattccagcactttgggaggccaaggcaggaggatcacttgagcctatgagttcaagaccagcctaggcaatgtagtgacacctcatttctatttattttaaaaaaaagagagagtaactacagaagaactttaaaaaataaaaaataagcttaccttggattcttggcttagagtagaggttttttttaagttatggaggaaacatttttgtaaaagtttaatgacccactttagatgctccaagaacaagcatcccttccatgtatgtcttgagaaagaaatcacagaagcatttctcaccaatactctttggcttttacatccaatacactgaatcttcctttagaggtaagactttaatatctatactgtaaatatttggtttatttggcactactgtaagttttgtttttcacaaagctcttattatgaagcaaaataaaaattctagtttcttgtatgattttttgtactcattcattcctgttaagctgccaaaaattaaagtgcaatattgtatatttttaagaacaaatttaaaatagaattttgatgtttctcagatcacaagaaatacaaatctatatagtataataaaatcagcaaaaagatcaaataa

SEQ ID NO: 38071 - DNA, 419 bp, Homo sapiens
tcccaattcttcctcagcctctgctcctccaccctataatctttttatcacctcccctccttacacctggtccggcttacagtttcgttcggtgacttttcttatattaataatatttacatccaatacactgaatcttcctttagaggtaagactttaatatctatactgtaaatatttggtttatttggcactactgtaagttttgtttttcacaaagctcttattatgaagcaaaataaaaattctagtttcttgtatgattttttgtactcattcattcctgttaagctgccaaaaattaaagtgcaatattgtatatttttaagaacaaatttaaaatagaattttgatgtttctcagatcacaagaaatacaaatctatatagtataataaaatcagcaaaaagatcaaataa

SEQ ID NO: 38072 - DNA, 175 bp, Homo sapiens
aatgttctaagaaagtttacaaatttgcgttgggctgcattcaaggctgtcctgggctgcgcgcagcccgtgggttggacaagcttggtgtatactttcgaaaaatttaaatcacaaaatcaatagaaatttgggactgatgaaatgtaaggatgaagaaaacttttgggttttg

SEQ ID NO: 38073 - DNA, 418 bp, Homo sapiens
ttgataggtctaaatggttgtgttcttgtctttaattcagaaaatgtttatcgagcatatactataagctggatatccctgtaggctctggagatgtgagagtgactgggatataaactgtgttcaaggaacacctagttcagtggagaaaagattgcattgcattttgcctcttttcctcctttacctgtgttgtatcagctaggattaaatttagttgtgagtggcagaaaatccaatagctgccttaaaccagttcactacaaaaatcctcaataactttagctacttttggagtttgcgaatatccaatatattcttttgaaaacctgccaataaaggagaaaatattcaacatttgtgttgcctttctcataaactgcaaggaaatcaaacagttgatgagaagtgtctcctt

SEQ ID NO: 38074 - DNA, 2350 bp, Homo sapiens
acggcgagcctcatcctccgggtgcggcgctgagcagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38075 - DNA, 558 bp, Homo sapiens
cgtcaacagcagcacctatttggaagcaacgtaatatcttgtggacgcaagcttccttatctttccgtgtgaccacagcgtgattcggggctctggccaggtggcagttcgcatactcctccacagatttcctggtaccatcaaggcacagcaacagccacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38076 - DNA, 1031 bp, Homo sapiens
tctctaaacttctcttctcgcttcatttcattcatttgatcttcaatcactgataccctttcttccagttgattgaatcagctactaaagcttgtgcattcgtcacgtagttctcatgccatggttttcagctccatcaggtcatttaaggacttctctacactggttactctagttagccatttgtctaatcttttctcaaggtttttagcttctttgcgatgggttcgaacttcctcctttagctcggagaagtctgattctctgaagccttcttctctcaactcatcaaagtcattctgtgtccagctttgttccgttgctggtgaggagctgcggtcctttggagggggagaagcgctctgatttttataattttcagcttttctgctctgttttttccccatctttgtggttttatctacctttggtcctcgatgatggtgacatacagatggggttttggtgtggatgtcctttctgtttgttagttttccttctaacagtcaggaccctcagctgcaagtctgttggagtttgctggaggtcaactccagaccctgtttgcctgggttatcagcagcggaggctgcaggacagcgaatactgctgaactgtctgggttttatatgaactccatcccttaccatgctacgttgggtatgttactgtgcctcagttttctcatctatgaaatgtctaaattagtgcctacttcgtaaggtggctgagataattaaataggttactataatttttacagacagggtctcactttgtcaccaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38077 - DNA, 686 bp, Homo sapiens
  misc_feature (48)..(48): n is a, c, g, or t
gaggagagacgcctatccccagtaggattctagggaattcttatattntgatattcgggcacaacagtctaattcgctctctgtcaaattagcagtcttctagataagtgcatagagttacttgtcagctaaaccccctgggtcgatacaagtctggatgatctaacgcggcctcgtccgcgtgggcgtccagcagactctgaaatcccgcccggaggaaaagcgtaaaggcgttggagtcaaaggagcggggatccgccagcatctgaaagccctgcacagactccgagagctccattgtgagcgcgccgtgaccttcgacacgcctcgtgcaaaattcggcacgagcaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38078 - DNA, 899 bp, Homo sapiens
  misc_feature (857)..(857): n is a, c, g, or t
  misc_feature (859)..(859): n is a, c, g, or t
  misc_feature (889)..(889): n is a, c, g, or t
taggctgtggcccttgggataggacaacatggacaaaatgaaatggtgagtgaacaatctaagcccggcatgtatgacaggctagactgtaggggcagatagtaaggggatacaggctcagagcactaaggtagtgaacttattgggtatagagaattccatcttatttctaagaaaaggactgggtttatgtgtacatgccattgctctgcagtaaacttttgattagagttgccttgtccaatatggtagccaccagcaagatgtgactatttaaatttaagttaattaaaattaaactaaataaaagatgtatttcttcaatcccacctagctgcatttcaagtgctcaacagccacatgtggctccatattggtcagcaaagagaatgtttgcatcatcacagaaagctctttcagacagtgctgctctagacagcttcaacaatgataggttctggtaaccataaagttgctatgcatactactcatttggaacaccagtttctgagaactgaaatagaataaaacacatctttgcagtataactatgttgggtgtaactgagtcacctgaaaaagtttggaagctggggaataacatgtggtgtagggcagttagtctttccacaggagtatgcagataagggagtcttgatccttattaaaatgctgattctcagagccttgagatactgatttagaaagtctgtgctaggtcaggtatccgcatttgaaaagctgcccccatgtaattctgacggaagcagcaatgtgcttgtctaggttcgctattgtgagaatcaagttgatatttacctaacctatatcctccacaaactgcacattgcggtgctntntgtatgtcagtcctcaccgcttaagagtcnggagacagcc

SEQ ID NO: 38079 - DNA, 758 bp, Homo sapiens
taggctgtggcccttgggataggacaacatggacaaaatgaaatggtgagtgaacaatctaagcccggcatgtatgacaggctagactgtaggggcagatagtaaggggatacaggctcagagcactaaggtagtgaacttattgggtatagagaattccatcttatttctaagaaaaggactgggtttatgtgtacatgccattgctctgcagtaaacttttgattagagttgccttgtccaatatggtagccaccagcaagatgtgactatttaaatttaagttaattaaaattaaactaaataaaagatgtatttcttcaatcccacctagctgcatttcaagtgctcaacagccacatgtggctccatattggtcagcaaagagaatgtttgcatcatcacagaaagctctttcagacagtgctgctctagacagcttcaacaatgataggttctggtaaccataaagttgctatgcatactactcatttggaacaccagtttctgagaactgaaatagaataaaacacatctttgcagtataactatgttgggtgtaactgagtcacctgaaaaagtttggaagctggggaataacatgtggtgtagggcagttagtctttccacaggagtatgcagataagggagtcttgatccttattaaaatgctgattctcagagccttgagatactgatttagaaagtctgtgctaggtcaggtatccgcatttggtgagatgtgtattacctaccat

SEQ ID NO: 38080 - DNA, 656 bp, Homo sapiens
  misc_feature (5)..(5): n is a, c, g, or t
  misc_feature (15)..(15): n is a, c, g, or t
ctaancctgtgtgancccaacaccaaagagggaatctgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38081 - DNA, 743 bp, Homo sapiens
  misc_feature (29)..(29): n is a, c, g, or t
  misc_feature (37)..(37): n is a, c, g, or t
  misc_feature (42)..(42): n is a, c, g, or t
  misc_feature (91)..(91): n is a, c, g, or t
cgcaaatcgctaccatacgcaagctgaanttacctcnttaanggacaaagctgagctcacgcgttgcgccgctttagccggcggatccccngggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38082 - DNA, 151 bp, Homo sapiens
cccccccccccaaaatttgtgggggaaggtttttttgccctggtttcactggcccaagtggtttgtgctaaccacgtctgtcttcacagctctgtgttgccatgtgtgctgaacaaaaaataaaaattattattgattttatatttcaaaa

SEQ ID NO: 38083 - DNA, 1287 bp, Homo sapiens
ctgtttgatgtgtgcccccttcttcccgatgatggcgcccacagcctgggttgggatgaagagattcacaatctcctgctctggataagagtgatgatgcgggaacgggccaaactggtgatgggggtacaggctggagaagtatccggagtaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38084 - DNA, 680 bp, Homo sapiens
  misc_feature (1)..(1): n is a, c, g, or t
  misc_feature (98)..(98): n is a, c, g, or t
ngttagaaactcagtctcgtactgtgatgggccagcttaaccgggtacccacaccaagaggatctcggctcacagcgcttcaggttctggtaagaagnaatgtgctttgtaaccacagctttccacagacactggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38085 - DNA, 2145 bp, Homo sapiens
gatctactaacttgctttctagttaattcttccttctcttccttcctctcacttatatatatctaagagaatatttagaatgtggtcacatgatttgttgagggtatactgatgactttctgcatgctgttttaatcaaatatttaaattcacatcaccgttaagctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38086 - DNA, 2304 bp, Homo sapiens
acggcgagcctcatcctccgggtgcggcgctgagcagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38087 - DNA, 2301 bp, Homo sapiens
  misc_feature (1)..(1): n is a, c, g, or t
  misc_feature (4)..(4): n is a, c, g, or t
  misc_feature (6)..(6): n is a, c, g, or t
  misc_feature (10)..(10): n is a, c, g, or t
  misc_feature (16)..(16): n is a, c, g, or t
  misc_feature (40)..(40): n is a, c, g, or t
  misc_feature (43)..(43): n is a, c, g, or t
ntcngnatcntcttanacccgtaaagcccgatgaactcgncgngggagccctgctggtctgcgccgtcccggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38088 - DNA, 2296 bp, Homo sapiens
acggcgagcctcatcctccgggtgcggcgctgagcagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggttttttgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38089 - DNA, 2283 bp, Homo sapiens
acggcgagcctcatcctccgggtgcggcgctgagcagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgtaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38090 - DNA, 2297 bp, Homo sapiens
acggcgagcctcatcctccgggtgcggcgctgagcagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38091 - DNA, 2317 bp, Homo sapiens
acggcgagcctcatcctccgggtgcggcgctgagcagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38092 - DNA, 1696 bp, Homo sapiens
acggcgagcctcatcctccgggtgcggcgctgagcagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38093 - DNA, 1256 bp, Homo sapiens
  misc_feature (17)..(18): n is a, c, g, or t
ccccccccccttccttnngctcccttcgttcagcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38094 - DNA, 2285 bp, Homo sapiens
acggcgagcctcatcctccgggtgcggcgctgagcagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38095 - DNA, 2288 bp, Homo sapiens
acggcgagcctcatcctccgggtgcggcgctgagcagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgtgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38096 - DNA, 2296 bp, Homo sapiens
acggcgagcctcatcctccgggtgcggcgctgagcagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaattttgccctggtttcactggcccaagtggtttgtgctaaccacgtctgtcttcacagctctgtgttgccatgtgtgctgaacaaaaaataaaaattattattgattttatatttcaaaa

SEQ ID NO: 38097 - DNA, 2326 bp, Homo sapiens
acggcgagcctcatcctccgggtgcggcgctgagcagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatctctcctgaaagcatgggctctatgtatcccctaatataacaaaggaggtcagcctaacaagcatgagatcgttctcctatgatcatgagtgtcaatggtttcactggaccaagtggtttgtactaaaatattccgaatccacagctaagtcatatcacgcgtcatggtcaaaaaatcacaggcat

SEQ ID NO: 38098 - DNA, 2294 bp, Homo sapiens
acggcgagcctcatcctccgggtgcggcgctgagcagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38099 - DNA, 2250 bp, Homo sapiens
acggcgagcctcatcctccgggtgcggcgctgagcagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacacactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38100 - DNA, 2309 bp, Homo sapiens
acggcgagcctcatcctccgggtgcggcgctgagcagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38101 - DNA, 801 bp, Homo sapiens
  misc_feature (1)..(1): n is a, c, g, or t
  misc_feature (4)..(4): n is a, c, g, or t
  misc_feature (6)..(6): n is a, c, g, or t
  misc_feature (10)..(10): n is a, c, g, or t
  misc_feature (16)..(16): n is a, c, g, or t
  misc_feature (40)..(40): n is a, c, g, or t
  misc_feature (43)..(43): n is a, c, g, or t
ntcngnatcntcttanacccgtaaagcccgatgaactcgncgngggagccctgctggtctgcgccgtcccggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcaaaa

SEQ ID NO: 38102 - DNA, 1257 bp, Homo sapiens
acggcgagcctcatcctccgggtgcggcgctgagcagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacatttttgggcaaaaaaaaaaaaaaacaaaaaaaaaaaaatctttttggcgccgccttgggccccttaagagaaagttttaagagacccatcggttgggcgggcgggcccccgtcggctgataggtgacaccggggtcacatagctggtcccccaggaaacacccggggcacggaaacacgggctcgcggattcctcccccaataacaacccccccgcggcagaccaggcgttcggacacacaccccaaagcgcactccgacaccacacaggcctcaacaccggacaccaaccaggcccatgtcaa

SEQ ID NO: 38103 - DNA, 899 bp, Homo sapiens
  misc_feature (1)..(1): n is a, c, g, or t
  misc_feature (4)..(4): n is a, c, g, or t
  misc_feature (6)..(6): n is a, c, g, or t
  misc_feature (10)..(10): n is a, c, g, or t
  misc_feature (16)..(16): n is a, c, g, or t
  misc_feature (40)..(40): n is a, c, g, or t
  misc_feature (43)..(43): n is a, c, g, or t
ntcngnatcntcttanacccgtaaagcccgatgaactcgncgngggagccctgctggtctgcgccgtcccggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacttcaagagtttccttttcgctctcctcg

SEQ ID NO: 38104 - DNA, 809 bp, Homo sapiens
acggcgagcctcatcctccgggtgcggcgctgagcagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttgcaaacagctggcagacccagtcggtaccgcca

SEQ ID NO: 38105 - DNA, 732 bp, Homo sapiens
acggcgagcctcatcctccgggtgcggcgctgagcagcgagtccgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttctgtgtcttttaaaacttgattatatctattttttaaaatccagtctaaatcttcttgcctgcaacttttttttatacttcctttgccactgtatttgtccattgtatccttgctttaatctatccttggtgaaattga

SEQ ID NO: 38106 - DNA, 370 bp, Homo sapiens
gggacttatcagaggaaggtgggaccagggaccctatagatgattttgggggcatcatgaaagcatgcagctggggccctaagtggataaatggcagataaaggaggtggaaaattcccaagacatactccgtagcttccctttttccccagggctggttcagagctttcagactcttctcatccatgtgttcccagctgctaaagaccacaaggtcctcacggactttctgttcacttgacacacctatttggaagcaacgtaactgactgctcgggcaacttttgtttgttccggtcggaaaccaaggaccttctgttcagagatgacacagtatgtttggccaaacttcatgacagaaacacatatg

SEQ ID NO: 38107 - DNA, 557 bp, Homo sapiens
gtgggtgttctttttctgtgttccctttttcatgctcagtaattggaaatgagcatactgtatttctcctttatcattgcctgggtttccacctgtgcagagttaggtacctacggggtccccatctggattcctgggcctctttccatcattcaatctctccacacggtgcctctgcctctggggtagtgttgccataaccaaagactgggggttggtgctgctaagatcaggctcatggtggaatgaggagcaatcactgctacatgggcatcagaagcctttacctggctgtgggctcttgagcgagtcattctcccgcatgttctctggccttcagtgctcactccagacctctcagctcatactttctatgatcaattgaatttcaaggatgggcaccacagcccatggctctcctgtgttaagctcacctgggctttccctccccagagaacttggcaaacaaggctgacagggaccagtatgagctgctttgcctggacaacacccggaagccggtagatgaatacaaggactgccacttggcccaggtc

SEQ ID NO: 38108 - DNA, 1354 bp, Homo sapiens
ccagcttgcccggcatcactcgcggcattggagtcaagatggaggagtacgcgcgagagccttgcccatggcgaattgtggatgactgtggtggggcctttacgatgggtaccattggtggtggtatctttcaagcaatcaaaggttttcgcaattctccagtgggagtaaaccacagactacgagggagtttgacagctattaaaaccagggctccacagttaggaggtagctttgcagtttggggagggctgttttccatgattgactgtagtatggttcaagtcagaggaaaggaagatccctggaactccatcacaagtggtgccttaacgggagccatactggcagcaagaaatggaccagtggccatggttgggtcagccgcaatgggtggcattctcctagctttaattgaaggagctggtatcttgttgacaagatttgcctctgcacagtttcccaatggtcctcagtttgcagaagacccctcccagttgccttcaactcagttaccttcctcaccttttggagactatcgacaatatcagtaggacttctttcctaggatttctttaacagaacgagttgtggttcgagaaggatttcagaagatcaagttacagtctgtttttaaaaccataggtgggacagctatggccaataggctataaagagacatttagcacttttttctatttaaaggaacaagcggggaagggtgctaaaagataatacgtttatttattcacacttgaattgcatttgtgatcaaaataaatgtttaaatcgctaaaggaaaatacagtaagtgcttgaaagatgaaggaccaaaaggccaaaaaacagtgaaatatgatcatcatctccttgcggacttctctgcctggttttgtgtgttctgttattcaaacaataaaaagctggtggaacttactctttcttttaagataagttgtagacttcgatgtttcatgctcatgtacttcaaataatgcatgttttatagttagtccctcatcacttgaagtgacttctgagaattatgcagagtcaacatggatcatttcacagtgagatgctttatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagtttagtgtttcttgtatgcttgaaaataaagtatgtactgttttgaatgtgttcc

SEQ ID NO: 38109 - DNA, 2529 bp, Homo sapiens
  misc_feature (963)..(963): n is a, c, g, or t
ctcccagggcatagaattactgagttagaagaaataactggtttatttttacataggatgtgatgtctaatattgtactaaaaatgaggatgcttatgctatactccactggtactatccactggatttatttattttttttattttttgagacggagtctcgctctgtcgcccaggctggagcacagtggtgcaaacttggctcactgcaagctctgcctcctgggttcacaccattctcctgcctcggcctccagagtagctgggactacaggtgcccgccatcacacctggctaattttttttgtattttttagtagagacgggggtttcaccgtgttggccaggatgccctcgatcttctgacctcatgatccacccgcctcggcctcccaaaatgctgggattgtaggcgtgagctaccgcacctggctgtttttgtatttagatagagtttaagtgcaaagtaatctgctgatttaaggttgttttaaattcatatctgaggaataaaggatggacaggcaatttccatccctttgatgttccataattctagctatttatatcattcatttgccccttcagcatggattggcttacacctgtaatacgttccagaatagctggatttcttttgttttcccatcggtgattttcatagagtagatgctcaatgacatataatgcagaaaggccaaaaatagaggtaagtaaagctatgaaagaaaagaagaacgaaagaggaagcagagtagtttgattttgtttattgctgcttaaaccagagagatatgttattctggaagggtgatttgcttgtttttacacatatgcagcctgactgttttaggcttggcttcttttttgtttgtttgagatggagtgtcgctcttgttgcccaggctggagtgcagtggcacgatctcggctcactgcaacctccgcctcctgggttcaagngattctcctgcctcagcctccccagtagctgggattacaggtgctcgccaccacacccggctaatttttacatttttagtagaggcggagtttcgccatgttagccaggctggtcttgaactcctggcctcaggtgatccacccacttcagcctcccaaagtgctgggattacaggtgtgagctatggcacccggctggcttatttcttataggctttgggccgttgctaattttccagctgatataatacaatccagctttattcgaaagataagtattctaactcttgttcggtgtttattcaaacttgtgtttgcatgtatttgtttggactataaattttgagactatagtgagtatgtttttgactataatattttaaatggaagatgaaatttaaattagtatttgcttgtttctttttacaataaaataggtagtagctttgcagtttggggagggctgttttccatgattgactgtagtatggttcaagtcagaggaaaggaagatccctggaactccatcacaagtggtgccttaacgggagccatactggcagcaagaaatggaccagtggccatggttgggtcagccgcaatgggtggcattctcctagctttaattgaaggagctggtatcttgttgacaagatttgcctctgcacagtttcccaatggtcctcagtttgcagaagacccctcccagttgccttcaactcagttaccttcctcaccttttggagactatcgacaatatcagtaggacttctttcctaggatttctttaacagaacgagttgtggttcgagaaggatttcagaagatcaagttacagtctgtttttaaaaccataggtgggacagctatggccaataggctataaagagacatttagcacttttttctatttaaaggaacaagcggggaagggtgctaaaagataatacgtttatttattcacacttgaattgcatttgtgatcaaaataaatgtttaaatcgctaaaggaaaatacagtaagtgcttgaaagatgaaggaccaaaaggccaaaaaacagtgaaatatgatcatcatctccttgcggacttctctgcctggttttgtgtgttctgttattcaaacaataaaaagctggtggaacttactctttcttttaagataagttgtagacttcgatgtttcatgctcatgtacttcaaataatgcatgttttatagttagtccctcatcacttgaagtgacttctgagaattatgcagagtcaacatggatcatttcacagtgagatgctttatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagtttagtgtttcttgtatgcttgaaaataaagtatgtactgttttgaatgtgttcc

SEQ ID NO: 38110 - DNA, 494 bp, Homo sapiens
  misc_feature (19)..(19): n is a, c, g, or t
cctggactggaaatgtggncctgtaacccagctgagccgaaagttggagaatgttaaatatctctggtggaacttactctttcttttaagataagttgtagacttcgatgtttcatgctcatgtacttcaaataatgcatgttttatagttagtccctcatcacttgaagtgacttctgagaattatgcagagtcaacatggatcatttcacagtgagatgctttatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagtttagtgtttcttgtatgcttgaaaataaagtatgtactgttttgaatgtgttcc

SEQ ID NO: 38111 - DNA, 370 bp, Homo sapiens
  misc_feature (346)..(346): n is a, c, g, or t
ctgaggaatgagcgacagttcaaggaggagaagcttgcagagcagctcaagcaagctgaggagctcaggcaatataaagtcctggttcactctcaggaacgggagctgacccagttaagggagaagttacgggaagggagagatgcctcccgctcattgaatcagcatctcctcaggatccctggaactccatcacaagtggtgccttaacgggagccatactggcagcaagaaatggaccagtggccatggttgggtcagccgcaatgggtggcattctcctagctttaattgaaggagctggtatcttgttgacaagatttgcctctgcacagtttcccaatgntcaggggtgccgagctcgaatgcg

SEQ ID NO: 38112 - DNA, 1370 bp, Homo sapiens
aagcagtggtatcaacgcagagtgcccattacggccgggggcattggagtcaagatggaggagtacgcgcgagagccttgcccatggcgaattgtggatgactgtggtggggcctttacgatgggtaccattggtggtggtatctttcaagcaatcaaaggttttcgcaattctccagtgggagtaaaccacagactacgagggagtttgacagctattaaaaccagggctccacagttaggaggtagctttgcagtttggggagggctgttttccatgattgactgtagtatggttcaagtcagaggaaaggaagatccctggaactccatcacaagtggtgccttaacgggagccatactggcagcaagaaatggaccagtggccatggttgggtcagccgcaatgggtggcattctcctagctttaattgaaggagctggtatcttgttgacaagatttgcctctgcacagtttcccaatggtcctcagtttgcagaagacccctcccagttgccttcaactcagttaccttcctcaccttttggagactatcgacaatatcagtaggacttctttcctaggatttctttaacagaacgagttgtggttcgagaaggatttcagaagatcaagttacagtctgtttttaaaaccataggtgggacagctatggccaataggctataaagagacatttagcacttttttctatttaaaggaacaagcggggaagggtgctaaaagataatacgtttatttattcacacttgaattgcatttgtgatcaaaataaatgtttaaatcgctaaaggaaaatacagtaagtgcttgaaagatgaaggaccaaaaggccaaaaaacagtgaaatatgatcatcatctccttgcggacttctctgcctggttttgtgtgttctgttattcaaacaataaaaagctggtggaacttactctttcttttaagataagttgtagacttcgatgtttcatgctcatgtacttcaaataatgcatgttttatagttagtccctcatcacttgaagtgacttctgagaattatgcagagtcaacatggatcatttcacagtgagatgctttatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagtttagtgtttcttgtatgcttgaaaataaagtatgtactgttttgaatgtgttcc

SEQ ID NO: 38113 - DNA, 1343 bp, Homo sapiens
aagcagtggtatcaacgcagagtgcccattacggccgggggcattggagtcaagatggaggagtacgcgcgagagccttgcccatggcgaattgtggatgactgtggtggggcctttacgatgggtaccattggtggtggtatctttcaagcaatcaaaggttttcgcaattctccagtgggagtaaaccacagactacgagggagtttgacagctagtagctttgcagtttggggagggctgttttccatgattgactgtagtatggttcaagtcagaggaaaggaagatccctggaactccatcacaagtggtgccttaacgggagccatactggcagcaagaaatggaccagtggccatggttgggtcagccgcaatgggtggcattctcctagctttaattgaaggagctggtatcttgttgacaagatttgcctctgcacagtttcccaatggtcctcagtttgcagaagacccctcccagttgccttcaactcagttaccttcctcaccttttggagactatcgacaatatcagtaggacttctttcctaggatttctttaacagaacgagttgtggttcgagaaggatttcagaagatcaagttacagtctgtttttaaaaccataggtgggacagctatggccaataggctataaagagacatttagcacttttttctatttaaaggaacaagcggggaagggtgctaaaagataatacgtttatttattcacacttgaattgcatttgtgatcaaaataaatgtttaaatcgctaaaggaaaatacagtaagtgcttgaaagatgaaggaccaaaaggccaaaaaacagtgaaatatgatcatcatctccttgcggacttctctgcctggttttgtgtgttctgttattcaaacaataaaaagctggtggaacttactctttcttttaagataagttgtagacttcgatgtttcatgctcatgtacttcaaataatgcatgttttatagttagtccctcatcacttgaagtgacttctgagaattatgcagagtcaacatggatcatttcacagtgagatgctttatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagtttagtgtttcttgtatgcttgaaaataaagtatgtactgttttgaatgtgttcc

SEQ ID NO: 38114 - DNA, 1329 bp, Homo sapiens
aggcgtacgccggattagggatgagtagcgcagatgtgcatagtgatcgggatatagtgaggggactcgacgactgggactatagcggtcggcttttcaagcaaccaaaagtggtcgtaaagttttccagctgggagtaatacacagactcagcgagggacgtcgacaaactagttaaaacgcaggtctgcacagttaggagcgtagctttgcagtttggggagggctgttttccatgattgactgtagtatggttcaagtcagaggaaaggaagatccctggaactccatcacaagtggtgccttaacgggagccatactggcagcaagaaatggaccagtggccatggttgggtcagccgcaatgggtggcattctcctagctttaattgaaggagctggtatcttgttgacaagatttgcctctgcacagtttcccaatggtcctcagtttgcagaagacccctcccagttgccttcaactcagttaccttcctcaccttttggagactatcgacaatatcagtaggacttctttcctaggatttctttaacagaacgagttgtggttcgagaaggatttcagaagatcaagttacagtctgtttttaaaaccataggtgggacagctatggccaataggctataaagagacatttagcacttttttctatttaaaggaacaagcggggaagggtgctaaaagataatacgtttatttattcacacttgaattgcatttgtgatcaaaataaatgtttaaatcgctaaaggaaaatacagtaagtgcttgaaagatgaaggaccaaaaggccaaaaaacagtgaaatatgatcatcatctccttgcggacttctctgcctggttttgtgtgttctgttattcaaacaataaaaagctggtggaacttactctttcttttaagataagttgtagacttcgatgtttcatgctcatgtacttcaaataatgcatgttttatagttagtccctcatcacttgaagtgacttctgagaattatgcagagtcaacatggatcatttcacagtgagatgctttatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagtttagtgtttcttgtatgcttgaaaataaagtatgtactgttttgaatgtgttcc

SEQ ID NO: 38115 - DNA, 1661 bp, Homo sapiens
gttcgtgagtcaggaccgatagcttctgaggtaacataaagctgaagagaatgtgatctgaaggattggggtttcatgcaggagaaacccatcaagccgattgggctcttctccaaggttggttttgggacattgtgcagaggtcattggaaaatttgaaaagattctattcattgtactttgtaaacttggttattcagaagctgggaaaagggaggtgacaaaaaatgtttgtaggttatattcacttacaaaggtatagtcagggttgggcgcaatggctcacgccaataatcccaaagtgctgggattacaggtgtgagctatggcacccggctggcttatttcttataggctttgggccgttgctaattttccagctgatataatacaatccagctttattcgaaagataagtattctaactcttgttcggtgtttattcaaacttgtgtttgcatgtatttgtttggactataaattttgagactatagtgagtatgtttttgactataatattttaaatggaagatgaaatttaaattagtatttgcttgtttctttttacaataaaataggtatatggttcaagtcagaggaaaggaagatccctggaactccatcacaagtggtgccttaacgggagccatactggcagcaagaaatggaccagtggccatggttgggtcagccgcaatgggtggcattctcctagctttaattgaaggagctggtatcttgttgacaagatttgcctctgcacagtttcccaatggtcctcagtttgcagaagacccctcccagttgccttcaactcagttaccttcctcaccttttggagactatcgacaatatcagtaggacttctttcctaggatttctttaacagaacgagttgtggttcgagaaggatttcagaagatcaagttacagtctgtttttaaaaccataggtgggacagctatggccaataggctataaagagacatttagcacttttttctatttaaaggaacaagcggggaagggtgctaaaagataatacgtttatttattcacacttgaattgcatttgtgatcaaaataaatgtttaaatcgctaaaggaaaatacagtaagtgcttgaaagatgaaggaccaaaaggccaaaaaacagtgaaatatgatcatcatctccttgcggacttctctgcctggttttgtgtgttctgttattcaaacaataaaaagctggtggaacttactctttcttttaagataagttgtagacttcgatgtttcatgctcatgtacttcaaataatgcatgttttatagttagtccctcatcacttgaagtgacttctgagaattatgcagagtcaacatggatcatttcacagtgagatgctttatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagtttagtgtttcttgtatgcttgaaaataaagtatgtactgttttgaatgtgttcc

SEQ ID NO: 38116 - DNA, 1299 bp, Homo sapiens
ccagcttgcccggcatcactcgcggcattggagtcaagatggaggagtacgcgcgagagccttgcccatggcgaattgtggatgactgtggtggggcctttacgatgggtaccattggtggtggtatctttcaagcaatcaaaggttttcgcaattctccagtgggagtaaaccacagactacgagggagtttgacagctattaaaaccagggctccacagttaggaggtagctttgcagtttggggagggctgttttccatgattgactgtagtatggttcaagtcagaggaaaggaagatccctggaactccatcacaagtggtgccttaacgggagccatactggcagcaagaaatggaccagtggccatggttgggtcagccgcaatgggtggcattctcctagctttaattgaaggagctggtatcttgttgacaagatttgcctctgcacagtttcccaatggtcctcagtttgcagaagacccctcccagttgccttcaactcagttaccttcctcaccttttggagactatcgacaatatcagtaggacttctttcctaggatttctttaacagaacgagttgtggttcgagaaggatttcagaagatcaagttacagtctgttttttttttctatttaaaggaacaagcggggaagggtgctaaaagataatacgtttatttattcacacttgaattgcatttgtgatcaaaataaatgtttaaatcgctaaaggaaaatacagtaagtgcttgaaagatgaaggaccaaaaggccaaaaaacagtgaaatatgatcatcatctccttgcggacttctctgcctggttttgtgtgttctgttattcaaacaataaaaagctggtggaacttactctttcttttaagataagttgtagacttcgatgtttcatgctcatgtacttcaaataatgcatgttttatagttagtccctcatcacttgaagtgacttctgagaattatgcagagtcaacatggatcatttcacagtgagatgctttatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagtttagtgtttcttgtatgcttgaaaataaagtatgtactgttttgaatgtgttcc

SEQ ID NO: 38117 - DNA, 1325 bp, Homo sapiens
ccagcttgcccggcatcactcgcggcattggagtcaagatggaggagtacgcgcgagagccttgcccatggcgaattgtggatgactgtggtggggcctttacgatgggtaccattggtggtggtatctttcaagcaatcaaaggttttcgcaattctccagtgggagtaaaccacagactacgagggagtttgacagctattaaaaccagggctccacagttaggaggtagctttgcagtttggggagggctgttttccatgattgactgtagtatggttcaagtcagaggaaaggaagatccctggaactccatcacaagtggtgccttaacgggagccatactggcagcaagaaatggaccagtggccatggttgggtcagccgcaatgggtggcattctcctagctttaattgaaggagctggtatcttgttgacaagatttgcctctgcacagtttcccaatgttgccttcaactcagttaccttcctcaccttttggagactatcgacaatatcagtaggacttctttcctaggatttctttaacagaacgagttgtggttcgagaaggatttcagaagatcaagttacagtctgtttttaaaaccataggtgggacagctatggccaataggctataaagagacatttagcacttttttctatttaaaggaacaagcggggaagggtgctaaaagataatacgtttatttattcacacttgaattgcatttgtgatcaaaataaatgtttaaatcgctaaaggaaaatacagtaagtgcttgaaagatgaaggaccaaaaggccaaaaaacagtgaaatatgatcatcatctccttgcggacttctctgcctggttttgtgtgttctgttattcaaacaataaaaagctggtggaacttactctttcttttaagataagttgtagacttcgatgtttcatgctcatgtacttcaaataatgcatgttttatagttagtccctcatcacttgaagtgacttctgagaattatgcagagtcaacatggatcatttcacagtgagatgctttatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagtttagtgtttcttgtatgcttgaaaataaagtatgtactgttttgaatgtgttcc

SEQ ID NO: 38118 - DNA, 1597 bp, Homo sapiens
  misc_feature (963)..(963): n is a, c, g, or t
ctcccagggcatagaattactgagttagaagaaataactggtttatttttacataggatgtgatgtctaatattgtactaaaaatgaggatgcttatgctatactccactggtactatccactggatttatttattttttttattttttgagacggagtctcgctctgtcgcccaggctggagcacagtggtgcaaacttggctcactgcaagctctgcctcctgggttcacaccattctcctgcctcggcctccagagtagctgggactacaggtgcccgccatcacacctggctaattttttttgtattttttagtagagacgggggtttcaccgtgttggccaggatgccctcgatcttctgacctcatgatccacccgcctcggcctcccaaaatgctgggattgtaggcgtgagctaccgcacctggctgtttttgtatttagatagagtttaagtgcaaagtaatctgctgatttaaggttgttttaaattcatatctgaggaataaaggatggacaggcaatttccatccctttgatgttccataattctagctatttatatcattcatttgccccttcagcatggattggcttacacctgtaatacgttccagaatagctggatttcttttgttttcccatcggtgattttcatagagtagatgctcaatgacatataatgcagaaaggccaaaaatagaggtaagtaaagctatgaaagaaaagaagaacgaaagaggaagcagagtagtttgattttgtttattgctgcttaaaccagagagatatgttattctggaagggtgatttgcttgtttttacacatatgcagcctgactgttttaggcttggcttcttttttgtttgtttgagatggagtgtcgctcttgttgcccaggctggagtgcagtggcacgatctcggctcactgcaacctccgcctcctgggttcaagngattctcctgcctcagcctccccagtagctgggattacaggtgctcgccaccacacccggctaatttttacatttttagtagaggcggagtttcgccatgttagccaggctggtcttgaactcctggcctcaggtgatccacccacttcagcctcccaaagtgctgggattacaggtgtgagctatggcacccggctggcttatttcttataggctttgggccgttgctaattttccagctgatataatacaatccagctttattcgaaagataagtattctaactcttgttcggtgtttattcaaacttgtgtttgcatgtatttgtttggactataaattttgagactatagtgagtatgtttttgactataatattttaaatggaagatgaaatttaaattagtatttgcttgtttctttttacaataaaataggtaaaggggtaagctggatttgtagacagttgtttctgtacttcctgggcactatcagaagctcataagagctgttcaacatcatgcgcctgagctgacccaaatcccgctccccatgctggaaagacaggcatatctttgaattcacctgttgagttcagaaatcggtaacactcatgggtagctgaaagtgtcgc

SEQ ID NO: 38119 - DNA, 757 bp, Homo sapiens
aagcagtggtatcaacgcagagtgcccattacggccgggggcattggagtcaagatggaggagtacgcgcgagagccttgcccatggcgaattgtggatgactgtggtggggcctttacgatgggtaccattggtggtggtatctttcaagcaatcaaaggttttcgcaattctccagtgggagtaaaccacagactacgagggagtttgacagctattaaaaccagggctccacagttaggaggtaagcagaattttcattttaactgaactatttttttctgttcctttgaagatggagctatttttatttttagattacaacaattagtgattttagtttggtctaacggtttgtcacaaacatatatccctatagtttcttcttgatttgtagtttgtttgaaaaattaacctgaattatgatacccatttgaaaatcttgtctctgtccttcagacactcggtgatttttttttttttttccttctccagaagaaagacagttatttaaagctcaggtgtgaggccgggcacggggctcacgcctgtaatcccagcactttgggaggccgaggtgggcagatcacctgaggtcaggagtttgagaccagcctgaccaacatggagaaaccccatctctactaaaaatactgaggcaggagaatcacttgaacccgggaggcggaggttgcagtgagccaagatcatgccattgcactccatcctgggcaacaagagcgaaactccgtctcaa

SEQ ID NO: 38120 - DNA, 1665 bp, Homo sapiens
ccagcttgcccggcatcactcgcggcattggagtcaagatggaggagtacgcgcgagagccttgcccatggcgaattgtggatgactgtggtggggcctttacgatgggtaccattggtggtggtatctttcaagcaatcaaaggttttcgcaattctccagtgggagtaaaccacagactacgagggagtttgacagctattaaaaccagggctccacagttaggaggtagctttgcagtttggggagggctgttttccatgattgactgtagtatggttcaagtcagaggaaaggaagatccctggaactccatcacaagtggtgccttaacgggagccatactggcagcaagaaatggaccagtggccatggttgggtcagccgcaatgggtggcattctcctagctttaattgaaggagctggtatcttgttgacaagatttgcctctgcacagtttcccaatggtcctcagtttgcagaagacccctcccagttgccttcaactcagttaccttcctcaccttttggagactatcgacaatatcagtaggacttctttcctaggatttctttaacagaacgagttgtggttcgagaaggatttcagaagatcaagttacagtctgtttttaaaaccataggtgggacagctatggccaataggctataaagagacatttagcacttttttctatttaaaggaacaagcggggaagggtgctaaaagataatacgtttatttattcacacttgaattgcatttgtgatcaaaataaatgtttaaatcgctaaaggaaaatacagtaagtgcttgaaagatgaaggaccaaaaggccaaaaaacagtgaaatatgatcatcatctccttgcggacttctctgcctggttttgtgtgttctgttattcaaacaataaaaagctggtggaacttactctttcttttaagataagttgtagacttcgatgtttcatgctcatgtacttcaaataatgcatgttttatagttagtccctcatcacttgaagtgacttctgagaattatgcagagtcaacatggatcatttcacagtgagatgctttatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagtttagtgtttcttgtatgcttgaaaataaagtatgtactgttttgaatgtgttccaagtcctctgcataaacgatgtattttggggtctggttgggcctggaaaatggatgagcacttcagaacaggtcattttcctgatattggaagtgacatgtggccctataggaggcatgatgttagttaattacacatttgcctacatctgtgggaaatggagaacaaagccatgtgggtactgtaaacacacgtttatcttttggcccaatgccatacatatggtaggcatttaattactgattgtgtttggataatttgggaattttcgactgtggtaaaatatacataaaataatactttttaaccat

SEQ ID NO: 38121 - DNA, 1445 bp, Homo sapiens
aagcagtggtatcaacgcagagtgcccattacggccgggggcattggagtcaagatggaggagtacgcgcgagagccttgcccatggcgaattgtggatgactgtggtggggcctttacgatgggtaccattggtggtggtatctttcaagcaatcaaaggttttcgcaattctccagtgggagtaaaccacagactacgagggagtttgacagctattaaaaccagggctccacagttaggagtaatgaagaagttagtactattattatctcccattttccagatgaggaaatttagttcctgagggttgaggtaatgtagctttgcagtttggggagggctgttttccatgattgactgtagtatggttcaagtcagaggaaaggaagatccctggaactccatcacaagtggtgccttaacgggagccatactggcagcaagaaatggaccagtggccatggttgggtcagccgcaatgggtggcattctcctagctttaattgaaggagctggtatcttgttgacaagatttgcctctgcacagtttcccaatggtcctcagtttgcagaagacccctcccagttgccttcaactcagttaccttcctcaccttttggagactatcgacaatatcagtaggacttctttcctaggatttctttaacagaacgagttgtggttcgagaaggatttcagaagatcaagttacagtctgtttttaaaaccataggtgggacagctatggccaataggctataaagagacatttagcacttttttctatttaaaggaacaagcggggaagggtgctaaaagataatacgtttatttattcacacttgaattgcatttgtgatcaaaataaatgtttaaatcgctaaaggaaaatacagtaagtgcttgaaagatgaaggaccaaaaggccaaaaaacagtgaaatatgatcatcatctccttgcggacttctctgcctggttttgtgtgttctgttattcaaacaataaaaagctggtggaacttactctttcttttaagataagttgtagacttcgatgtttcatgctcatgtacttcaaataatgcatgttttatagttagtccctcatcacttgaagtgacttctgagaattatgcagagtcaacatggatcatttcacagtgagatgctttatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagtttagtgtttcttgtatgcttgaaaataaagtatgtactgttttgaatgtgttcc

SEQ ID NO: 38122 - DNA, 1491 bp, Homo sapiens
aagcagtggtatcaacgcagagtgcccattacggccgggggcattggagtcaagatggaggagtacgcgcgagagccttgcccatggcgaattgtggatgactgtggtggggcctttacgatgggtaccattggtggtggtatctttcaagcaatcaaaggttttcgcaattctccagtgggagtaaaccacagactacgagggagtttgacagctattaaaaccagggctccacagttaggagcatggattggcttacacctgtaatacgttccagaatagctggatttcttttgttttcccatcggtgattttcatagagtagatgctcaatgacatataatgcagaaaggccaaaaatagaggtagctttgcagtttggggagggctgttttccatgattgactgtagtatggttcaagtcagaggaaaggaagatccctggaactccatcacaagtggtgccttaacgggagccatactggcagcaagaaatggaccagtggccatggttgggtcagccgcaatgggtggcattctcctagctttaattgaaggagctggtatcttgttgacaagatttgcctctgcacagtttcccaatggtcctcagtttgcagaagacccctcccagttgccttcaactcagttaccttcctcaccttttggagactatcgacaatatcagtaggacttctttcctaggatttctttaacagaacgagttgtggttcgagaaggatttcagaagatcaagttacagtctgtttttaaaaccataggtgggacagctatggccaataggctataaagagacatttagcacttttttctatttaaaggaacaagcggggaagggtgctaaaagataatacgtttatttattcacacttgaattgcatttgtgatcaaaataaatgtttaaatcgctaaaggaaaatacagtaagtgcttgaaagatgaaggaccaaaaggccaaaaaacagtgaaatatgatcatcatctccttgcggacttctctgcctggttttgtgtgttctgttattcaaacaataaaaagctggtggaacttactctttcttttaagataagttgtagacttcgatgtttcatgctcatgtacttcaaataatgcatgttttatagttagtccctcatcacttgaagtgacttctgagaattatgcagagtcaacatggatcatttcacagtgagatgctttatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagtttagtgtttcttgtatgcttgaaaataaagtatgtactgttttgaatgtgttcc

SEQ ID NO: 38123 - DNA, 1241 bp, Homo sapiens
aagcagtggtatcaacgcagagtgcccattacggccgggggcattggagtcaagatggaggagtacgcgcgagagccttgcccatggcgaattgtggatgactgtggtggggcctttacgatgggtaccattggtggtggtatctttcaagcaatcaaaggttttcgcaattctccagtgggagtaaaccacagactacgagggagtttgacagctattaaaaccagggctccacagttaggagatggaccagtggccatggttgggtcagccgcaatgggtggcattctcctagctttaattgaaggagctggtatcttgttgacaagatttgcctctgcacagtttcccaatggtcctcagtttgcagaagacccctcccagttgccttcaactcagttaccttcctcaccttttggagactatcgacaatatcagtaggacttctttcctaggatttctttaacagaacgagttgtggttcgagaaggatttcagaagatcaagttacagtctgtttttaaaaccataggtgggacagctatggccaataggctataaagagacatttagcacttttttctatttaaaggaacaagcggggaagggtgctaaaagataatacgtttatttattcacacttgaattgcatttgtgatcaaaataaatgtttaaatcgctaaaggaaaatacagtaagtgcttgaaagatgaaggaccaaaaggccaaaaaacagtgaaatatgatcatcatctccttgcggacttctctgcctggttttgtgtgttctgttattcaaacaataaaaagctggtggaacttactctttcttttaagataagttgtagacttcgatgtttcatgctcatgtacttcaaataatgcatgttttatagttagtccctcatcacttgaagtgacttctgagaattatgcagagtcaacatggatcatttcacagtgagatgctttatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagtttagtgtttcttgtatgcttgaaaataaagtatgtactgttttgaatgtgttcc

SEQ ID NO: 38124 - DNA, 782 bp, Homo sapiens
aagcagtggtatcaacgcagagtgcccattacggccgggggcattggagtcaagatggaggagtacgcgcgagagccttggtgagcttcaccgctgtctttgcatttctcttgcccccctgcccactgccctccttctcccttgtccaggctcccaaggtgcaagccagactcaaccgcagcctcgtcgacttgggcctggtaactgggcaatgcggtctttcgcggccagtcggcttcttagccctgtacttagtacctccccggccgcgtgagcctccctctcccaacccagcacccgtgtgaccttgtgatggatggtaaggaggtccagacttgagtttgatagaacctcggaacctcctcccaacgcagggcgtaatcgactttatgcggggccagttataatcccccctgttcgtcgaggtgaccttgggcgcgtccctccgtctcgccttgctcagttcctgcgttgaggaactgaagaataggcatttgagggagtgtcattcttgaggttttacttgtatcatgatatgtgtccacagagtgaagcattttaaatgaatggaacatagattttagccaaggggtctggataagcttctttattgcgtggggccttgttttccttcttggaattctttcttgagggtagagggggacaaaaattacctgggaaataggaagaggtaatagcatgtgttctctgaaaagccatggacagaaattcattgttacatccagcgtttattgagtatgaataaaccagacacatagata

SEQ ID NO: 38125 - DNA, 176 bp, Homo sapiens
tggcatcacaaggacttaatctttcaattattattcatcaagtaatatttagcacatattcattgctgctttctgtcagccaggttaggcaccattaggcactgccaccagagcagtcaacaagatagatatggaatgtagtctagtgggaggaagttaaggcttgcacagctgga

SEQ ID NO: 38126 - DNA, 235 bp, Homo sapiens
gtaatttgctgaccccaatcatggctactgatccagctgtatgaccctggaaaaataagctccctgtgcctcaaattcttcatctgtaaaacaggtatttatttactttatgggattgttatgaggattcaatgagtaaatttgtgtaaaacagaatggggccagtcatatagtaactgctcaatacatgatagctactaccatcactaccaccacctattcacaacttgtctag

SEQ ID NO: 38127 - DNA, 408 bp, Homo sapiens
attgctgcaataatagaattaaattagacatttccttatcattagattttactttataagacaatggagacatcaataatttgttcaataagatttccacattaccacagattttctctatcatattgataacacataggcacaagtaatcaatatttgattaaatcatatttatttaagtggtatcatctgcaaaacagataatttctagtagaaattattatttattattatttctggtactcaataaattttcttcttgatctagaagtaggttttgaatcataaagggtttaacaaggctatctgaaataggacttctaaaacattgatattttgaacaattccttaaattgccagaacttttctgaagagctaatccaccttatgttagttttgtccaagttg

SEQ ID NO: 38128 - DNA, 685 bp, Homo sapiens
aagtttctccaggcatcagacatcaggcactggtgctgccccccagctaacataattcaacacagcccaggcctcccaagtgcccagcaccactgcagatcactgtgtgcccactctgtgcctcaactaaggaagctcctatggatggtcagcagggagagatgccaaacagcaatgagagcaggacatactaagcaaagggctgtcctaagtgtccaacggacaacttcaacctcaccacagtgacatcaacaaggaggggctgctgttatccctgattttcccaactgtcaggaaacgtttcaagaggttaagtcttgcctaagattatgcaggctgtctctgtccagaggcagagagaccatgttcctggaatcagggtatctgagttctaatccacttccagagtggaggctctttctaatagaccctgtactcctcatctagaatttcacatacagagcacaccagccatgcttcagagaataaatgactttctgtctgaacagaacacagtttttgctggttactctgccagatgcattttcaatggcatagaattcaccaaaaaaccttccttgggggggtccaaagagaaaaaaacaaacaagagaacaccaaaccaggaggaaacagccaagctacatgttttaaacccccagagaatcccaaacacaggaagaaa

SEQ ID NO: 38129 - DNA, 705 bp, Homo sapiens
tcagctgttcacggaagtctgatcctgatattctaaacccgaaaagtgataagaatcttgacagagaactaagtccactcccacttgaatgaaactcttacccagggaaaacgaaaactactcctgcctgcctccctcccctcagcccccaggagaaccgtgaaatgcctgctgaattgagagactggaaaagaacagagcaaggcagagcccctgaggtctttgccacaggagagtgatcaacatctgagtcctttgcatccttattttaccctgacttcagttaatgccaccaatgtccagtgtgcacactctcagcacacacacaggcagtgccatgaagtggaggggacagaaaagctttccacaccaaaactcttctccatgcaaacaaaagaatggctgtctcgccttagaaggaagccctggctagggtgatttcaggggttaatcctcaatgaaagagggttaagcagagacttgaagattgctgaggttttatgatggtgaattgcctggggaatccacattcagatcagccttggtatgttttgctgagtgagataagagttggagacttcatgctgggacatgtgcaaaaggaagggaaaaaattaaaaggggaggggaaggaactaggcaactaaaaacagcccactcgtggcaaccaaatctaaacagaaaaacattgcagggagccaaacg

SEQ ID NO: 38130 - DNA, 376 bp, Homo sapiens
tagaggaaaataacacacgacgtgacaccgaatgggaacactgcaacaagacaacatttttaacaacctataaaaccacattatgttggtattaatagtatgcactagccttaatgttaaaaaaaatgacaaagatttttttccccaatatttataaggtttactaaggatagataccactattctcaaagaatgaacagtgaccatgtgaattactgtcctgaaatttaggttgcaattttgaatagctcccaggcatcacgccccaaatttaggagctgtcttccagcaaagactatcagtcaaggtgtggagcatggttagacctaaagttcacgcttttacacttgcaattgtctctctataaaaaccaatc

SEQ ID NO: 38131 - DNA, 754 bp, Homo sapiens
tggaagaaatgatgagaatggtagcaagaacagtatagggtcttggaagggagcagagggtgggaagagcacaggccctggaagggaaagactgggttgtaggaatctactctgccatctaccagctgagtgtccctgaactgccctaagtctcatctgtcaaggggaagcctgcttgccctcccttcccaccttcacaaagaagagaatttatatatgggcactttggaaacttcagaaattacatacatgaaacagaaattacataaatgatcatgaaagccatcagaaactctatccagcaggctcgtgggtgacaatgggaggaaccatagtagagggtggagagtgcatctgagctcattcatggccatcaaaggggcagcgcttactcaggcagggtgtgtgtgacatacttgccgaaagctttccccgagccccagaggctacctggtcacctttaaaggcgttgaggaggggcggctattgtctcagcatgtttaaaaccgcttttagctttctgggaaccctaaaccctctctttgtaaaagtgccacatacatagatctcttctttttgatcaatggcaccgcacaactgacggcattaccgagagcaatatttgtaattacaaatggcacattctggaaatactcttgtaatcttatgtatgggtggtttgcaaaccaactgtaaacattttagaatctacatcctaaggtatagggactatcgtaacttaatttgtagatct

SEQ ID NO: 38132 - DNA, 449 bp, Homo sapiens
atagatagtccattgtgaactgtgtattgtttgcccccaaaagtcacagttgggtgtgcactgcagtactccattatcaaatggaagtggtgtttaccagagtggactcaggcacaccttgaaggaataggaaagttacatgaagaggtgtcccaaatgtgcatggctcttactcttgctacactgctttttctctctcagcttgtacctgaacccacatgagagtaccctatgactatctgagggtgaaaaaactcttgtgtagtttacaaatggatctgaatgatgtgcacgtactgtctgagatgggcagctgcaatactgcagccccacacctacagggtcttcctgaagacaatcgcaaaggaaaatcctcccagtgggcagaacgtggatgagtgcacctggttgttcattttgcctggaagcagagagggctaaagatgggg

SEQ ID NO: 38133 - DNA, 1858 bp, Homo sapiens
tacttccagatgtggttaataatattcagatccctaggttactcaaacaaaactaaaggagagaactatttaggggccatctgctttaaagtttaaggtgttttgttgttgttttagtgcctgtacaaattgaccataaaacccagattgattagtgagtgtggatttgagttgcctaagttgaggctattaaggtacttctttacttaaaagataagtttaaaagactctattcatcagttcatgatgatcttggaaatgctgtttctctactcaaaggatatacccacaggcaggtccatggggacttgctctggtgatctctgctattaaggcaaattccagcctgtttgtgccaagaacagagtcaagtgagagagaatgaagactcagagatgtgcagcactggcttgtatgttgtcaggcagaagccttgttcctttctcaagaaaacttcaggcctatcaagcttggaaggaaatacatttttttatgctgatttgcagcctacaccagctgatgaatatgctaggactttgagagaacacaaagcatggtaagttttggtcaggtggaaaggagcctgacatctgaacataatgcttcctctctcaacatctgggatacttttgaaaattcagtaaggcttaatgtaggaaaaattctttacaggaaaagctaattgatctgtttgtctaacctcatagccactccaaaatatgccttttataatggaaaaaaacagtgaacagagagaagagatttggggataagttagaaggtaccctcaaaactactgccgtaaacctacaggtgggcaaggaggaattactgtagtgtctctggagaaagttcttgaacatccaaatcatctcttttctaagcagtttttcccctaatctcataccttacatcttccagcatcatttgctacatcaatgtcttttcatcctcttcatcagccccattgagctgactccagcttatttttgcactgatttccaccatttccttcccacacccatcctttccctctatttaaagcctccatctcaccctcagtaatgctgctgatttactctcagatgtctcaagtctagcttcctttttgaatccttctcctactccaggggctgtcaaaggcagccttaaagttcagtgactgttaggtggctcaggccatttttcattgggtggtctttggtgtttgcatactgaatttgaattcagtttaaaagcaaactgttggatatgaggaagaaagggatatggccttagccctttttccaatatttggaatatgaaagcatattgtgctttgtgtaaaaaatgttttcttctcctattctgctcttgtctttactgaaggtaaaagtattccttaagtagcttttgcaaatttctagtctgatttccacattcattaagttgatttagcagacatgtaagtcagaagtttcacatatcccttgtatcaaacattttatagggaaacctagtaaatttatgatgcttcattttgggctttccagactatttgagttattcaagatagccataatgttttagtagcgacattcttttattacttctaattgccttgtaaaatgcattgttatggcccggcacggtgggtggatcacaaggtcaggagttcaagaacagcctggccaagatggtgaaatgctgtctctactgaaaatacaaaaattagccaggtgtggtggcaggtgcctgtaatcccagctactcgggaggctgaggcagagaattgcttgaacccgggaggtggaggttgcagtgagctgagatcgcaccactgcactccaccctgggcgacagagtgagactatctcaa

SEQ ID NO: 38134 - DNA, 1369 bp, Homo sapiens
tacttccagatgtggttaataatattcagatccctaggttactcaaacaaaactaaaggagagaactatttaggggccatctgctttaaagtttaaggtgttttgttgttgttttagtgcctgtacaaattgaccataaaacccagattgattagtgagtgtggatttgagttgcctaagttgaggctattaaggtacttctttacttaaaagataagtttaaaagactctattcatcagttcatgatgatcttggaaatgctgtttctctactcaaaggatatacccacaggcaggtccatggggacttgctctggtgatctctgctattaaggcaaattccagcctgtttgtgccaagaacagagtcaagtgagagagaatgaagactcagagatgtgcagcactggcttgtatgttgtcaggcagaagccttgttcctttctcaagaaaacttcaggcctatcaagcttggaaggaaatacatttttttatgctgatttgcagcctacaccagctgatgaatatgctaggactttgagagaacacaaagcatggtaagttttggtcaggtggaaaggagcctgacatctgaacataatgcttcctctctcaacatctgggatacttttgaaaattcagtaaggcttaatgtaggaaaaattctttacaggaaaagctaattgatctgtttgtctaacctcatagccactccaaaatatgccttttataatggaaaaaaacagtgaacagagagaagagatttggggataagttagaaggtaccctcaaaactactgccgtaaacctacaggtgggcaaggaggaattactgtagtgtctctggagaaagttcttgaacatccaaatcatctcttttctaagcagtttttcccctaatctcataccttacatcttccagcatcatttgctacatcaatgtcttttcatcctcttcatcagccccattgagctgactccagcttatttttgcactgatttccaccatttccttcccacctgccttggcctcccaaagtgctgggattacaggtgtaagccaccgcacctggccagtttctatcataaattttaaatgtaagattggaagatacagagagctgtataaaatcataccagtagggtataattagcccaggtagtttaggaataaaattgggttgtatccgagtgccctaacttgacattttgattctccagcaaagaacataggttactaggttactaaccttgccttctcacttgggataaactttttttttttttcttgttgcccaggctggaggttgcagtgagctgagatcgcaccactgcactccaccctgggcgacagagtaagactatctcaa

SEQ ID NO: 38135 - DNA, 1463 bp, Homo sapiens
tacttccagatgtggttaataatattcagatccctaggttactcaaacaaaactaaaggagagaactatttaggggccatctgctttaaagtttaaggtgttttgttgttgttttagtgcctgtacaaattgaccataaaacccagattgattagtgagtgtggatttgagttgcctaagttgaggctattaaggtacttctttacttaaaagataagtttaaaagactctattcatcagttcatgatgatcttggaaatgctgtttctctactcaaaggatatacccacaggcaggtccatggggacttgctctggtgatctctgctattaaggcaaattccagcctgtttgtgccaagaacagagtcaagtgagagagaatgaagactcagagatgtgcagcactggcttgtatgttgtcaggcagaagccttgttcctttctcaagaaaacttcaggcctatcaagcttggaaggaaatacatttttttatgctgatttgcagcctacaccagctgatgaatatgctaggactttgagagaacacaaagcatggtaagttttggtcaggtggaaaggagcctgacatctgaacataatgcttcctctctcaacatctgggatacttttgaaaattcagtaaggcttaatgtaggaaaaattctttacaggaaaagctaattgatctgtttgtctaacctcatagccactccaaaatatgccttttataatggaaaaaaacagtgaacagagagaagagatttggggataagttagaaggtaccctcaaaactactgccgtaaacctacaggtgggcaaggaggaattactgtagtgtctctggagaaagttcttgaacatccaaatcatctcttttctaagcagtttttcccctaatctcataccttacatcttccagcatcatttgctacatcaatgtcttttcatcctcttcatcagccccattgagctgactccagcttatttttgcactgatttccaccatttccttcccacacccatcctttccctctatttaaagcctccatctcaccctcagtaatgctgctgatttactctcagatgtctcaagtctagcttcctttttgaatccttctcctactccaggggctgtcaaaggcagccttaaagttcagtgactgttaggtggctcaggccatttttcattgggtggtctttggtgtttgcatactgaatttgaattcagtttaaaagcaaactgttggatatgaggaagaaagggatatggccttagccctttttccaatatttggaatatgaaagcatattgtgctttgtgtaaaaaatgttttcttctcctattctgctcttgtctttactgaaggtaaaagtattccttaagtagcttttgcaaatttctaggttgtcctccaccatctattaggtgtcttgaactaccatttccctaatgttccatac

SEQ ID NO: 38136 - DNA, 1671 bp, Homo sapiens
tacttccagatgtggttaataatattcagatccctaggttactcaaacaaaactaaaggagagaactatttaggggccatctgctttaaagtttaaggtgttttgttgttgttttagtgcctgtacaaattgaccataaaacccagattgattagtgagtgtggatttgagttgcctaagttgaggctattaaggtacttctttacttaaaagataagtttaaaagactctattcatcagttcatgatgatcttggaaatgctgtttctctactcaaaggatatacccacaggcaggtccatggggacttgctctggtgatctctgctattaaggcaaattccagcctgtttgtgccaagaacagagtcaagtgagagagaatgaagactcagagatgtgcagcactggcttgtatgttgtcaggcagaagccttgttcctttctcaagaaaacttcaggcctatcaagcttggaaggaaatacatttttttatgctgatttgcagcctacaccagctgatgaatatgctaggactttgagagaacacaaagcatggtaagttttggtcaggtggaaaggagcctgacatctgaacataatgcttcctctctcaacatctgggatacttttgaaaattcagtaaggcttaatgtaggaaaaattctttacaggaaaagctaattgatctgtttgtctaacctcatagccactccaaaatatgccttttataatggaaaaaaacagtgaacagagagaagagatttggggataagttagaaggtaccctcaaaactactgccgtaaacctacaggtgggcaaggaggaattactgtagtgtctctggagaaagttcttgaacatccaaatcatctcttttctaagcagtttttcccctaatctcataccttacatcttccagcatcatttgctacatcaatgtcttttcatcctcttcatcagccccattgagctgactccagcttatttttgcactgatttccaccatttccttcccacctgccttggcctcccaaagtgctgggattacaggtgtaagccaccgcacctggccagtttctatcataaattttaaatgtaagattggaagatacagagagctgtataaaatcataccagtagggtataattagcccaggtagtttaggaataaaattgggttgtatccgagtgccctaacttgacattttgattctccagcaaagaacataggttactaggttactaaccttgccttctcacttgggataaactttttttttttttcttgttgcccaggctggagtgcaatagtgagatctcggctcaccgcaacctccgcctcttgggttcaagcgattctcctcccttagcctcccgagtagctggaattacagcctgtgccaccacgcccggcaaaatttgtatttttagtagagacggggtttcaccatgttggtcaggctggtttcaaactcccaacctcaggtgatctgcccacctcagcctcccaacatgctaggattacaggcgtgagccactgcgcccagcccaggataaacattctacctgcctgaaagtaccataagaggcaagtgagtttcttgcatgatgggcttctgcagcttccccctcaagtcacatctacctgttgtatttatttatttattta

SEQ ID NO: 38137 - DNA, 902 bp, Homo sapiens
gtcgtcgacggtaagaggtacacggcgcttatgttaactctggggcatgtggcacgctggaggtatttttgaaaaactttacttctaaaggtaatgaaaacgttgtgattcttttaaagcttatttaaatcatttaagacgcccgtgcttatctgggggaatttacaagtgctgtttgcatgtggaaaacgggattttacttaatgatgggacaaaaaaaagtgttttattcttgctcgtgaaacaatatccagatgtcgtcttgtttgcggtgggtgtacgggggtctagcttgcgggacaagaattactccgacttctctttgcaagggtctgtcagagcaagtttgttgattttcagcgattacatagttctttggctaattctgaagcagttactttcctttgtcaatggggaaatcagtttagattgccgtaaggcgaaacctcgccggaatattttaaaatctgttacctatccttttgagaaaagttatgtaagttttctgtggtaggtgtaaggaatgtaaacgatcctgagtttggaaatattatgaactttgttcatgacccatgattaatatgttttttaatctgtgtataatttcatgagagtttagactatcctcagctaataaatgttatactgggtgaaatttccacattgctcctgtaacgccaacgtttgtctcctctgtacttccgcatttagtcacttgaaggaaataagaatttattgttcaatagacatttcttgacctcataatttcttttaacccacaggttagaaaacttacaacgaatgtagtatttgactgtggaaaactaaagaccaaaaatgtgtaccattaattcaaatgtttagatttatctttttcccctttacctgtaagagggattttg

SEQ ID NO: 38138 - DNA, 358 bp, Homo sapiens
tccttttaattacatttattttaatgctgaatttactcctgtgccataagtttttgtttcttcagtttcttctgggatatctttttcttctgggcaacctcctcttctgatttaggaacaatctgttccttttccgtaaggatcatctcaatgtggcagggagagctcatgtatgggttaatccgaccatgagctctgtgggtccggcggcgcatcttaggtgttttgttcacttggatgtgctcaatgaccagagaatctacatctaaacccttaagttcagcattactctctgcgtttttaagcatgtgcagcaaaaattcagcactctttttgggccaccgaccttgtgtccagc

SEQ ID NO: 38139 - DNA, 370 bp, Homo sapiens
tagggtaggaattttttaaaaatctctataggtcagaaaataaaaccacatgaagcattgagggtagtgctagaggcctgccagttttaggggccatttggctcctgagaagaactgttaataaaagtattaataaggaagaggacacacaaaacacgctcaatgggaaaagccaggcgtgcagctgacctggccctggcctaggacaatgtttacaaggattgaccactgtcaagtcacagagtcacaaattgtctagaatcaatattatgtagactatgttttttaaacctcaatgcaactaaatttaaacttataataaaaaagttagtttcaaaaaacatgtcttgccctaccagctattaaaaca

SEQ ID NO: 38140 - DNA, 1104 bp, Homo sapiens
gggacatgtgagcccctcttcatgttgatgttccattggggaactgcccctcccccattctgggtccagtgtcccatccattgcagaggggcctgaaggtgctgaaggagctcagagccagagcaaaaaggggggacctggcctcacagagaggaaggacaccttttgtttttctgactgtctggcgaaggagatcaagatgattgcacatgcaaacaagttcgtcagtgccaccattgccacctgagtattgggtgctcaagtggaacaggggacttgaggaaggtggggaagcgttggggagtggctggtgaggcaaaccgaagtgggcccacccggacggagagctgggtttctcaacctttgcacgagtgacatcttgggcccgataattctgtgttgtgggggctgacctgtgcactgtaggatgtttagtggcatccctgggctaaatccactggataccaaagctcacacccttcctcccagtcataacagccaaaaatgtcaccagatactgccatgtttccccagggttgagtgggatgggatcactcctacccatctccccgctgagttcctgagtgaggactgcagaatgctgactggacatcaggaatgtgggttgcagtcttcatggctgtatttgttgttgttttcttctgggagtaggagcagagaagatgaagtgaacgatgggttaagtcagatttgttggggatggtgggcccattggtgctgcaatggagggataagggggtccgtgggattgatagtatggcccaagacatgggtgtagttgaaggcaaaagctcatgggtctgagctacatgaagtcacccagggggtggtgtctgaggactggccaagatcaggtccctgcaaacaaggcagctgtatctttaagatgggaagagagtaataaaacctcttcttagggttgttgagagaatcaaaggctttaatacacagaaagcacttaaaatagtgccttactatgcttgtagtaagtgcccaagaagcgctagctattattatcattaggcttttatagctgcaagtaattgaaactaactcatacccatacccgcttaccaaaaaaag

SEQ ID NO: 38141 - DNA, 1744 bp, Homo sapiens
acagtaagttttactatttggctgtcctgaggaaaactatttcatctcagaagtcttagtgatttgaattgttactcctaggttcttcaatgaagtttccatggattattttactcttaaaaataagaattgtaggccaggcccggtggctcacgcgggtaatcccagcactttgggagactgaggtgggtggatccacaaggtcaagagatcgagaccagcctggctaacatggtgaaaccctgcctctactaaaactacaaaaattaggccaggcgtggtggtggctcacgcctgtaatcccagcactctggaaggccgaggcaggcggatcacctgaggtcagaagttcaagaccagcctggccatggtgaaaccctgtctgtactaaaaaatacaaaaaattagctgggcgtggtggtgtgcacctgtcatcccagctactcgggaggctagaggcaggagaatcgcttgaacccaagaggcggaggttgcagtgagccgagatcgcgccattgcactccagcctgggcaacaagagcgaaactctgtctcaaaaaaaaaaaaaaaatacaaaaattagctgggcatggtggtgtgcacctgtagtcccagctacttgggatgctgaggcaagagaatcacttgaacccaggaggcaagggttgcagtaagctgagattgcgccactgctctccagcctggtgacagagcaagactgtctacaaaaaaaaagggaactgtatttgttcagttgagacccccggctagaaagcatttgcttttttatttttattttttattttttgaggtagggtttctctttgtcacccaggctatagtgcagtgacgcaatcatgtctcactgcagtttctaatggccggtcataagcaatcccacccaggttagcctcccgagtagctgggactataggtgcagccaccatgccctgctaatttttctattttttttttgtagagacaaggttttgccatgttgctcagttggtctgaaaatccagggccaagcaatctgcacgctactcccggccttaaaagcttttgtgcctgggcgtggtggctcatgcctgtaacaataaggtcaggatatcgagaccagcctgaccaacatggtgaaaccccatctctactaataaagtacaaaaattagccggatgtagtggcgcgtgcgtgtaatcccagttactcgggaagagaggcaggagaattgcttgaacccgtgagatggaggttgtgatgagccaagatcacaccactgcactccagcctgggtgacagctagactgcgtttccaaaaagaaaaaaaagcttttgtgacaaatcttacaggtggagcgaccaccccaacccccgtacatcctgagagtgtccaaaaaatggaaaagatcgtgtttaggcttacatcttaaaggatgacttacaaccttaattgatattttgtaacagagatgatgttaatagacactgtatctaaatttgtaaagtagaatttgtagaatcatttggggtttcacttcaagtttgccatttgtgattgtcaaacttaatttgactttacaattacatggttttgttgtaaagaatcatccattacactgattttggatcagtctggcatttgtgattggtctggtgatatgttttatgactatgattaaactgtcaggcttctggttgacccttgttttagaaaaattaccctttttgggccaggcgtggtggc

SEQ ID NO: 38142 - DNA, 963 bp, Homo sapiens
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttc

SEQ ID NO: 38143 - DNA, 735 bp, Homo sapiens
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgaccgtgaaagcgggggaccccccccacaaggtgcccaacggactcataaacgacgctcggtaaacccacgggccataccccccctcccccttcg

SEQ ID NO: 38144 - DNA, 1053 bp, Homo sapiens
  misc_feature (1000)..(1000): n is a, c, g, or t
  misc_feature (1007)..(1007): n is a, c, g, or t
  misc_feature (1010)..(1010): n is a, c, g, or t
  misc_feature (1016)..(1016): n is a, c, g, or t
tgctactttgaacaaaaggtccccctgtggtcttttgttcaacattgtacaatgtagaactctgtccaacactaatttattttgtcttgagttttactacaagatgagactgtggatcccgcatgcctgaattcactaaagccaagggtctgtaagccacgctgctcttctgagacttccattcctttctgattggcacttgctgcccacgaagtgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcattaggtatctattagaatttgtaacnggttttnagnaatggnccaggttatttgtccaagggtaatagagagtccgaag

SEQ ID NO: 38145 - DNA, 813 bp, Homo sapiens
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccgaagaaagtaaagtgtaattaaaatggaagtgctaaattcagaatatgaagtatgtgttcatgtttcaggatattctactttggcatgtaattgtgtaaattattaaaatattataattagagctgggtgcagtggcttaatgcctgtaatcccggttatttgggaggttaaagtgggaggatcacttaagcccaggagtttgaggctgcaatgaagctatgattgcaccactgcattccagcctgggctacagagcaagacctcatctcttaaatttaaaaaaaaaaaggagagaaaaaaatgctgggcaccttggcttatgcttgtaatcccagcattttgggaggctgaggtgggccgatcacttgaggcaaatcaccagcctggtcaacatggcaaaaccgtgtctctactaaaaaaaaaaaaaaaaaaaaaa

SEQ ID NO: 38146 - DNA, 456 bp, Homo sapiens
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggacatgtaatttattgaagaactggcgcctaatatcagcaacgtttgctcacgctacttataggcctactcgtgactcc

SEQ ID NO: 38147 - DNA, 632 bp, Homo sapiens
cttaaaggcagagtcgactaatcttttgtcttcactgtgtcccagaagcctagaatagttttcagcacatagtagatacccaataaggttaaattagtggtctcaaatgctaatacattttcaaccttcttatagaaagaacatactggtcgtcttgttataggagatcacaaatcaacatctcacttccgaaccgaagaaagtaaagtgtaattaaaatggaagtgctaaattcagaatatgaagtatgtgttcatgtttcaggatattctactttggcatgtaattgtgtaaattattaaaatattataattagagctgggtgcagtggcttaatgcctgtaatcccggttatttgggaggttaaagtgggaggatcacttaagcccaggagtttgaggctgcaatgaagctatgattgcaccactgcattccagcctgggctacagagcaagacctcatctcttaaatttaaaaaaaaaaaggagagaaaaaaatgctgggcaccttggcttatgcttgtaatcccagcattttgggaggctgaggtgggccgatcacttgaggcaaatcaccagcctggtcaacatggcaaaaccgtgtctctactaaaaaaaaaaaaaaaaaaaaaa

SEQ ID NO: 38148 - DNA, 231 bp, Homo sapiens
  misc_feature (21)..(21): n is a, c, g, or t
tatctagaggatcccgagaanctgctgctccgcgagaatctgtgctggttttgcggctgggaagagcggcgagagggttcggcatttttcgtcgggatccccgcaaggatgagtgctgccagagagtctcacccgcatggggtgaagcgttcagcctccccagacgacgatctgggatctagcacttgggaagcagcaggatctcgcgggagcagcaggaattctcgcggg

SEQ ID NO: 38149 - DNA, 2094 bp, Homo sapiens
  misc_feature (1790)..(1790): n is a, c, g, or t
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggaaaaaaaaaaaaaaaaaaaaaaaaaaaaanaaaaaaaaaaaaaaaaaaaaaaataaaaaaaaagaaaaaacaaaaaaaaaaaaaagaaaaaaaaagacgaagagacaaaaaaaataacgaaaaacaaggcagccgcactcagaaggaacgtggcctaccactgtgtcacgcacagcggggtaatctattaacagtagcaataagtcgggagacagacagaggcgtcactgtcaacggtggctgaggggctgacgatgttcgtctctgcgaggagatggctcgacctctgcgagaggatcggtgcccggtactgtacgtagactctcctcttaca

SEQ ID NO: 38150 - DNA, 1864 bp, Homo sapiens
  misc_feature (1537)..(1537): n is a, c, g, or t
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccataaaaaaaaaaaaaaaaaaaaaaaaaaaanaaaaaaaaagggggggggggccaaaaattccccggggggggcccagttggggttccccggttttttgttacaggggggcgcccttaataggggagggccggatatttaataacagcaagggaacagggggccgcggttaaaaacacgggtcgagcgtggagaacgtggcacgctggagaccctgggggaaaggaaccctactctctgtcggggggcatatctgggcaactcacccaaagagttaaacgtcacggaatatcaacatttcagggtttctggttaccaacggatatggtgcgtaaaattcggtaccagtttcgacatttg

SEQ ID NO: 38151 - DNA, 1759 bp, Homo sapiens
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccataaaaaaaacaatcaaataataatgaaaactggagacgtggaggacgtgctagaaccccgcagccgaggacctgaaaccagacagctaaccgactgcccccgagctgcaccaaaaagtgcaggagatcctgagggctggacggcggggccgcggagccacataattcctcatcggggggacgcatatatacaccttttttattgaacacactccatgttataattatacgaggcggggctttacataccctc

SEQ ID NO: 38152 - DNA, 1995 bp, Homo sapiens
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggtggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggataatggggtccaaattcttaatgtttataagtaacaagttcaaaggctttagtcacacctgtttgtgagctgagctattatacatctacatacttaaaggatgtatttggagtgttacattttttttttttttttttttttgagacggagtctcattctgtccccaggctggagtgcagtggcgcgatctcggctaactgcaacctctgcctcgcaggagaatcacttgaacccaggaagcggaggttgcagtgagccgggatcgccccattgcactccagcc

SEQ ID NO: 38153 - DNA, 1235 bp, Homo sapiens
  misc_feature (1036)..(1036): n is a, c, g, or t
  misc_feature (1041)..(1041): n is a, c, g, or t
  misc_feature (1045)..(1045): n is a, c, g, or t
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctatttacnattcntcanatttccctaaacagtatcgaccggattgtccgcaacaggtactactatcctgatcgcacacgcctatgactactgggcgccacaacaaatgccaccaggctcgcgacgatactcctttggccgacagagctcctgaggtcacaccgatcacacaagggtcagagccaaacagtcatcgcgtcacacatgt

SEQ ID NO: 38154 - DNA, 1968 bp, Homo sapiens
cagattcgcttagcgggacaatcactttgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggataatggggtccaaattcttaatgtttataagtaacaagttcaaaggctttagtcacacctgtttgtgagctgagctattatacatctacatacttaaaggatgtatttggagtgttacattttttttttttttttttttttgagacggagtctcattctgtccccaggctggagtgcagtggcgcgatctcggctaactgcaacctctgcctcgcaggagaatcacttgaacccaggaagcggaggttgcagtgagccgggatcgccccattgcactccagcc

SEQ ID NO: 38155 - DNA, 1978 bp, Homo sapiens
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcactgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggataatggggtccaaattcttaatgtttataagtaacaagttcaaaggctttagtcacacctgtttgtgagctgagctattatacatctacatacttaaaggatgtatttggagtgttacattttttttttttttttttttttgagacggagtctcattctgtccccaggctggagtgcagtggcgcgatctcggctaactgcaacctctgcctcgcaggagaatcacttgaacccaggaagcggaggttgcagtgagccgggatcgccccattgcactccagcc

SEQ ID NO: 38156 - DNA, 2053 bp, Homo sapiens
  misc_feature (60)..(60): n is a, c, g, or t
  misc_feature (163)..(163): n is a, c, g, or t
ggtagtggcgctgctatggcgcccctctgcgcgggattgtaagctgctggtttagcggcntgggaagcacggcgcgcagaggagcggttcgaggcagtttattcagtcgcggatcgcccagtcgaagggatgtatgtgcggtgccatgaatgatgtcgtctancccggtcagtgcgggattgaacgctgggttcatgacacttctccctcgagactgacgaatcttggtgatcgtagcaatttggcgaggcaagcgagcactgtgggtacatgagagagtagagaggacatcacgaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggataatggggtccaaattcttaatgtttataagtaacaagttcaaaggctttagtcacacctgtttgtgagctgagctattatacatctacatacttaaaggatgtatttggagtgttacattttttttttttttttttttttgagacggagtctcattctgtccccaggctggagtgcagtggcgcgatctcggctaactgcaacctctgcctcgcaggagaatcacttgaacccaggaagcggaggttgcagtgagccgggatcgccccattgcactccagcc

SEQ ID NO: 38157 - DNA, 1983 bp, Homo sapiens
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaaggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggataatggggtccaaattcttaatgtttataagtaacaagttcaaaggctttagtcacacctgtttgtgagctgagctattatacatctacatacttaaaggatgtatttggagtgttacattttttttttttttttttttttgagacggagtctcattctgtccccaggctggagtgcagtggcgcgatctcggctaactgcaacctctgcctcgcaggagaatcacttgaacccaggaagcggaggttgcagtgagccgggatcgccccattgcactccagcc

SEQ ID NO: 38158 - DNA, 2521 bp, Homo sapiens
ctggattaaagacaaagtggaacatcctgagattgccacgaaagcactggaaagcctgcttccatttccaacctcctgtctttgtgaaacagggttttctgtagtgacagcagccaaacaagattacagagtagactggacataagcaacacacttagggtgtcactgtctcccatcacccctagatgggaccgtctagttgcagggaaaacaagctcagggctcccactgcttctacattatggtgagttgtacaattatttcattatatattacgatgtgataataataaagtacacaataaatgtaatacacttgaatcatctcaaaaccaccaccacccccctccatggaaaaattgttttccacaaaaccggtgcctggtgccaaaaaggttggaaactgctgctttaaactttaagttgctctgataaacttgataagcaaagaaaggcataaagaagagtcagtacatgaccattttatttagccatttgctgaacagaagtgcctagcttttttcactgttttggttcaaagatagataattctgtttgttagagagtttttattaggtgactagaaaaaaatctttcaggataacatctacttattataagtaagctaaaacatttaatacccaaagtgcttagtaataaatatttatgctatctcaacatcaggcattttattttctattaggtaaccacctatggcataaattctcaaaagtcatagtaaaattagtcacaattagataaatcagccctgagtataatagcatctgtattatgggtttttgtgtaaattattaatttgactgaaacataactaaagtatcctggacatgcagggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggataatggggtccaaattcttaatgtttataagtaacaagttcaaaggctttagtcacacctgtttgtgagctgagctattatacatctacatacttaaaggatgtatttggagtgttacattttttttttttttttttttttgagacggagtctcattctgtccccaggctggagtgcagtggcgcgatctcggctaactgcaacctctgcctcgcaggagaatcacttgaacccaggaagcggaggttgcagtgagccgggatcgccccattgcactccagcc

SEQ ID NO: 38159 - DNA, 2046 bp, Homo sapiens
  misc_feature (22)..(22): n is a, c, g, or t
  misc_feature (29)..(29): n is a, c, g, or t
tccacttcgacggaactctctnacaaacngaagtgcctagcttttttcactgttttggttcaaagatagataattctgtttgttagagagtttttattaggtgactagaaaaaaatctttcaggataacatctacttattataagtaagctaaaacatttaatacccaaagtgcttagtaataaatatttatgctatctcaacatcaggcattttattttctattaggtaaccacctatggcataaattctcaaaagtcatagtaaaattagtcacaattagataaatcagccctgagtataatagcatctgtattatgggtttttgtgtaaattattaatttgactgaaacataactaaagtatcctggacatgcagggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggataatggggtccaaattcttaatgtttataagtaacaagttcaaaggctttagtcacacctgtttgtgagctgagctattatacatctacatacttaaaggatgtatttggagtgttacattttttttttttttttttttttgagacggagtctcattctgtccccaggctggagtgcagtggcgcgatctcggctaactgcaacctctgcctcgcaggagaatcacttgaacccaggaagcggaggttgcagtgagccgggatcgccccattgcactccagcc

SEQ ID NO: 38160 - DNA, 1805 bp, Homo sapiens
cgacttgccatttgctgagattgctctcaaaatctcgtgggaacccgcagccctgagtataatagcatctgtattatgggtttttgtgtaaattattaatttgactgaaacataactaaagtatcctggacatgcagggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggataatggggtccaaattcttaatgtttataagtaacaagttcaaaggctttagtcacacctgtttgtgagctgagctattatacatctacatacttaaaggatgtatttggagtgttacattttttttttttttttttttttgagacggagtctcattctgtccccaggctggagtgcagtggcgcgatctcggctaactgcaacctctgcctcgcaggagaatcacttgaacccaggaagcggaggttgcagtgagccgggatcgccccattgcactccagcc

SEQ ID NO: 38161 - DNA, 1738 bp, Homo sapiens
aagcagtgtatcaacgcatagtgcccattacggccggggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggataatggggtccaaattcttaatgtttataagtaacaagttcaaaggctttagtcacacctgtttgtgagctgagctattatacatctacatacttaaaggatgtatttggagtgttacattttttttttttttttttttttgagacggagtctcattctgtccccaggctggagtgcagtggcgcgatctcggctaactgcaacctctgcctcgcaggagaatcacttgaacccaggaagcggaggttgcagtgagccgggatcgccccattgcactccagcc

SEQ ID NO: 38162 - DNA, 1934 bp, Homo sapiens
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggataatggggtccaaattcttaatgtttataagtaacaagttcaaaggctttagtcacacctgtttgtgagctgagctattatacatctacatacttaaaggatgtatttggagtgttacattttttttttttttttttttttgagacggagtctcattctgtccccaggctggagtgcagtggcgcgatctcggctaactgcaacctctgcctcgcaggagaatcacttgaacccaggaagcggaggttgcagtgagccgggatcgccccattgcactccagcc

SEQ ID NO: 38163 - DNA, 2034 bp, Homo sapiens
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatatgggactgtctagttttaggaaaacaagctcaaagcttccattgagtctacattatgctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccgtcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggataatggggtccaaattcttaatgtttataagtaacaagttcaaaggctttagtcacacctgtttgtgagctgagctattatacatctacatacttaaaggatgtatttggagtgttacattttttttttttttttttttttgagacggagtctcattctgtccccaggctggagtgcagtggcgcgatctcggctaactgcaacctctgcctcgcaggagaatcacttgaacccaggaagcggaggttgcagtgagccgggatcgccccattgcactccagcc

SEQ ID NO: 38164 - DNA, 2453 bp, Homo sapiens
ctggattaaagacaaagtggaacatcctgagattgccacgaaagcactggaaagcctgcttccatttccaacctcctgtctttgtgaaacagggttttctgtagtgacagcagccaaacaagattacagagtagactggacataagcaacacacttagggtgtcactgtctcccatcacccctagatgggaccgtctagttgcagggaaaacaagctcagggctcccactgcttctacattatggtgagttgtacaattatttcattatatattacgatgtgataataataaagtacacaataaatgtaatacacttgaatcatctcaaaaccaccaccacccccctccatggaaaaattgttttccacaaaaccggtgcctggtgccaaaaaggttggaaactgctgctttaaactttaagttgctctgataaacttgataagcaaagaaaggcataaagaagagtcagtacatgaccattttatttagccatttgctgaacagaagtgcctagcttttttcactgttttggttcaaagatagataattctgtttgttagagagtttttattaggtgactagaaaaaaatctttcaggataacatctacttattataagtaagctaaaacatttaatacccaaagtgcttagtaataaatatttatgctatctcaacatcaggcattttattttctattaggtaaccacctatggcataaattctcaaaagtcatagtaaaattagtcacaattagataaatcagccctgagtataatagcatctgtattatgggtttttgtgtaaattattaatttgactgaaacataactaaagtatcctggacatgcaggtcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggataatggggtccaaattcttaatgtttataagtaacaagttcaaaggctttagtcacacctgtttgtgagctgagctattatacatctacatacttaaaggatgtatttggagtgttacattttttttttttttttttttttgagacggagtctcattctgtccccaggctggagtgcagtggcgcgatctcggctaactgcaacctctgcctcgcaggagaatcacttgaacccaggaagcggaggttgcagtgagccgggatcgccccattgcactccagcc

SEQ ID NO: 38165 - DNA, 1869 bp, Homo sapiens
taatgagccgggggattgatgttaaaggtagaacgtcatgatggagcaggtgatgtgctggtctcaaactttgggcctcaagcaatccccctgcctctcagcctcttgagtagctggaatcccagccacaggtatgagccactgggcccagccagacagagctctttcttaaaattctactcaagtcttaaagctgttgttctaatggctacaaagtagagtgtttctaagaccgacagaacttacggtctttctcagattttgtatgggctaatgtttatttttaaaagagcctgttgattgatgttttaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggataatggggtccaaattcttaatgtttataagtaacaagttcaaaggctttagtcacacctgtttgtgagctgagctattatacatctacatacttaaaggatgtatttggagtgttacattttttttttttttttttttttgagacggagtctcattctgtccccaggctggagtgcagtggcgcgatctcggctaactgcaacctctgcctcgcaggagaatcacttgaacccaggaagcggaggttgcagtgagccgggatcgccccattgcactccagcc

SEQ ID NO: 38166 - DNA, 1616 bp, Homo sapiens
tgctactttgaacaaaaggtccccctgtggtcttttgttcaacattgtacaatgtagaactctgtccaacactaatttattttgtcttgagttttactacaagatgagactgtggatcccgcatgcctgaattcactaaagccaagggtctgtaagccacgctgctcttctgagacttccattcctttctgattggcacttgctgcccacgaagtgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggataatggggtccaaattcttaatgtttataagtaacaagttcaaaggctttagtcacacctgtttgtgagctgagctattatacatctacatacttaaaggatgtatttggagtgttacattttttttttttttttttttttgagacggagtctcattctgtccccaggctggagtgcagtggcgcgatctcggctaactgcaacctctgcctcgcaggagaatcacttgaacccaggaagcggaggttgcagtgagccgggatcgccccattgcactccagcc

SEQ ID NO: 38167 - DNA, 1215 bp, Homo sapiens
catgatacgactcgagtcggacccccaatagtagggacgcatgtatacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggataatggggtccaaattcttaatgtttataagtaacaagttcaaaggctttagtcacacctgtttgtgagctgagctattatacatctacatacttaaaggatgtatttggagtgttacattttttttttttttttttttttgagacggagtctcattctgtccccaggctggagtgcagtggcgcgatctcggctaactgcaacctctgcctcgcaggagaatcacttgaacccaggaagcggaggttgcagtgagccgggatcgccccattgcactccagcc

SEQ ID NO: 38168 - DNA, 2141 bp, Homo sapiens
  misc_feature (2111)..(2111): n is a, c, g, or t
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatgtaaataataatggcggagtggctgagggttgaggcctactaaagcctggagtaggccgggaagggtggttggaggaggacgcgcctgaggtggcctgcagcgggagagcccagggaagaaaccagaagaatgagtgggaaatgcctcccttaatctttatgagggtcagaaggtttgaagaggcccacacgctgagagccggagacctgcgtaggaagggggattgaggaaggaaattctgagagggtcgaggagtgaaagagcttagtcaagggatttcgtacgtgcgttttggggggccgatgagagtgctttctcgggcctttgtactcagtatagagacggcaagactctccctgttttgggttctaaatgttcccgtgacaatgtcgaaatgttcgtgcacgtttgtacagatttttcctgcctggatgatttttacaatgtgctgttgagagttaactttagctgcactagtaagggtaaaccgagaacagtattgagccgaaaattgtgccacgggtgtaatttggtactggctctggtggtgaggtctaagacgttgagacctagaagcccattttgatgtcggatattaatacctcgttcttcttacctcgtctccccatcaaatgccgttcccttcctcagccctcacctcataggttttaatagcaaacggtttatcccttaaagtaacccgttaaatatttactgcactgccgggtgttgggaattcggagagaaatatgatgcttattttaggcctttttgtatatttgtcctagctcctagcccagtgtcatggaaacggtaggtaaccagtaaacgtaaaactaggtccttcatacaatggataagtgtcttggcaacgttgatggggaaaattgttggagagagcgcggagaggtcatctttaaggaagatgaagggatatctaggttttttttcggttttgtttaaagtactgtcaatttctgaatacatagagctttaaatttttcgatagtgcatttcaacgctcttcataaaattttaaaagcccactgaatactactttgtagcaaatgagataatgttaagacctacccctctgatgggaggtggggcgaggaccggaatattaaggatctttaaaggaatcgacttcagctctgcagaaagattagcaatcagtaaagatttggggatgaatgggcacctagagaagtttattcttgctctctgttatttctgctactggattttagatcttgttaatatggtaattcaggttttgtcaggaattgatccacacttttgagtaacctggctgccacttaaaaagctgttacattgttttcctcctgatctttaaatgtgacttgattgctaggatatcagacacctgtttggaaatatcttttagcgtgacagaaaactccaggtgatatgaaatttaacaaagttaaagggattaagtcattaagtttacagcttcggaagaggtcggtttaaactagacgaccttgaagacctttcccaatcatataagcgtatctttaagtacctgggttttgtttttgttttgagacaggtgagacagggtctctgtcgcccaggctggagtgcagtggcacgatcgatcagtgctccctgcggcctccacctccctggctcaggtgatcctcctgcttcaaccccctcttcccccaccaccactacagtagctcggactacaggtgtgcaccattacacccgactaattttttgtatttttagtagagaccagattttgccacattgcccaggctggtctccaactactagacccaagcgatctgcccacctcggcctcccaaagtgctggaattacaggtgtgagccacctcgcctcanggataaaacggtacccttggagaaaaaaag

SEQ ID NO: 38169 - DNA, 1811 bp, Homo sapiens
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatgtaaataataatggcggagtggctgagggttgaggcctactaaagcctggagtaggccgggaagggtggttggaggaggacgcgcctgaggtggcctgcagcgggagagcccagggaagaaaccagaagaatgagtgggaaatgcctcccttaatctttatgagggtcagaaggtttgaagaggcccacacgctgagagccggagacctgcgtaggaagggggattgaggaaggaaattctgagagggtcgaggagtgaaagagcttagtcaagggatttcgtacgtgcgttttggggggccgatgagagtgctttctcgggcctttgtactcagtatagagacggcaagactctccctgttttgggttctaaatgttcccgtgacaatgtcgaaatgttcgtgcacgtttgtacagatttttcctgcctggatgatttttacaatgtgctgttgagagttaactttagctgcactagtaagggtaaaccgagaacagtattgagccgaaaattgtgccacgggtgtaatttggtactggctctggtggtgaggtctaagacgttgagacctagaagcccattttgatgtcggatattaatacctcgttcttcttacctcgtctccccatcaaatgccgttcccttcctcagccctcacctcataggttttaatagcaaacggtttatcccttaaagtaacccgttaaatatttactgcactgccgggtgttgggaattcggagagaaatatgatgcttattttaggcctttttgtatatttgtcctagctcctagcccagtgtcatggaaacggtaggtaaccagtaaacgtaaaactaggtccttcatacaatggataagtgtcttggcaacgttgatggggaaaattgttggagagagcgcggagaggtcatctttaaggaagatgaagggatatctaggttttttttcggttttgtttaaagtactgtcaatttctgaatacatagagctttaaatttttcgatagtgcatttcaacgctcttcataaaattttaaaagcccactgaatactactttgtagcaaatgagataatgttaagacctacccctctgatgggaggtggggcgaggaccggaatattaaggatctttaaaggaatcgacttcagctctgcagaaagattagcaatcagtaaagatttggggatgaatgggcacctagagaagtttattcttgctctctgttatttctgctactggattttagatcttgttaatatggtaattcaggttttgtcaggaattgatccacacttttgagtaacctggctgccacttaaaaagctgttacattgttttcctcctgatctttaaatgtgacttgattgctaggatatcagacacctgtttggaaatatcttttagcgtgacagaaaactccaggtgatatgaaatttaacaaagttaaagggattaagtcattaagtttacagcttcggaagaggtcggtttaaactagacgaccttgaagacctttcccaatcatataagcgtatctttaagtaccctgggcgacagagcgagactctgtttaa

SEQ ID NO: 38170 - DNA, 1834 bp, Homo sapiens
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatgtaaataataatggcggagtggctgagggttgaggcctactaaagcctggagtaggccgggaagggtggttggaggaggacgcgcctgaggtggcctgcagcgggagagcccagggaagaaaccagaagaatgagtgggaaatgcctcccttaatctttatgagggtcagaaggtttgaagaggcccacacgctgagagccggagacctgcgtaggaagggggattgaggaaggaaattctgagagggtcgaggagtgaaagagcttagtcaagggatttcgtacgtgcgttttggggggccgatgagagtgctttctcgggcctttgtactcagtatagagacggcaagactctccctgttttgggttctaaatgttcccgtgacaatgtcgaaatgttcgtgcacgtttgtacagatttttcctgcctggatgatttttacaatgtgctgttgagagttaactttagctgcactagtaagggtaaaccgagaacagtattgagccgaaaattgtgccacgggtgtaatttggtactggctctggtggtgaggtctaagacgttgagacctagaagcccattttgatgtcggatattaatacctcgttcttcttacctcgtctccccatcaaatgccgttcccttcctcagccctcacctcataggttttaatagcaaacggtttatcccttaaagtaacccgttaaatatttactgcactgccgggtgttgggaattcggagagaaatatgatgcttattttaggcctttttgtatatttgtcctagctcctagcccagtgtcatggaaacggtaggtaaccagtaaacgtaaaactaggtccttcatacaatggataagtgtcttggcaacgttgatggggaaaattgttggagagagcgcggagaggtcatctttaaggaagatgaagggatatctaggttttttttcggttttgtttaaagtactgtcaatttctgaatacatagagctttaaatttttcgatagtgcatttcaacgctcttcataaaattttaaaagcccactgaatactactttgtagcaaatgagataatgttaagacctacccctctgatgggaggtggggcgaggaccggaatattaaggatctttaaaggaatcgacttcagctctgcagaaagattagcaatcagtaaagatttggggatgaatgggcacctagagaagtttattcttgctctctgttatttctgctactggattttagatcttgttaatatggtaattcaggttttgtcaggaattgatccacacttttgagtaacctggctgccacttaaaaagctgttacattgttttcctcctgatctttaaatgtgacttgattgctaggatatcagacacctgtttggaaatatcttttagcgtgacagaaaactccaggtgatatgaaatttaacaaagttaaagggattaagtcattaagtttacagcttcggaagaggtcggtttaaactagacgaccttgaagacctttcccaatcatataagcgtatctttaagtacctgggttttgtttttgttttgagcctgggcgacagagcgagactctgtttaa

SEQ ID NO: 38171 - DNA, 1232 bp, Homo sapiens
ctggattaaagacaaagtggaacatcctgagattgccacgaaagcactggaaagcctgcttccatttccaacctcctgtctttgtgaaacagggttttctgtagtgacagcagccaaacaagattacagagtagactggacataagcaacacacttagggtgtcactgtctcccatcacccctagatgggaccgtctagttgcagggaaaacaagctcagggctcccactgcttctacattatggtgagttgtacaattatttcattatatattacgatgtgataataataaagtacacaataaatgtaatacacttgaatcatctcaaaaccaccaccacccccctccatggaaaaattgttttccacaaaaccggtgcctggtgccaaaaaggttggaaactgctgctttaaactttaagttgctctgataaacttgataagcaaagaaaggcataaagaagagtcagtacatgaccattttatttagccatttgctgaacagaagtgcctagcttttttcactgttttggttcaaagatagataattctgtttgttagagagtttttattaggtgactagaaaaaaatctttcaggataacatctacttattataagtaagctaaaacatttaatacccaaagtgcttagtaataaatatttatgctatctcaacatcaggcattttattttctattaggtaaccacctatggcataaattctcaaaagtcatagtaaaattagtcacaattagataaatcagccctgagtataatagcatctgtattatgggtttttgtgtaaattattaatttgactgaaacataactaaagtatcctggacatgcagggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaaaaaaaacgtcgagcggccgcttattttgtagtagtagtagtagtagtag

SEQ ID NO: 38172 - DNA, 1022 bp, Homo sapiens
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaaggtaagcatcagatggtgtgcatttttaccttttctgtgaaaatattgccatttttatgtatgctaagtaagaaggactgaatatacttggattccattttcctgttctgtgtgatttcttttggctttgggaaatacatgtggcctaaccaagcacataaaatttatattatttttgagccacttctaggattctctgtccgtatagtttgaagactgtacagagaaaaatttggttcaaggaggctgtataggagaaaagagatgtcaaagtttatgatttgccatatgttggcccagtggtttgatagaatatatttcttctgggtaggttatcttgtgggaacctctggccaaagtgaaaaggctgtcatattttatagctccctccagcccttgaagtagtaaccagaggaatatcctttatcaaaaacttaattttaagactacactttcagagattatttctatagtttgttactagatagagaagtttctctgaatgtgtagaacaccagggggaaagaaaaccttaattttaaaaatgttcaagatactttgaaatgcctgtcagtttggttaacgttaatagaaggtacagttgacccttgagcaatgtgggggttaggggtgctggttctgcaggcagtcagaagtttgcatataacttttgactccccaacaacttaactactaatagcctactg

SEQ ID NO: 38173 - DNA, 305 bp, Homo sapiens
agagacagggtctcactatgttgcccaggctggtctcaaactttgggcctcaagcaatccccctgcctctcagcctcttgagtagctggaatcccagccacaggtatgagccactgggcccagccagacagagctctttcttaaaattctactcaagtcttaaagctgttgttctaatggctacaaagtagagtgtttctaagaccgacagaacttacggtctttctcagattttgtatgggctaatgtttatttttaaaagagcctgttgattgatgttttaggtagaagaccatgatggagaa

SEQ ID NO: 38174 - DNA, 458 bp, Homo sapiens
  misc_feature (243)..(243): n is a, c, g, or t
ccactacagtagctcggactacaggtgtgcaccattacacccgactaattttttgtatttttagtagagaccagattttgccacattgcccaggctggtctccaactactagacccaagcgatctgcccacctcggcctcccaaagtgctggaattacaggtgtgagccacctcgcccagccagtacttaaaaaaaaaatttttttaaccataagtaatgcattcattaaaatacctccaagnctgttgcaagaaaaaaaaaaaaaactagcaggccgggcgcggtggctcattcctgtaatcccaacactttgggaggccaaggcaggcggatcacgaggtcaggagatccaaaccatcctggctaacacagtgaaaccccgcctctactaaaaaaatacaaaaaaattaaccgggcgtggtagcgggcgcctgtagtcccagctactagggaggct

SEQ ID NO: 38175 - DNA, 218 bp, Homo sapiens
ccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgt

SEQ ID NO: 38176 - DNA, 738 bp, Homo sapiens
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgacttgcaccgcaggatctcaacaccccaacacattcacacagcacactctccactcgacctctgctctcacatgtcttcctcactccccccgccctt

SEQ ID NO: 38177 - DNA, 1560 bp, Homo sapiens
tgggccagccagcaaagcttcatctgtatttacagccactccccttggcttgcattaccacctgagctctgcctcctgttggcatttgattcttataagagcgtgaaccctggtgtgaactgcacatgcgagtgatctaggttgcacactccttatgagaatctaatgccagatgatctgtcattgtctcccattaccccccagatgggactgtctagttttaggaaaacaagctcaaagcttccattgagtctacattatggtgagttgtataattatttcattatagattacagtgtagtaataatagaaataaagtgcccaataaatgtaatgcacttgaatcatcctgaaaccatcacatcctccctctcagtggaaaaattgtcttccacgaaactggtccctgatgccagtctggtcctggagtgctgctttaaggtctttgaaaagaagaactggcaggacttaatgttatttccttaaaacattgggattagaagttgtagatgacagttatttatataaacactgaaaatgttttttaatagaagcagaatcaagaaagttggtttttacacaattttttaacttctatacatttttataactagttcatagaccactttcatctgtctcatttgatcatggacagtatgatgtggaaaaaacacaggatggtcagaggatcaaaggaagtcacttagcctctctgtgcctcagtgtcttaagacagtcttttaaaaaggcatctctttatagataaggagttaaaattaagttaaatgtcagatcctggcttacagagcaagtgatttagtgattgtcagaactgaagcttcaccattactttaactatattgagccagaaatagttaagaactaaatggcccataaaaatatatgaggggggtcacatggaaaaaagtagagatttggaacttagggaaccaaaattatgagagcatataagcccttccactaatgagaatttagaagtgcaaatgggtccaggttggtacaaatgctttaactctcatatgcccaggggaaatagtggtttttttaaatattcttttagtcttttacaaataatttttagaaataataatgggagatagtgcaaaacaactttattaggaattttaatgtgaatttaacaatagcaaaccgaaatttatattctttgttttcctgattttgatgtacatatagtcatccttcagtatgctaaatgtgggggattggttccaggacccagccacctctttggcaaatcttgcatactcaagttctgcagccagccctgtggaacctgagaataggaaaaatcagccttccatatacttgggatggatctgcatttggttgaaaaaaatccacttataagggaccttgaagttcaaacctgtctcggatttgcatcatcaaaatacaatacttgaggaatttttgaaacctattgcttacaattttgtaattgtcatccttgctccataattgcaaaacatttttatttttagattataaacttaattagaatgataaattcggtgaata

SEQ ID NO: 38178 - DNA, 1932 bp, Homo sapiens
ggaggtggagaggtaccggcttctccccgggccctcagcttgaagcagggtctcgtgcacggcgctccaggccgtgccccgtaacaacgggtaagaagaaggtactccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggataatggggtccaaattcttaatgtttataagtaacaagttcaaaggctttagtcacacctgtttgtgagctgagctattatacatctacatacttaaaggatgtatttggagtgttacattttttttttttttttttttttgagacggagtctcattctgtccccaggctggagtgcagtggcgcgatctcggctaactgcaacctctgcctcgcaggagaatcacttgaacccaggaagcggaggttgcagtgagccgggatcgccccattgcactccagcc

SEQ ID NO: 38179 - DNA, 1976 bp, Homo sapiens
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccgtcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggataatggggtccaaattcttaatgtttataagtaacaagttcaaaggctttagtcacacctgtttgtgagctgagctattatacatctacatacttaaaggatgtatttggagtgttacattttttttttttttttttttttgagacggagtctcattctgtccccaggctggagtgcagtggcgcgatctcggctaactgcaacctctgcctcgcaggagaatcacttgaacccaggaagcggaggttgcagtgagccgggatcgccccattgcactccagcc

SEQ ID NO: 38180 - DNA, 1966 bp, Homo sapiens
ggctttcttgcggaatcaccatggctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggataatggggtccaaattcttaatgtttataagtaacaagttcaaaggctttagtcacacctgtttgtgagctgagctattatacatctacatacttaaaggatgtatttggagtgttacattttttttttttttttttttttgagacggagtctcattctgtccccaggctggagtgcagtggcgcgatctcggctaactgcaacctctgcctcgcaggagaatcacttgaacccaggaagcggaggttgcagtgagccgggatcgccccattgcactccagcc

SEQ ID NO: 38181 - DNA, 1481 bp, Homo sapiens
  misc_feature (1428)..(1428): n is a, c, g, or t
  misc_feature (1435)..(1435): n is a, c, g, or t
  misc_feature (1438)..(1438): n is a, c, g, or t
  misc_feature (1444)..(1444): n is a, c, g, or t
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcattaggtatctattagaatttgtaacnggttttnagnaatggnccaggttatttgtccaagggtaatagagagtccgaag

SEQ ID NO: 38182 - DNA, 1541 bp, Homo sapiens
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccattaaaaaaaaaagaagacaagcagcagaaacaac

SEQ ID NO: 38183 - DNA, 1508 bp, Homo sapiens
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccat

SEQ ID NO: 38184 - DNA, 2044 bp, Homo sapiens
cggggcggcgaggggccgcaacggtgacgactgtggcagagaaggcccggaggggctctgcgttctgtagtggcgctgcttgggcccgtggcggattgtaagctgctggttttgcggctgggaagagcggcgagagggttcggcatttttcgtcgggatccccgcaaggatgagtgctgccagagagtctcacccgcatggggtgaagcgttcagcctccccagacgacgatctgggatctagcaattgggaggcagcagacttgggtaatgaagagagaaaacaaaagttcttgagacttatgggtgcaggaaagaaagaacatactggtcgtcttgttataggagatcacaaatcaacatctcacttccgaaccggggaagaagacaagaaaattaatgaagaactggagtctcaatatcagcaaagtatggacagtaaattatcaggaagatatcggcgacattgtggacttggcttcagtgaggtagaagaccatgatggagaaggtgatgtggctggagatgatgatgatgacgatgatgattcacctgatcctgaaagtccagatgattctgaaagcgattcagagtcagagaaagaagaatctgctgaagaactccaagctgctgagcaccctgatgaagtggaggatcccaaaaacaaaaaagatgcaaaaagcaattataaaatgatgtttgttaaatccagtggttcataactcccaaacgcttagtctttgtattaaaagtaagccttattgttacaatgcacagtggaggactgcttatagagcacagacctttgtattataatttttaaaaaggcccttttaaataattacaaagagtgtttgctttcaaatgccatgggttacacttttatgggcatgactataaccatttttgtaaagagtaagagttgtataaaataagaaataaatacagtactcaacttcctttcatattagcatcatcaaccctctaattcaccttatgggggaaatgcttctttttgtttgtgatagctattttatcatttccttcatatttttctcttataaaaatgtatttgatactgtgatatgttcacgaaaagtattctttaattattctttgttatagtagagctgttcattatggatatttctgctgccagtcacaatctaaattaattttggcaaaagattgggtacttagtttcctgttactgagttagctctactcttttggaccaaagcaacatgagagcaagtacttttcacacttgttaagatggagttataactgtcatacatttggaatattatgatcccaagtagtctttttataatttggattgtatcgtatgttagatttttgataaaatttggccaatttttacagaagaaattctctgatcatttagttctatctatttagaaatatgtaaaactggatttttttttaagtaatatgtgaccaaagttaattttgtcccaaaggtctaaataaagagcagtttcccatatttggctgtgatacctttatcctcattatctacaaatgaggaacaggcttactgataagaagctgaaacaagaaattctcttcattttatcccagtgctattttattgattaattactaaaaagtattactttctaattttattgctgtttctgttggtgtgagattagaatcatctgactgctattaggtggttgatttgtatagctgattaacacaaattgcattatgagctagtaaatggatctttggataatggggtccaaattcttaatgtttataagtaacaagttcaaaggctttagtcacacctgtttgtgagctgagctattatacatctacatacttaaaggatgtatttggagtgttacattttttttttttttttttttttgagacggagtctcattctgtccccaggctggagtgcagtggcgcgatctcggctaactgcaacctctgcctcgcaggagaatcacttgaacccaggaagcggaggttgcagtgagccgggatcgccccattgcactccagcc

SEQ ID NO: 38185 - DNA, 501 bp, Homo sapiens
gcttcctagtattggctgctatgatttgccgggcactcgctctgaaccaggtcatgggctggacccatcatgtgcatcccctcatttgatctacccagcagcctcaccaactgggggttgctgttgtcaccccacctcatagatgaagaaactgaggctcggagacattaagtgacttgcccaagatcaaacagcttaagagacccagagctgcggcctgaactcatgcccagctagcatcaaacactgtgttcttgcttttttttttttctttttgagacagagtctcactcttttacccaggctggagtgcagtagcagaatctcagctcactgcaacctctgcctcccaggttcaagggattctcctgcttcagcctcctgagtagctgggactacaggcacccacccccatgcccagctaataaaacactgtgttcttaaccactaagaggctcagggtaccccaggtgcctcccagtagagcatgcttcccttttg

SEQ ID NO: 38186 - DNA, 364 bp, Homo sapiens
tgacccagtgcaatcctggtggtggtgataaggatgtttgtgtcacccttcccacaactccagacagctcagcatggaaagagatattccatttgtttgggaaagtaagagaagagaacaaaagtctttgctgggtaatccatgaaattgtactggatcttacctaagaccaccaaagcagtgatgaaggagttttctcttgacccctttgttggatttgcaccaggggtgcctgatatggtttggctgtgtccccaccaaaatctcaacttgaattctatctcccagaactcccatgtgttctgggagggacaaagggggaggtaaatcatggaggtctatctttccagtgctattctcataa

SEQ ID NO: 38187 - DNA, 2316 bp, Homo sapiens
agcgggtctcgctcgctcgcgcagcggcggcagcagaggtcgcgcacagatgcgggttagactggcggggggaggaggcggaggagggaaggaagctgcatgcatgagacccacagactcttgcaagctggatgccctctgtggatgaaagatgtatcatggaatgaacccgagcaatggagatggatttctagagcagcagcagcagcagcagcaacctcagtccccccagagactcttggccgtgatcctgtggtttcagctggcgctgtgcttcggccctgcacagctcacgggcgggttcgatgaccttcaagtgtgtgctgaccccggcattcccgagaatggcttcaggacccccagcggaggggttttctttgaaggctctgtagcccgatttcactgccaagacggattcaagctgaagggcgctacaaagagactgtgtttgaagcattttaatggaaccctaggctggatcccaagtgataattccatctgtgtgcaagaagattgccgtatccctcaaatcgaagatgctgagattcataacaagacatatagacatggagagaagctaatcatcacttgtcatgaaggattcaagatccggtaccccgacctacacaatatggtttcattatgtcgcgatgatggaacgtggaataatctgcccatctgtcaaggacctctagccccccagcataccccggctcaggggacacggacacaggcccaggggagtcagaaacctgtgacagcgtctcaggctcttctgagctgctccaaagtctgtattcacctcccaggtgccaagagagcacccaccctgcttcggacaaccctgacataattgccagcacggcagaggaggtggcatccaccagcccaggcatcgacattgcagatgagattcctctaatggaagaagatccctaatatgggtcaagatccagatgactctcctgctccttcggggaaaggaccttgtatcttggagtgaggtcacagaaggatagagcctgggggcaaaatgtctaacttgtctacatggggaccacagttcacattatgcatctcaggctccacagtgaggctgacaaactgcaatggcagtgcttttaaatgagatttgaggattcaccaagacccatggggaaccggggcagcagggaagccctcgcgtggtcttggatgaggggtgttaaatgtgtatcgtgctgtggaacatgggacaattccacgcacatcccaccgaatcatcacgcatcccattgactggcaagtactccccgccccctctgaaagcatgtcacatcatgtaaatttgcttctaacatctgcttcaaactgtctctggactccaaatttggatgggtcagcctctgcagaaagtttgtgttgagatgctggaagaacagcagagcctcctgcaccctcagcaagggaccagctcccaaaggaaaggtccttgtgtgacatttggagaatcttccttcatccagacaactctactcgaagcaagacgaaagcaggatgtggcagttgcagtgagaaaggaaaggaaagatgggcagactctgctttctggaaatttcttcacaaagtagagctcatgaactctgtgctgtcttctggtaacatatcatcagtgtttgtattcatggtgtggcacatggatccatggcattgggtaaatctggtggtttttacacatggtcagaatgtgttcaaatacatctcatgatggagacagtaaccaaggtaatgttttgtttcagcattttaaaaagactccacttaacatttatctcagaatcatgagcctctctctagttgacaattgtcattgttcccccagccccaaattgaaccatacatttattttccaaaacagaaattgtttctgtaaacatatccgaccttcaaaagaagtgtgaggttggatttttcccccttttatttgtcctaagattccaggaggctggcctcccagcccagatagctcagccacctcacctgcctatcattcctgcattcctactttgagggtctcatcatgcccactgggtgttgttcctaagaaactgattgattaaaaaatttcccaaagtgtcctgaagtgtctcttcaaatacatgttgatctgtggagttgattcctttccttctcttggttttagacaaatgtaaacaaagctctgatccttaaaattgctatgctgatagagtggtgagggctggaagcttgatcaagtcctgtttcttcttgacacagactgattaaaaattaaaagaaaatgacaaaaagaagcgt

SEQ ID NO: 38188 - DNA, 1066 bp, Homo sapiens
agcgggtctcgctcgctcgcgcagcggcggcagcagaggtcgcgcacagatgcgggttagactggcggggggaggaggcggaggagggaaggaagctgcatgcatgagacccacagactcttgcaagctggatgccctctgtggatgaaagatgtatcatggaatgaacccgagcaatggagatggatttctagagcagcagcagcagcagcagcaacctcagtccccccagagactcttggccgtgatcctgtggtttcagctggcgctgtgcttcggccctgcacagctcacgggcgggttcgatgaccttcaagtgtgtgctgaccccggcattcccgagaatggcttcaggacccccagcggaggggttttctttgaaggctctgtagcccgatttcactgccaagacggattcaagctgaagggcgctacaaagagactgtgtttgaagcattttaatggaaccctaggctggatcccaagtgataattccatctgtgtgcaagaagattgccgtatccctcaaatcgaagatgctgagattcataacaagacatatagacatggagagaagctaatcatcacttgtcatgaaggattcaagatccggtaccccgacctacacaatatggtttcattatgtcgcgatgatggaacgtggaataatctgcccatctgtcaaggctgcctgagacctctagcctcttctaatggctatgtaaacatctctgagctccagacctccttcccggtggggactgtgatctcctatcgctgctttcccggatttaaacttgatgggtctgcgtatcttgagtgcttacaaaaccttatctggtcgtccagcccaccccggtgccttgctctggaaggaggaagacctgaacatcttttccctgtcctttatttcccacacatcaggttggcagctgctgtgctttatttttgccctgtgttaaagtcctctcccaccccagcacctacctgttcctcaactagcaccaccacatctctgttctaaatgttgttctcctgcaataaaggacgtttgaattaaacattc

SEQ ID NO: 38189 - DNA, 984 bp, Homo sapiens
  misc_feature (966)..(966): n is a, c, g, or t
  misc_feature (974)..(974): n is a, c, g, or t
agcgggtctcgctcgctcgcgcagcggcggcagcagaggtcgcgcacagatgcgggttagactggcggggggaggaggcggaggagggaaggaagctgcatgcatgagacccacagactcttgcaagctggatgccctctgtggatgaaagatgtatcatggaatgaacccgagcaatggagatggatttctagagcagcagcagcagcagcagcaacctcagtccccccagagactcttggccgtgatcctgtggtttcagctggcgctgtgcttcggccctgcacagctcacgggcgggttcgatgaccttcaagtgtgtgctgaccccggcattcccgagaatggcttcaggacccccagcggaggggttttctttgaaggctctgtagcccgatttcactgccaagacggattcaagctgaagggcgctacaaagagactgtgtttgaagcattttaatggaaccctaggctggatcccaagtgataattccatctgtgtgcaagaagattgccgtatccctcaaatcgaagatgctgagattcataacaagacatatagacatggagagaagctaatcatcacttgtcatgaaggattcaagatccggtaccccgacctacacaatatggtttcattatgtcgcgatgatggaacgtggaataatctgcccatctgtcaaggacctctagccccccagcataccccggctcaggggacacggacacaggcccaggggagtcagaaacctgtgacagcgtctcaggctcttctgagctgctccaaagtctgtattcacctcccaggtgccaagagagcacccaccctgcttcggacaaccctgacataattgccagcacggcagaggaggtggcatccaccagcccaggcatcgacattgcagatgaaaattccttcttaatgggaagaagaatcccttaaaaatggggtcaaggatccccnatgaattnttctggttcc

SEQ ID NO: 38190 - DNA, 1595 bp, Homo sapiens
agcgggtctcgctcgctcgcgcagcggcggcagcagaggtcgcgcacagatgcgggttagactggcggggggaggaggcggaggagggaaggaagctgcatgcatgagacccacagactcttgcaagctggatgccctctgtggatgaaagatgtatcatggaatgaacccgagcaatggagatggatttctagagcagcagcagcagcagcagcaacctcagtccccccagagactcttggccgtgatcctgtggtttcagctggcgctgtgcttcggccctgcacagctcacgggcgggttcgatgaccttcaagtgtgtgctgaccccggcattcccgagaatggcttcaggacccccagcggaggggttttctttgaaggctctgtagcccgatttcactgccaagacggattcaagctgaagggcgctacaaagagactgtgtttgaagcattttaatggaaccctaggctggatcccaagtgataattccatctgtgtgcaagaagattgccgtatccctcaaatcgaagatgctgagattcataacaagacatatagacatggagagaagctaatcatcacttgtcatgaaggattcaagatccggtaccccgacctacacaatatggtttcattatgtcgcgatgatggaacgtggaataatctgcccatctgtcaaggctgcctgagacctctagcctcttctaatggctatgtaaacatctctgagctccagacctccttcccggtggggactgtgatctcctatcgctgctttcccggatttaaacttgatgggtctgcgtatcttgagtgcttacaaaaccttatctggtcgtccagcccaccccggtgccttgctctggaaggtaacacatctcattctttcggaagttgtattttgtattattaaagggaggaagaagatcagtaggaggaagagctgtgaattatgatgggcaataacttttcttctctgaatacatctttctcacttttctccagagcagagatcagctgccgtgaagccatatttacaattagatgtaaaacttgcttccctcatccttaggcttaaagaggagagcagataaaagaaaaagttgcgaacattaaaggttaaattacaaaatattgcaaagttaaatgaaatgtcttcaaaaattaattttctctgcaccaaatgggaacagattgtatcatgtcattaatcttacccctcgttttattgttgtgtcgctgtttcctccatatttccatgcactttatggcttagctgtaaatgttttgctgcaagcacacccttggatgcctgaaagcaagagctctttcctccctgtttttattaaatctctatgactatagattgtgattcacgaaagaccactaatcagtagtatgaagtagtgagaaggacagggcttccactggcggagtcaaggcagtgtctgcaggggaaaagcctgtaaacacttctgctaggcaagttggacatgctggttcagctcttgctttaactcagatcttgaaagtatgcccgaagagaacaagctccaatgtgtttctcagcatctgagtatagtgggtag

SEQ ID NO: 38191 - DNA, 582 bp, Homo sapiens
ggggggcaatgaaactaccctgcatgataacttgaatggtggatacatgtcactacacatttatccaaacccatagaatgtacaacaccaagagtgaaccctaatgtaaactcgactctgagtgataatgatgtatcaatgtaggttcatcagcagtaacaaatgcaccactctggtggggatgtgaataatgggggaggctgtgcatgcgtgggagcagggagtatacgggaacttcctgtaccttctgctcaatattgctgtgaacctaaaactgctcttaaaaataaagtctttattttttttagaaagaaaagggctttaggtttttttttttcaatcaagagaaatagtcttcttatgttttcatatttacacttctttttttcaggaggaagacctgaacatcttttccctgtcctttatttcccacacatcaggttggcagctgctgtgctttatttttgccctgtgttaaagtcctctcccaccccagcacctacctgttcctcaactagcaccaccacatctctgttctaaatgttgttctcctgcaataaaggacgtttgaattaaacattc

SEQ ID NO: 38192 - DNA, 418 bp, Homo sapiens
tctgagtgactgccctgtgtcatcttattatcctcaacttatgtgcatttagtctccgccccctgcctcctgaactccttgccctaggctttgatgccagaaactgtccttggcctttcaatctgtgccatcatttcagcatcagtctgcattcttgaactggaacctagcactaagttcatatcattcatcacttttctgtttggggagcctcttggtctttgtgttattaaaaaagaaaatcttggctgggcacagtggctcaggtctgtaatcccagcactttcagaggccaaggcaggaggatcgcttgagcccaggagttccagatcagcctgggaaatatagtgagactctgtctctaccagaaaccaaaaaaaaaaaaaaaaaacttagccaggtgtggtggcacacaccc

SEQ ID NO: 38193 - DNA, 274 bp, Homo sapiens
tactctcacctagcaatgaagggttgtaagagttctcatttaattcaatctcctcatctgacagataggaaaactgaggaccagaaagggaaagggattgatccaaggttcacctccagggctcagtctcccataatgggagaacttggacaaaatatcaaattagtctactttatttttttttcttcctgttgcactacactgactcttagaaggaattaaatagtgaactcgtaacggggcttgaagtttggaaagcatgcccacacccgtc

SEQ ID NO: 38194 - DNA, 413 bp, Homo sapiens
ccagccagctactgaaccttatgtgtgcctagggccattttgagacaatttgctgaatattaaaagtacaaccaataatgtttctctccacatccacaatagcgcttagaggaagcatctgggattgagccatctcacatctgtctaatcacattcattcaaatgtgatgggcccaactggcctacgtacatggctgcatatcaccatgggtggaaattaaatcagaatttggctcaggagagagatgaagagaaaatgcacgtagataattggctcagataacattctgtttctggaagtcacaaagagtggaaattggaatatgtaaattaaagaaaaacaggtaaggaatttcacatggaacccccaacccaccacaccctgtgtatgttctcattctcattctctctat

SEQ ID NO: 38195 - DNA, 410 bp, Homo sapiens
aaaagaaaagaaaacaagtgtaagcaaggatatgaagaagagaacccttgtacactgttggtgaaaatgaaaatcagtgcaaccactatggaaaatagtatggaggcacctcaaaaaatttaaatcagaaataccatacgatccagcaatcctacttctggatatatattcaaaggagttgaaatcagggtcttgaagagagatctgcacttttacatttattgcagcattattcacaataggcaagatatggaatcaacttcagtgtccatcaatgaataaatggacaacgaaattgtgatattaaaaaaagtatatacttatggtatatgatacaatgttttgatatatgtataccttgtagaaagtctaaatcaagctaactaacaatgaattaccttgtttttatc

SEQ ID NO: 38196 - DNA, 553 bp, Homo sapiens
accagtcgggggttgttggtgttaggtgttgggagggtgaggcattagactttgactctgccttctgagcttgcagcctagtctgggagggaagaggaatgcaccagaatccaaagcaaaaaacataaatggttaagggctagtggagaggaataggaagcaacttgtgaaagaaggtgcaggaaaggcagcaggaccaagctaggcctggacctggatgaatgggtaggatttggccaggtggagggagcaagagggcacaggagggaatggaacagcaagggcaaaagcctggagtgggaagaatgctggtgtgcccagctcacaggctgtggggagaaaggcctggccagacccgaggctactaagtagggggtagtaggaaatgggctcacatgggtaaaaaggaaccatgttacagggcctgaaacaagccctgtggaggagtttaagagttgttgaaggctgggttgggtgtctcacacctgtaatcccagtgctttgggagaccaaggcaggaggatcgcttgagcccaggagtttgagaccagcc

SEQ ID NO: 38197 - DNA, 2965 bp, Homo sapiens
  misc_feature (625)..(625): n is a, c, g, or t
  misc_feature (921)..(921): n is a, c, g, or t
  misc_feature (1028)..(1028): n is a, c, g, or t
  misc_feature (1527)..(1527): n is a, c, g, or t
ctgccactgtggaagccaatccactgaatagcagcatttcccatttgggtattgagggatctataggagttcaccaaactgaggcaagtggaaaggcattctacacagaagaaattaactttgcaaaagtgttgagctggagaagggagtccctggagcagggacttagctccaggtggcagggctgccctgaggtgaggagggaaggaaatgactggaaagtgagttgtgggcaggttgaaaaaagttttgcgtgtagggtttgtacttaatcctgtaggttccaggatgtccttctgtttctcaggcagcaatatgagaggcttgagtaccatcatgaggaagccatttctgagggcaaatcaacaggatctggggagatactggacttgggggtgtagggagaggtcaggactgatggggctcacacccaggtgtttggcgcgggtcatttacatcagttttgaatgtgatacacatacctaccctggcttgctttccctcctcttccagtaaattagaaacttcatgattgttctctgctcagattggctctttggtaggggagggtggaagtgtaactcccttggcagaggggtctggaggagcctagcagggccggtgncctcctcctctgcccccagccctgtctgtggagagcggctcctgctctctcaccctctcctctcccagcacccctccccactctgatcacagcctcagagtccaaatggaacaggccagactgttcaggtggctgttgccacgtctccctgagcccctgctctggagccccgagcaccagcctggagccctggcccagccaaaggcttcacccctggagcaggtgactctgagcgaggccatggcccgagtccctgtttccaggatgtttgtgtccctgtggacctgtctttgtanggctccatgtacttctgggagcctgtatgcttgcgccagtgtgcccactcatgtcacctgtgtctgtccgtgaatatgtgccctatgtctttttggatgtctctgtntgttcgcatgtgtttgcacaagtatgaggtgggcctcttaggctctctcagggcccccatggttatcttgtcataaatggcagtcaggttagggtgctctgaaaggggctaagtgcgaggaggggccgagccagggtatagcccttgcccctgggggcctgtggtctgagggaagatccagacctcaccaatgtggcaaactcagcagaaatacaagttcccagatttgagaaacctctttgggacccctcatgctgcacttggcctcggtgttggggacccagggtcagatcagaccctgcccctaccttccagagccagcccaggcagtcagctatgcagttggacactagcgtggctgctgaatggatggctgtacagggcacaagaaaacaggtgaaggcatgcccaggcctgctggagagtcagggagggcttcctacaggaggagtttgagtggtgactacagagctgtttgggggatgagaggaaggagatngagaacagagctgggcttggcgtcagatggcactggcgggtttgaagaaaagggagatggggagggtgattctcatcttccaggcctggaggttggagggaatggaggtgtcttgaaatgcgtggaaaggaagaggagttcccatttggccactgtgggtatgagcttcctgtgggatgtccaggtgcagatgaccagagggttgcaggatacttgagtcttgaacttggtccagccagagatgggtggttgaaaccgtggggtggatgatactgccaagaaggatgtgatgggcaagggagggaaagggggcttaggattgagagcagcagcattcaggcctgggcagagaggatccagcgaaggggctggtgaggtggggccagaaagggggacaaacaaccaggcaatcagtggctgaggatggagaagtgccccatggatttacccacacagaagccattgttgaacttggtggcagcagagggtaatgggttttgcagtgggtgggacgaagtggagatatgggtgcagacaactctcagaagtttggatgagaagggaggagagaaagggaggagagctgggaaggggtgcaggggatgaactgcatgagccccaggcctgctcactgctgattggaaggagccagaagaggagagaggagaggccagagggaggagggagggtgaagtggtcatctgtagacacccgcctagtcctctgccaggggcagggagggtgcctggagggggtggtgctttctggaggaatggctgtggagggctgagggtgaaggaggtgcagtgctgggcaggcagccttcagtcttgccctgacctctgccagtcttcatatctgcagggtatggtggtagcagccaccctggggtgtggggaggatcccaggaggcagaagctccactagctcagagcatcctcgtaaaccaggttcaggtcaggagttgaagctcagggctgggcggggttggcctctggtggtttttgcatcttcagtgctcaccaaagctgtttcgtagacactgcaaacaagaaaggcctaggaaggtcaggacgtggatggcctgcttccaaagaggccacacccaaccccatctctgggcccagctctcaattacagggaagttcttcctttgggtctagcctaagtctttcccgctgtgtgttcccttctggtgaacttgttcaaccctgctccatggagccaagcctatcagctggccacttggagtggcggtcagtatttttacaacttgttttcatgaagatgatttgaagtctccttgcattcccagaatgtcagacccgccctgattcacaaggattgaccaaaacagggtctgagccaaccagaggaatttgaagacttagtcatcccccttggatcatctgcacattcttctcctttccttccagtt

SEQ ID NO: 38198 - DNA, 214 bp, Homo sapiens
gactctgagaactggaccatcccaaggctgtagctttcttcaagcctggcaggctctgtcgtggtgaagagtctgaaggctttttcttttccagtaacacaggaggtgattgaatggaaggagtggccagtcactctttggcgtccaggatccaagaagaaacagatgaggaggaaggaggataaacaacttctggacaaagcgagtaagtgaa

SEQ ID NO: 38199 - DNA, 299 bp, Homo sapiens
ctcttagtttgcagttagctgagaaataggtgttctgcttccttacatggtgactgttgagtagataaaacacagaggtctaccccccctgccccaatatacctgtttagtagtgaagcaatttacatagtaactccatgtgggggtgtacttttactctctactctcactacacatccaagaagcctcccctagacttttggttaatgtgttgttgcaaaaatatgaaatgtaatgtactttctgacacatgtagggacatacttagaactagcattgcccagagtttatcaagcgta

SEQ ID NO: 38200 - DNA, 746 bp, Homo sapiens
agggttctaaatcttacagagtaaaaaaattattgaagcaaaaacaaatgtataaaaagtacatataaacgtacagtttgatgaattttcataaattcaataggctcatggaactagcactcagattaaaaaaatacagttatgagtacccctgaagtcctccctaacaccccatcagccattacctactcaccttcttgcccaagataaccattattttgatttcttacagcatattttttgcttatttttgaactttacataaatggaattattggtcatgtgtctagcttctttcacttgaaattatgtttgtgagattcatttatattgttgtgtgtactattattgtagatcatttattctcattggtgtatagaattccactgtgtgaatattccacaatatatttattccagtcttggtgggcatttgggtagattccagtttggaacaattataaataaagctttgatgaatattctaaagacaaaacaacacagcaaaacacagaaaaaacaatgtgtgggccgcaccggccccaaaaaaagttccaaacaccacaccgtgggggcgcgcgcccccagagtaacgcggcccgtggccaaagcgggcccaaaagaaaccggcccagaacacgtcgcggggccccaccaaaaaaaacgccgggaaccggggtctgcaccacccatggggccgaggccacggccaccaccggaccacgaccgaaaaaggccccggagaat

SEQ ID NO: 38201 - DNA, 332 bp, Homo sapiens
ggggccttggagatgctcttgactgggaacctcagtccttctgaacatggcctagtcctctctgcatggcccctcattctctggggcctctttctcctgtggcttctctctgtagcagaacagcctgatttctttgcatgtggcaggaacctgcctctgcaaagtggaagctgcaagatcacgtcaagcccagaaggtcattggtgccacattctgttggtcagaacaaacctcatggccagtccagattcagggggagggaaacataacccaccttttgatagactatttccaaagacagccacagcaatctcctatcaaaagtcgacgcg

SEQ ID NO: 38202 - DNA, 373 bp, Homo sapiens
ttttttggctagtcatggtcttttgagataccacatgaactttaggatagtcttttttacttctgaaaaaaagcctttggaattttaatagagatttcaaggaatctgtagattacagtacaaatattttaacactattaagtctttcaacccatgatcacgggatgtcttcccctttatttgtgtcttgtttaatttttttcagcaatgttttagaattctcagtgtatacgtttttttcctcctggagcaactatatctataagtatgctattctttttgatatcattgtaaattatatttgttttcttaataatttccttgtcaggtattttgctgataatgtacagaaatgcaactaatttttgtgtgt

SEQ ID NO: 38203 - DNA, 347 bp, Homo sapiens
catccttcccctacccccaccttccctcccttctcctggagcccaggaaaaaaccatctgctgagttggctttcagaagatttttttttaaataccaatttccctttgttccgaggcaacctccaatcagggctggtgtctgctgggtttggcgaaaggctggtattgtgtttcatgctcccggaggaaaggttgtccacttgcttttctttttgattcgattccctgccattctgcaggagagtcagtggttgcagctgctgctgtcagctataagtgggggatccccttgtttaagaccctatacgttaatcccttggcaggaggagaaaaacaaaacaaaacaa

SEQ ID NO: 38204 - DNA, 375 bp, Homo sapiens
acaaagtaggatgatagatgttaaataccaagcactccagataccctggggtcaaatctggctctatcagttactactgctgatgtgtcagtgtgcataacatgcttggaaccgtgcctggcacataagtgtctgcgaaataaaatgaatcaatatgttaaaggtaaacaaactacgtgtttcaattaaaagatattctcagaatggaccaaaaaattaaaaacccaatacacaaagcaatgtatgctatctacaaaagacacatctaacttataagctctagaaatgtagaagtaaaaaaatgggagagaagatataccatgcaagggccaatcaaaaggaaactggtgttacaaggctggcttttgggctgaa

SEQ ID NO: 38205 - DNA, 684 bp, Homo sapiens
agaggcccacagcagggagtgagatgagaccaggtttaaacgtcactttcccctaagtccttgttcattcacagcttccttcagtagctctgaccagctttctcagcacctgccgaccgacaaaccaaccaaccaatggaggctggtgctgggggtggagatggccaagagccggtggtgagaagtgagggagaatggggaagaaggggctccacagagggcacttgatccgggacggctttccggaggaggtgatttcctaggcctaaggggctccgggcagaggggccagcatgagggaagctcggaggtgggggagcatggattggaggagagaataagcagttgcttgctggggtgtcataagatgcggcagtgcactcaacgctacaggagcaggcacgggcctttttcaccagcctaaggattttggaatgactcttctatcagccaacagtttccaaccttatttatgtacttgtttctttgattccagcgatgcaggagagatgatattcagacagccgacttctgctgtgggtgtgccccaggttataaatcatttccatcaggctagctggagtcccggcccttcctttccactgaagaaagcaaatcagagtaccagatagcgagagtgatattatcacaggatagccttgaaactgccataacaaaaaaaaa

SEQ ID NO: 38206 - DNA, 1546 bp, Homo sapiens
cctccaaaacaccctaacagttaaatttcctcagtccagaagctgattgcagtccagttcgcaattggccaggctctagtttatataggacctgaggctccacccatgtgcaggcaccgcccccgtggcgtcacgagcgagcaatggcgtcattggaacgacatgagcatgcgcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgagctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaa

SEQ ID NO: 38207 - DNA, 973 bp, Homo sapiens
tgcaggctggtaccggtccgaagcgttgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcaccttccagagcccgggggaactggggcctggaggtgagactgccagctgcggcgtgaaaaaggggggatcgtggaatctggcctacaggggacggctcgagagaggacggggggag

SEQ ID NO: 38208 - DNA, 2379 bp, Homo sapiens
cctccaaaacaccctaacagttaaatttcctcagtccagaagctgattgcagtccagttcgcaattggccaggctctagtttatataggacctgaggctccacccatgtgcaggcaccgcccccgtggcgtcacgagcgagcaatggcgtcattggaacgacatgagcatgcgcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcaggtgcctgggtgggctggagttggggagctgcagtcgggggcccggggtcacggagggtactttgcaggtcctgggcctgacctcgctttccacctgctctcccacagcgagatgctccttgggccagtgccccccagcttcgccttcttgccgaagcacaaggccaacgcgtacaagtagcctcaggctttcccaggggcaccctggggcgaggagagtacaataaattttattcttttaaaa

SEQ ID NO: 38209 - DNA, 2079 bp, Homo sapiens
  misc_feature (11)..(11): n is a, c, g, or t
  misc_feature (40)..(40): n is a, c, g, or t
  misc_feature (47)..(47): n is a, c, g, or t
gggaaagaaanagaacttaggctaggtcgaggctggtgtnaatcggncgagtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaa

SEQ ID NO: 38210 - DNA, 2173 bp, Homo sapiens
  misc_feature (2172)..(2172): n is a, c, g, or t
cctccaaaacaccctaacagttaaatttcctcagtccagaagctgattgcagtccagttcgcaattggccaggctctagtttatataggacctgaggctccacccatgtgcaggcaccgcccccgtggcgtcacgagcgagcaatggcgtcattggaacgacatgagcatgcgcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcaatgctccttgtcgtgcattgaatcctctaagtanc

SEQ ID NO: 38211 - DNA, 2396 bp, Homo sapiens
cctccaaaacaccctaacagttaaatttcctcagtccagaagctgattgcagtccagttcgcaattggccaggctctagtttatataggacctgaggctccacccatgtgcaggcaccgcccccgtggcgtcacgagcgagcaatggcgtcattggaacgacatgagcatgcgcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtacggccagccacatcctcgcactggctcccaaacaactcccccgggccctgtctcccaccacctcccaccgtctcccaccacctcccaccatctcccaccacctcccaccaccgtcctgtaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaa

SEQ ID NO: 38212 - DNA, 2499 bp, Homo sapiens
cctccaaaacaccctaacagttaaatttcctcagtccagaagctgattgcagtccagttcgcaattggccaggctctagtttatataggacctgaggctccacccatgtgcaggcaccgcccccgtggcgtcacgagcgagcaatggcgtcattggaacgacatgagcatgcgcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaaggtagcggccctggacgtgtgcctcggtttccccatctgggcagggaggcactgacccagccggcgatgtctcggtggagggtcaggggtttgggctcaagtgtggccctggagtccctgcctttcctgcaggtcggcgtctcctggtgggggcctccgggcagcaggggtgaggggtcttgggtcagcccacgtcctgccctccctccacccgcctgtctcttccagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaa

SEQ ID NO: 38213 - DNA, 2552 bp, Homo sapiens
cctccaaaacaccctaacagttaaatttcctcagtccagaagctgattgcagtccagttcgcaattggccaggctctagtttatataggacctgaggctccacccatgtgcaggcaccgcccccgtggcgtcacgagcgagcaatggcgtcattggaacgacatgagcatgcgcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgcctggctctcttggtctcttcctctctgcgtctcactctctgcctcctaccctgcgtggcggcttctcccccagctccacggccgctctcgggagcagcgctacaccaagctagccgactggcagtacatcgaggagtgcgtgcaggccgccagccccatgcccctgttcggtgggtgttccgggaagccacctccctctcccctaccacccttggtcactcacacctctgggctgttcgccttcccacttgggaccccctcgtaccaccctgatgggagccactgggtcagccaaaactcctgaagggctggtgagcagaactccagggtcccacctgcccatgtctccctgagaccccagcctctgtctcctcaggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaa

SEQ ID NO: 38214 - DNA, 2175 bp, Homo sapiens
cctccaaaacaccctaacagttaaatttcctcagtccagaagctgattgcagtccagttcgcaattggccaggctctagtttatataggacctgaggctccacccatgtgcaggcaccgcccccgtggcgtcacgagcgagcaatggcgtcattggaacgacatgagcatgcgcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaa

SEQ ID NO: 38215 - DNA, 2156 bp, Homo sapiens
cctccaaaacaccctaacagttaaatttcctcagtccagaagctgattgcagtccagttcgcaattggccaggctctagtttatataggacctgaggctccacccatgtgcaggcaccgcccccgtggcgtcacgagcgagcaatggcgtcattggaacgacatgagcatgcgcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagccgactggcagtacatcgaggagtgcgtgcaggccgccagccccatgcccctgttcggtgggtgttccgggaagccacctccctctcccctaccacccttggtcactcacacctctgggctgttcgccttcccacttgggaccccctcgtaccaccctgatgggagccactgggtcagccaaaactcctgaagggctggtgagcagaactccagggtcccacctgcccatgtctccctgagaccccagcctctgtctcctcaggaaatggggacatcttgtcatttgaggatgccaaccgcgccatgcagactggtgtcaccgggatcatgattgcccggtaagtgcccagggatgttagagatccagcttcatgcacagcagcagtgccctgaacccaacacgccgtcacccacccctgttctgtggtgggctgttggtcccaagatgggaggagcagagagcgatgtca

SEQ ID NO: 38216 - DNA, 1189 bp, Homo sapiens
cctccaaaacaccctaacagttaaatttcctcagtccagaagctgattgcagtccagttcgcaattggccaggctctagtttatataggacctgaggctccacccatgtgcaggcaccgcccccgtggcgtcacgagcgagcaatggcgtcattggaacgacatgagcatgcgcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcaccttccagagcccgggggaactggggcctggaggtgagactgccagctgcggcgtgaaaaaggggggatcgtggaatctggcctacaggggacggctcgagagaggacggggggag

SEQ ID NO: 38217 - DNA, 1174 bp, Homo sapiens
cctccaaaacaccctaacagttaaatttcctcagtccagaagctgattgcagtccagttcgcaattggccaggctctagtttatataggacctgaggctccacccatgtgcaggcaccgcccccgtggcgtcacgagcgagcaatggcgtcattggaacgacatgagcatgcgcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctgctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaa

SEQ ID NO: 38218 - DNA, 684 bp, Homo sapiens
gccgagatcttaccactgcaccccagcctgggcgacagagccagactccgtctcagaaaaaacaaaagaaagtcctgtgctttgaaggttgtgtgcatgcagctgggaggcttactaggcttgtaggttttgtggtctgggctccggctcaggccaggccatggaagcagaggccacacgatcccaggcaggctggtggctgggcccactgatcgtcacccgtcccacagtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaa

SEQ ID NO: 38219 - DNA, 518 bp, Homo sapiens
ctactacctgggccgcgactacctggagacgctgatggccagccagaaggcagccgactggatccgcatcaggtgcctgggtgggctggagttggggagctgcagtcgggggcccggggtcacggagggtactttgcaggtcctgggcctgacctcgctttccacctgctctcccacagcgagatgctccttgggccagtgccccccagcttcgccttcttgccgaagcacaaggccaacgcgtacaagtagcctcaggctttcccaggggcaccctggggcgaggagagtacaataaattttattcttttaaaatccaggcctttctgtgaccctgaagcagcccctcctcggcccccaccttccccaaacctcttagctgcctccatgggccctgccccaagctgggtgctgctggtgcccagagaggccttgacccccaagaaggtagcgggttgaggacccggggggcctcagcctgtgtgggtgtggatcagggcagcctgcctggaggaggc

SEQ ID NO: 38220 - DNA, 2272 bp, Homo sapiens
cctccaaaacaccctaacagttaaatttcctcagtccagaagctgattgcagtccagttcgcaattggccaggctctagtttatataggacctgaggctccacccatgtgcaggcaccgcccccgtggcgtcacgagcgagcaatggcgtcattggaacgacatgagcatgcgcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaa

SEQ ID NO: 38221 - DNA, 2590 bp, Homo sapiens
cctccaaaacaccctaacagttaaatttcctcagtccagaagctgattgcagtccagttcgcaattggccaggctctagtttatataggacctgaggctccacccatgtgcaggcaccgcccccgtggcgtcacgagcgagcaatggcgtcattggaacgacatgagcatgcgcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaaaaaaaaaaaaaaaaaactcgagactagttcctcgtgccgaattcggcacgagcttggagcttccacaaacttaaaaccatgaaacatctattattgctactattgtgtgtttttctagttaagtcccaaggtgtcaacgacaatgaggagggtttcttcagtgcccgtggtcatcgaccccttgacaagaagagagaagaggctcccagcctgaggccttgcccaccggccatcagtggaagtggctatcgggctcgttcagccaaagcagctgccacttcaaaagaaagtagaaggtgtctacaagatgcaagtggt

SEQ ID NO: 38222 - DNA, 2178 bp, Homo sapiens
  misc_feature (2138)..(2138): n is a, c, g, or t
cctccaaaacaccctaacagttaaatttcctcagtccagaagctgattgcagtccagttcgcaattggccaggctctagtttatataggacctgaggctccacccatgtgcaggcaccgcccccgtggcgtcacgagcgagcaatggcgtcattggaacgacatgagcatgcgcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcnaatgctccttgtcgtgcgattgggatactctaggtcaccc

SEQ ID NO: 38223 - DNA, 2487 bp, Homo sapiens
cctccaaaacaccctaacagttaaatttcctcagtccagaagctgattgcagtccagttcgcaattggccaggctctagtttatataggacctgaggctccacccatgtgcaggcaccgcccccgtggcgtcacgagcgagcaatggcgtcattggaacgacatgagcatgcgcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacggtgggtcttgggacgcctcgggcattggggcctcgcggtcgaccccgcgtcccttcctaatggctcctctcctcccatccctccctcttcacctccacacctccctctgtctccgcctgtgtctctctctgtctctctcagcctggctctcttggtctcttcctctctgcgtctcactctctgcctcctaccctgcgtggcggcttctcccccagctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaa

SEQ ID NO: 38224 - DNA, 2346 bp, Homo sapiens
cctccaaaacaccctaacagttaaatttcctcagtccagaagctgattgcagtccagttcgcaattggccaggctctagtttatataggacctgaggctccacccatgtgcaggcaccgcccccgtggcgtcacgagcgagcaatggcgtcattggaacgacatgagcatgcgcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgcctggctctcttggtctcttcctctctgcgtctcactctctgcctcctaccctgcgtggcggcttctcccccagctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaa

SEQ ID NO: 38225 - DNA, 2623 bp, Homo sapiens
cctccaaaacaccctaacagttaaatttcctcagtccagaagctgattgcagtccagttcgcaattggccaggctctagtttatataggacctgaggctccacccatgtgcaggcaccgcccccgtggcgtcacgagcgagcaatggcgtcattggaacgacatgagcatgcgcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaaggtagcggccctggacgtgtgcctcggtttccccatctgggcagggaggcactgacccagccggcgatgtctcggtggagggtcaggggtttgggctcaagtgtggccctggagtccctgcctttcctgcaggtcggcgtctcctggtgggggcctccgggcagcaggggtgaggggtcttgggtcagcccacgtcctgccctccctccacccgcctgtctcttccagggtgggggctgtgccctcatgaatcgctccaccaagttccagcagatcgtccgtggcatgaaccaggtacggccagccacatcctcgcactggctcccaaacaactcccccgggccctgtctcccaccacctcccaccgtctcccaccacctcccaccatctcccaccacctcccaccaccgtcctgtaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaa

SEQ ID NO: 38226 - DNA, 2054 bp, Homo sapiens
ggctgagggcgagaagccaccggctcttcattccgggccgttcttccgcctgcagggtggtcagcggaggtacctgagatcgtgcacgttggggcctgtcacatgcgcgaaggacaccacgtgcatgctagggcagatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctggtgcaggaggagttggcggcccgcgggacccagcccccgtccatccgcaacggcctggacaaagccctgcagcagcagctgcggaagcgcgaggtccgcttcgagcgagctgagcaggccctgcgccggttcagccagggccccacacccgctgccgctgtccccgagggcacggcagccgagggcgctcccaggcaggaaaactgtggtgcccagcaggtccccgcagggccgggcactagcacccctcccagcagccccgtgcggacctgcgggcccctgacggatgaggacgtggtcaggctgcggccctgtgagaagaagcggctggacatccgtggcaaactttacctggcccccctcaccacgtgtgggaacctgcccttccgacggatctgcaagcgcttcggggcggatgtgacatgtggagagatggccgtctgcaccaacctgctgcagggccagatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaa

SEQ ID NO: 38227 - DNA, 1028 bp, Homo sapiens
  misc_feature (11)..(11): n is a, c, g, or t
  misc_feature (40)..(40): n is a, c, g, or t
  misc_feature (47)..(47): n is a, c, g, or t
gggaaagaaanagaacttaggctaggtcgaggctggtgtnaatcggncgaatgtccgagtgggccctactcaaacgccaccagtgtgaggacatctttggcgtccagctggagggcgccttccccgacaccatgaccaagtgtgccgagctgctgagccgcaccgtggaggtggactttgtggacatcaacgtcggctgccccatcgacctcgtgtacaagaagggtgggggctgtgccctcatgaatcgctccaccaagttccagcagatcgtccgtggcatgaaccaggtgctggatgtgccgctgactgtgaagatccgcacaggcgtccaggagcgtgtgaacctggcgcaccgcctgctgcccgagctgcgggactggggcgtggcactcgtcacgctccacggccgctctcgggagcagcgctacaccaagctagccgactggcagtacatcgaggagtgcgtgcaggccgccagccccatgcccctgttcggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaa

SEQ ID NO: 38228 - DNA, 1379 bp, Homo sapiens
cctccaaaacaccctaacagttaaatttcctcagtccagaagctgattgcagtccagttcgcaattggccaggctctagtttatataggacctgaggctccacccatgtgcaggcaccgcccccgtggcgtcacgagcgagcaatggcgtcattggaacgacatgagcatgcgcacttccccagcacaatcagggaagacacgcgtgacccggaaggtcttcccgccacactccagagcggatgtgaggggcgccgatggcggagggaacggcggaggctcctctagagaatggtggtggtggcgactcgggagccggagctttggaacgaggagtggcgcccattaagcgtcaatacctcaccaccaaggagcagtttcaccaattcctggaagccaaagggcaggagaagacttgccgggaaaccgaggtaggagaccctgctggcaatgagctggctgagcctgaggctaagcggatccgactggaggatggacagacggcggacgggcagacggaggaggcagcagagcccggggagcagctacagactcagaagagggcccggggacaaaacaagggccggccccatgtgaagcccacgaactacgacaagaacaggctgtgtccctccctaatccaggagtcggctgctaagtgtttcttcggtgatcgctgccgctttctgcacgacgtggggcgctacctggagaccaagccggccgacctgggcccccgctgcgtgctcttcgagaccttcggccggtgcccctacggcgtgacctgccgcttcgctggggcccacctgaggcccgagggacagaacctgcccagcctctgtctcctcaggaaatggggacatcttgtcatttgaggatgccaaccgcgccatgcagactggtgtcaccgggatcatgattgcccgtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaa

SEQ ID NO: 38229 - DNA, 804 bp, Homo sapiens
gccgagatcttaccactgcaccccagcctgggcgacagagccagactccgtctcagaaaaaacaaaagaaagtcctgtcccccttttttttttgggaaaaagggggggctttgaaggttgtgtgcatgcagctgggaggcttactaggcttgtaggttttgtggtctgggctccggctcaggccaggccatggaagcagaggccacacgatcccaggcaggctggtggctgggcccactgatcgtcacccgtcccacagtggcgccctgctcaagccgtggctcttcacggagatcaaggagcagcggcactgggacatctcgtcgtccgagcgcctggacatcctgcgggacttcaccaactacggcctggagcactggggctcggacacgcagggcgtggagaagacccggcgctttctgctcgagtggctgtccttcctgtgccggtgggcaccggggctggctggggtgggcggcgcgtgggccgcggctggttagagctgactcaagcctgtcctgcccgcccacccgccgcaggtacgtgcccgtggggctgctggagcggctcccacagaggatcaacgagcggccgccctactacctgggccgcgactacctggagacgctgatggccagccagaaggcagccgactggatccgcatcagcgagatgctccttgggccagtgccccccagcttcgccttcttgccgaagcacaaggccaacgcgtacaagtagcctcaggctttcccaggggcaccctggggcgaggagagtacaataaattttattcttttaaaa

SEQ ID NO: 38230 - DNA, 329 bp, Homo sapiens
agggattgattggcacatgcagaggcccagcaaaggagccagaccatttgggccaagtgtgtcctagactgtgggtagaagggaggctccagggcctcagcagctggggtggaggccaagctccacttgtgtgtatttttttccctccagctggacatccgtggcaaactttacctggcccccctcaccacggtaggacctgggtcaggtggctggtcgggtggcagggtggcagtgtggtcattccaacagggcttagtgtctgtccccacctactggattgtggggctggggcgcatattcagggttctgctgtgtgtgtgtgtgtg

SEQ ID NO: 38231 - DNA, 650 bp, Homo sapiens
agaaatgaggcaacttgtccaaggtcgcgcacctagtaagtggtggagctcggtccagctgactcctagacatgctcatagcagtcatactgtgctaggctctggggatatggcagagaatagaaaggaggaggatctctgtccttcctgagggagacacaaagcgggatggtaaaaattcggattgggggaaactgggttctatgggaagacactggcaggaaccctcaacaagggcttccctagggcttttcctcccataccttcccaaagtatttaatcttctcataaaacataaggtcccggaggttctcatccaggacttctccaggatgtcaaccattatcccatcacctgtggccagagtcgccatagttactgcagcgcagtggggctcagcttaaggcacctccagtttcctcgctcttccatgcccattcttgtgcctttgcgtgaactgatctttacttttcagccagattttattagaaatgatttaggaatttcaagcaggggcatttccctagcaaccgatgacataagcacaaggcccaaatctgtgctgttaacagggaatggcgttctgtgggctccgatctgcgtctctgaccctcgtaaaccttgtcttctaaaggaggaggctgagagca

SEQ ID NO: 38232 - DNA, 324 bp, Homo sapiens
tcacatctgtaataccagcattttgggatgccgaggtgtgtggattgcttgaggccaggagtttgaaactatcgtcggcaacatagcaagacttcatctttacagaattaaaatttaatattagccagaaatgatggcacacacctgtagtgtcagctactcacgaggcagaggcaggaggattgtttgagccaaggaggactgcttgagcttgggaggtcaaggctgggtgagccatgatagtgccactgcacttcagcctgtgcaacagaccaagaccaggtctcaaaaaaggccgggcaccatggcttaagcctgtaatcc

SEQ ID NO: 38233 - DNA, 442 bp, Homo sapiens
tgaggtctttccgtgctgtcatagaagggcctgccctttttctcttgtaggaagttagcttctggtaattgaacctgaagagggtagttgtgaagctgaagctgaggagtaggctgaggacattccttcctacacaaaagttcttgcactcatattgtttatctaattgaaccctgtgggccgggtacggcacgttacgcctataatcccaaagtgctgggattacaggcgtgagctaccacacctggccccatttcagtagttctatctttaatttctgaaaattctatttggtttgttttcacatctccttggtatttttttctagttccttgtggcttgtctatttcaaaattctgtcttttatttctttaagcaatttatgaagttattttatattctgatatcagatacaataaaaccttggtggttaaaaaaaaaa

SEQ ID NO: 38234 - DNA, 735 bp, Homo sapiens
acaataatctgagttatatgttaatttctaaaagaataaatgaacccattacttcccagatttcacagaagccacttgcttggagcagactaccatgacaagccagtctcaggggatccaccagcttcttcaggcagaaaaacgggccaaggacaagctagaggaagccaagaagagaaaaggaaagcgattgaagcaagccaaggaggaagcaatggtagaaattgaccagtacagaatgcagagagataaagagtttcgactaaaacaatctaagataatgggctctcagaataatctctcagatgaaatagaagaacaaacactagggaagatacaagaacttaatggacactacaataagtatatggaaagtgtgatgaaccagctcttgagcatggtctgtgacatgaaaccagaaatccatgtgaactacagagccaccaactaaatgtacatcacagttttcaagaaaaaaaaaggtgtgtgagtgccacctggttgcttatggcttcgtatttttatgttgagaaatttgaaatgagaaccttaaatttacatttacaggaaatgtgacataactcatacatcggcactgaattaaacaaaacaaaatacaactgttgctatatcttttctagtaataattatgaccttgtcacttaacttggagtaagtcaagaatgcaaaatagtaacatgttttttaacacttgaaagaaaaacatggtcatga

SEQ ID NO: 38235 - DNA, 802 bp, Homo sapiens
tattcattatttataagtagatgcaacacctcatttatacctccttatctcatacagaagagctaagattggcagaaatgatttcacagaagccacttgcttggagcagactaccatgacaagccagtctcaggggatccaccagcttcttcaggcagaaaaacgggccaaggacaagctagaggaagccaagaagattctgcatctacttttcctaaaacgaagagactgggactgcttctggaaaaggaaagcgattgaagcaagccaaggaggaagcaatggtagaaattgaccagtacagaatgcagagagataaagagtttcgactaaaacaatctaagataatgggctctcagaataatctctcagatgaaatagaagaacaaacactagggaagatacaagaacttaatggacactacaataagtatatggaaagtgtgatgaaccagctcttgagcatggtctgtgacatgaaaccagaaatccatgtgaactacagagccaccaactaaatgtacatcacagttttcaagaaaaaaaaaggtgtgtgagtgccacctggttgcttatggcttcgtatttttatgttgagaaatttgaaatgagaaccttaaatttacatttacaggaaatgtgacataactcatacatcggcactgaattaaacaaaacaaaatacaactgttgctatatcttttctagtaataattatgaccttgtcacttaacttggagtaagtcaagaatgcaaaatagtaacatgttttttaacacttgaaagaaaaacatggtcatga

SEQ ID NO: 38236 - DNA, 640 bp, Homo sapiens
tattcattatttataagtagatgcaacacctcatttatacctccttatctcatacagaagagctaagattggcagaaatgatttcacagaagccacttgcttggagcagactaccatgacaagccagtctcaggggatccaccagcttcttcaggcagaaaaacgggccaaggacaagctagaggaagccaagaagagaaaaggaaagcgattgaagcaagccaaggaggaagcaatggtagaaattgaccagtacagaatgcagagagataaagagtttcgactaaaacaatctaagataatgggctctcagaataatctctcagatgaaatagaagaacaaacactagggaagatacaagaacttaatggacactacaataagtatatggaaagtgtgatgaaccagctcttgagcatggttcccgacatgtgaccagtgagtcatttgtgttccgtagccaccaaagaagtgagcatctcagttgtcaggaagtgagaacggtgtgtgagggccgtttgggtgtgtaaggtttaggatttgtaagatgagccagttgaaatgagaacctgttttttacgttggcaggaaatgtgccacaaatcaatcataggctttggatcaaacaaaacaaaaaac

SEQ ID NO: 38237 - DNA, 1233 bp, Homo sapiens
gaggcctgtctcaaacttgagatgtggcaataacttgctttgtcacctcggcaagtcatttccaaatcaggaaggggtcagtttcaggaaacagaaacttctccagctgtttttggcagaaggggatttaagggaatcagggtacttaaagtacatgggaaggctggagaagtcgcctccaggaagctcccactggagctgggatcagaacgtactgtcctgcctgccatcccctgtaagcacccaggaagctgggcttgggccctgggacatggggtgggactgccactcctgcctcctgacacccacaaagccagaagcgtggtgctgctgcagaaggactgaacatctccaaggctgggcccgcagagcaaacttccttggccctgtgtcctccatccatatccttcaaaggacacctcattagtggactccatttctctcttccacggaactccagtggcaagggaatccagaaacgttttctttttgcctggagatgctaatccttagcctaagaataaggaaactggtccatgtaaggactgaccatcctttcacccatctgtctgcccacttgtgtatccatcccattttatccatccattcctccagttgtggacaccagatgactttcagctccccctaccccaaccagaactttgctgcaatggccattcttatatgcccctatggacccatgggacaattctctgggatacatgctaggagcagaattgctgaatcatagggaatgcatgtgcttagcttggctaagcaatgttggagtaaaagcttttggttttgcatcttctcagcacttctagggaggcaccaaaagggaggatggcactgactgagcccacctgagatagctcctagaccccagccctctgtgtcctcagaatcacacactgctgctcatcacttcagcttcccgaagatcatggcaatagcagcatgcctgtaactgtcccaagtacaaccaaaaattcttcctaaagagagggaaccaaagtcacacgggtcaccttgtccacctgtgtggacgttgctcatgttcacatacccttccttgcctccttcaaggcaggtctggccacaagcccagctctggctaatgaaatgtgaagggagtcaagggccgggggcggtggctcacacctgtaatcccagcattttgggaggccgaggtgggttgattacctgaggtgaagaatttgagaccagcct

SEQ ID NO: 38238 - DNA, 1295 bp, Homo sapiens
gaggcctgtctcaaacttgagatgtggcaataacttgctttgtcacctcggcaagtcatttccaaatcaggaaggggtcagtttcaggaaacagaaacttctccagctgtttttggcagaaggggatttaagggaatcagggtacttaaagtacatgggaaggctggagaagtcgcctccaggaagctcccactggagctgggatcagaacgtactgtcctgcctgccatcccctgtaagcacccaggaagctgggcttgggccctgggacatggggtgggactgccactcctgcctcctgacacccacaaagccagaagcgtggtgctgctgcagaaggactgaacatctccaaggctgggcccgcagagcaaacttccttggccctgtgtcctccatccatatccttcaaaggacacctcattagtggactccatttctctcttccacggaactccagtggcaagggaatccagaaacgttttctttttgcctggagatgctaatccttagcctaagaataaggaaactggtccatgtaaggactgaccatcctttcacccatctgtctgcccacttgtgtatccatcccattttatccatccattcctccagttgtggacaccagatgactttcagctccccctaccccaaccagaactttgctgcaatggccattcttatatgcccctatggacccatgggacaattctctgggatacatgctaggagcagaattgctgaatcatagggaatgcatgtgcttagcttggctaagcaatgttggagtaaaagcttttggttttgcatcttctcagcacttctagggaggcaccaaaagggaggatggcactgactgagcccacctgagatagctcctagaccccagccctctgtgtcctcagaatcacacactgctgctcatcacttcagcttcccgaagatcatggcaatagcagcatgcctgtaactgtcccaagtacaaccaaaaattcttcctaaagagagggaaccaaagtcacacgggtcaccttgtccacctgtgtggacgttgctcatgttcacatacccttccttgcctccttcaaggcaggtctggccacaagcccagacctggctaatttgtaaaattttttgtagagatgggttcttactatgttgtccaggctggttaaggcctcctgggttcaagtgatcctcctgccttggcctcccaaagtgctgggattataggtgtgagccaccaggcccagcctaaccctttataagaaataaagtctcctctcaaaatttat

SEQ ID NO: 38239 - DNA, 865 bp, Homo sapiens
cgttcccatatgtcgacctgcaggcggcgcgaattcactagtgattgtgagctgagatcgcacccggtccaagcactggctttgagataagcaatattaaaaacattttcagcttcatcagatgctgactaactgacctccaaccactgttccaccagccataactacagctttgattggacaagtgactgatttcagtaactttttcctgacaaggtgactacccatcatggactggttctggctggcttacagagctcctgcacttgcatgtctttgtgtcctgaaaagaccttttgccatatagggcctaattataatacatttaaatgttaagtctccaccccaaagtgaccatgggttgtatgttgcatgcatgtttgttcaatatgcatgtgtcagaaccactttcatgaatattcatagctcctcatgtaacctgttgaatgtgtatgtttagtcaatccattgagcatgaagctcctaccctaacccctccttctttgaagtgcctgtctctggtcttggctggagacatgcttcccagcaggtctcactccctttctgaggctggagtgcagtggtgcgatcatagctcactacaacctcaaactcctgggcaaaagtgatcctcctgcctcagcctccggggtggctaagactacaggtgcatgccaccacacctggctaatttgtaaaattttttgtagagatgggttcttactatgttgtccaggctggttaaggcctcctgggttcaagtgatcctcctgccttggcctcccaaagtgctgggattataggtgtgagccaccaggcccagcctaaccctttataagaaataaagtctcctctcaaaatttat

SEQ ID NO: 38240 - DNA, 282 bp, Homo sapiens
gtacacttaaaatggttaaaatggcaaatttcatgttatatatattttatcacaataaacagttataccactgttaaaatattaatcagtattttgagaaaaatgcttatagcttagaaggcaatactcacagtttttggggattcttgttaaattcctgtcacaaactttgagggcctgttataaatgaaaaggcacaagctgggcatggtggctcacgcctgtaatcccagcactttgggaggccaaggcgggtagatcacctgaggtcagcagtttgac

SEQ ID NO: 38241 - DNA, 217 bp, Homo sapiens
aagtgactacaggtgaagtatcccttaaccaaaatgtttgggaccagaagtgttttaaactttggattttggaggattttgaaatatttgcattatacttacctgttgaccatctctaatccaaaaatatgaaatttgaaatgctccaatgagcactttctttgactgttcaaaagtttcaaattttagagcatttcaggatttcaggtttgggata

SEQ ID NO: 38242 - DNA, 1008 bp, Homo sapiens
gttcatccgggtgcttcatgctgtgaccacaaatgggtaaggaacagggaccaggaagcccctcatccccttagcacgtgggtcttctccattaggcacattcagtccactcttgcgttctctctccactcccgggagtggagagagaaagggatgttacaaaccatctcagagtacaaagaaccttctctgacaacagagaattatctggcccaaaattcagtagtgccaaggttgagaaacctgaccttaaatgaataatttaacctttctgggcttcagtttcctcatctgtaaaatagggctattaatagtatctaccttgtagagctattgtattggtccaacaaaataatgcaagtacctagtgcctaataataaaggtagtccataaatattccctacacgaatggttcttagcatgcctctggaatccctcctggcttcatcactgggctgaacccaccggaccctagtttggcttatttcttgccaaggccagtgctcctgactctttcttcactggtcttgatgctttccttctctccttgacctcaaggcctatcaagcagctggaagcctctccctcaggccccatcccagcaccaggcccctgcctccacctcccacttctcccttcccgtctctcttccccctctttccagccttacctctagtggctccccatgccccttggcaggtcagagcacactcagctttttcccacttcagcatctctgcacagacttcctccagccagagtggcagaagacagagaagcatgtccaggatttggaccagactgcctggtcccagttctgcactgggcctgttacttacggcctagttttaggaaagtcagcctcatctgcaaagcagggaaataatttccaacccatgaggttgttgtatggacccagttgagaatgtatgaaaacatgcaacaactataaagattgttaaaatgtaagttattcactgtgtgagcattattctgctaaatgtatg

SEQ ID NO: 38243 - DNA, 1265 bp, Homo sapiens
ctataaagagattcccaaaccatgtcccagaatctgtacatcacctccacctcctcagaccctcctccaaagagtcgcctgtctctgactcctacctgtccagggttctagccacctgatggtaagatcttggctttccgattcaggcaggagagtcgcttgaattcgggaggtgcaggttgcagtgagctgagatcgtgccattgcactccagcccaggcaacgggcggggctccatctcaaaaaaaaaaaaatccagttctgttactaaccatatgaccttagacaagtgattctcaataaggggtaattttatcccccaggggatgttaggcaatgcctgaagatatttttgattgtcataactgggaatggaagtgctactggcctaaagtcgggagaggctagggatgttacaaaccatctcagagtacaaagaaccttctctgacaacagagaattatctggcccaaaattcagtagtgccaaggttgagaaacctgaccttaaatgaataatttaacctttctgggcttcagtttcctcatctgtaaaatagggctattaatagtatctaccttgtagagctattgtattggtccaacaaaataatgcaagtacctagtgcctaataataaaggtagtccataaatattccctacacgaatggttcttagcatgcctctggaatccctcctggcttcatcactgggctgaacccaccggaccctagtttggcttatttcttgccaaggccagtgctcctgactctttcttcactggtcttgatgctttccttctctccttgacctcaaggcctatcaagcagctggaagcctctccctcaggccccatcccagcaccaggcccctgcctccacctcccacttctcccttcccgtctctcttccccctctttccagccttacctctagtggctccccatgccccttggcaggtcagagcacactcagctttttcccacttcagcatctctgcacagacttcctccagccagagtggcagaagacagagaagcatgtccaggatttggaccagactgcctggtcccagttctgcactgggcctgttacttacggcctagttttaggaaagtcagcctcatctgcaaagcagggaaataatttccaacccatgaggttgttgtatggacccagttgagaatgtatgaaaacatgcaacaactataaagattgttaaaatgtaagttattcactgtgtgagcattattctgctaaatgtatg

SEQ ID NO: 38244 - DNA, 491 bp, Homo sapiens
cgtttgtagagccagaggacacccttgcaaaacagccactgtgagaggccagttgctgcaaatcacaggtcagccacttctacacttgtccttcaagcacatcagccggacatttggagttttctatagtcttcatttcaaactcgatcatcctgagtgttgtggtggacactactagtgtcacaaagagtccagcaccctctccttccaggtatataaacggtgcattgctgggctcctttgcagttggataggtcaggtaatttgtctgttgtgaagagttactatgtttcacttctaagccgaagcatttgattgtcaatggaataccctccagctctctccttccctgcagaagtaatcttggaagcatgtgttgagatgacagagttcccaatagcctagattcctgaatgacttagtggagctgagtcctccacaggtccatgttggacatgcacaatcagtgagaataaacttttgttggatta

SEQ ID NO: 38245 - DNA, 1018 bp, Homo sapiens
tcatctgtgggaaggaggggagcatctagttgtctactgctagtgagctaggagttctaggattgtcaggttctaggattgttaggttgggcttagctgctagattttattctgtctgtattccggcattgttacccctttctggctaatcatccagcaccatttccctccatttgaggatttatagtcataattgggctgggggatgggggactccctttttatcaggtgatgctgcccttgaagcctccaatagcttattagtttcaagattctcagaattcttaggcctctcaaattaaattttccagtactacataaaacatttctatacactgcgggggtgaaaaactaccactctctatacctaactgaaaccttgctatggccaggcacagtggctcatgcctgtaatgccaacactttggcattcagcctttgggaggctgaagtgggaggatagcttgagcccacgagtttgagaccagccctggcaacatagcgagaccctgtctctacataatattttttgaaaattagctaggcatggtggcacatgcctgtaatcccagctacttgggaggctgaggtgggaggactgcttgagcctgggaggttgggagtgcagtgagccatggtgacgccactgcactccagatgggctgacctgtctccaaaaaataaaaccctgccatggcacttaaactccattgtatgtgagatgatactctaaaatttaatcataacataatacttatttagcattagctctgtgccaagacactgttctaagtacttcttctattttcattaattctgtgattgtcataggtagatgctattcttacctattttataaatgagaacagtgaggcacagaagtgttaacatactgtctttaagggaaatttgaaaaaatacattaaaaccatttaaacagctcctcacattttgatgtatttcctttagtctttaaaaaaaatcatagattaaaaatgtcatcgtaaacatagttgta

SEQ ID NO: 38246 - DNA, 92 bp, Homo sapiens
attttccagtggttgtcaatggaaggtttccattctcttgggggaattaaggaaatttgtaaggtcatttttggctatcaaaatcactaggg

SEQ ID NO: 38247 - DNA, 383 bp, Homo sapiens
gtaaattcagtctttagtgttgatagtcttttatgttggagaaaagcaaaagagaacgaggtagaaaataaaggttgggtcatgcagcctatagcttctgttgcacttggtatgttaacttccttaagaaatgtcaagttgaaatacaagcatttctgcagccaacagtgagaacaaaagaccagggatccttcattttctgaactgtgtaagactctggaatcttcatatctcagaggcaaaaaaggaggaatatttcaacaatgactgtagttgttattccaggtaatcagaatccttattagaagtataatataagagtgtggtttttatctttactccataaattaaatgcaaccggtatcatgtgactacattttgac

SEQ ID NO: 38248 - DNA, 992 bp, Homo sapiens
ctaaataaagatctaaataactgatctaaataaagcagcccccacagattcccactcactgggcccacagaagccaactcaatgtcagactgcagggcaggaggtacaaagccgctagaaggctgcaaaaccaagagtgctaactcaccccagcaccactaccaaccacactgggctgaaaggcacagccacaggacctggcccactcagagaagcaccaagtctggctctgctctcactcagcactcatagctcagggctagggcagccaggtaaccagggctcaagcccagagccagggctcaaacactcactcattggttcagaaataatggcaaggtcccatacagcctcagcctctgcttccccaagccttcctctctacaccacccatcaccgcccccaccacccatacacggccaggcagaaccccaaagcaccgaaaggggccctaaggaagctgccaggcatccccacacaccccgtcagtccctctgccccgactccctctcctgctcaccactcagtccctatccaaacgggactgcacacaacgtggaatgcacatcctctcccctgctcccttctacctggaggatgcctgaaggggtctgccggggaatgcccgaatttttcgtcatcacagtcacactgggccacagaaccccatattctctaccctcaaggctcctgaaagtgcccccagacacacagcaggaagtgcccctgcgtccctcctcagacccaggagaaagccaaggctcccactctggggggtggaggcgggtctggcgtcccaccgccccagaaaccctcacccgggccctttccacacccggccgtgcccgcgctcccggtccacgccagcccgcaaggagcccccgccccactcacaggacgcagagcgcgaaggcccccgccacgctctcgctgtctcggaccaggaagctgccatcgcggcccgcccgggccagcagctcctccgcggccgc

SEQ ID NO: 38249 - DNA, 300 bp, Homo sapiens
cgaatagctgggatacaggcgtttgctaccatgcccaactaattatttgttatttttaatttttttttgtagagatgagctctctctatgttgccaggctggtctcaaactcctgggctcaagtagtcctcccacctcagcctcccaaagtgaggtactgtgcctgcctacaaatttattttgtaaccaaccattatactctgctacgtctgactgttacatagagacatagttttctatcatcaacttcattatggaagggttattttctactgaatttaatccaaattacgagaagaa

SEQ ID NO: 38250 - DNA, 353 bp, Homo sapiens
aggtactgtactcattaattttggcctcaatgtccttattctcatcagctcattgagcatttaaaagatgatcccctccctattttatttaacatttttagttttttttttctgagaggggccagtaatggtacctagccctcccagtgctggaaatgaaagtcctgattgccttttgagcctccctatcacacagttgttcacagtgtttttgtgccaacagtacttaaagtcacaatcatttaattgttggagattataattttaacaacctgtaaagaaagtttttttaggaatcagtaaaccactcttcttaaggataaagataactgtagtaagtccagtttttaagt

SEQ ID NO: 38251 - DNA, 576 bp, Homo sapiens
aggctgaatttgtaaaaataatccacaaagaaaaacccatgcccagatgtctttacttgtaagttctaccaaacaaaagaaaaattaatatcaattcttaaaagcctcttccaaaaagcagaagaggaagaaacacttcctaaatcattctgaggccaatatcaaaaccagacaatgacatcacaggaaaagaaaactacagaccaatatctcttatgaatatgaatgcaaaaatcctattttaaaaaacaagttaaatccagcaacatataaaaagcaacatataaaaagaattatacaccctgactgtgtgggatttatgccaggaatacaaggttggtttaacatctgaaagtcaggtagtgtaaccctatcaatacaataaaaaacaaaaaccacatggcagcctcaataaatgcagaaaaagcatctgacaaaatcgacaaccctttcaggataaaaacattcaataaaccaagaaggtaagaaaacttcctcaacctgataaaggacatctatcttaaaaacaaaagcaaaagcctacagctaatgtcatacttgacagtgaaagattgg

SEQ ID NO: 38252 - DNA, 453 bp, Homo sapiens
ctcaagcaattctcctgcctcagcctcctgagaagctgggaatacaaatacacaccactgaataatttttaattctttttttttaaattaagatggggtcttgctatgttgcccaggctagatttgaactcctaggctcaagtgatcctctcacctcagcctcctgactagctgggactacaggtgcatgtcactgcacctcgctataacagttatttaaaaaccttccatttggaatagggagaagagaatacaatggtcactaatctacagcatataacacatccttctggacagtggagtgaatttcttggccaacaaaacctattgtttttggtcctttccactgggacatatctcctttgtccattgttgtttatggacatccctgagaggatggacctttggaactgaagcatcccacttcccttttgacatggttttgagttattt

SEQ ID NO: 38253 - DNA, 189 bp, Homo sapiens
aaaaaatacaaaaattggctgagtgtggtggcacatgcctgcagtcccagctactggaaggctgaagtgggagaatcacttgagcccaggtcgaggcttctgagccatgattgctcccactgcactccagcttggaaggaaaaaaaaatgttgggaggaaaggacaggggagctacaggggatggaggt

SEQ ID NO: 38254 - DNA, 481 bp, Homo sapiens
acaaaccatcctaaaactcaaacacttaaaacaagggttgggaaaccatggcctgtgggacaaattcagctgctgcttatttttgtacagcctatgagctaagaatggtgctacaaatggaatgtttgtgtgttcccaaaattcgtatttcaaaacctagtcccagtgtggaggtatttggaggtgatcagatcatgagggcagagcccatctcatgaatgggattagtcccctcataaaagatgcttcaaggagctcccttgccccttctgtcaagtgagaacgccacaaaaaaaatggctgtctgtgaaccagaaagtgggccctcatcagacaccaaatttgacagtgctttgatcttggacttcccagcctccagagctgtgagaaataaatttctgttgtttatgagccacccagtctatggtattcttttatagcagcctgatcagactaagacaaatagtttttacattttaaa

SEQ ID NO: 38255 - DNA, 520 bp, Homo sapiens
tgagtctcgtaaacataaatttgagtcaaagaagccatagcaaaagagtccataatttatgattccatttatttaagtacaaagagaggcaaaaccaatctattttgtcaggaggtaggataacccttgggaaggggtggtgattaaaaaggaatagaaggaaggctactggggtgctggttgattctttttaatgtttgtaaagtttacatggtgtcttcagcttatgaaaattccttgagctctgaccttatatgtacacttgtcaatatgcatgttagagtttaatacacttgtgcaaatgcaaacatatgttcacttattaaagacagcaacacaacagaaaaattcatttaaaacttacttaaagaaaaaaaaaaaaaaaactagtcggttgtgatgacacacgcctgtagtcccagatacacaggaggttgaggcaggaggatctcttgagcagagaggttgaggccagcctgggcaacatagtgagacccaccccccctacccccaattccta

SEQ ID NO: 38256 - DNA, 445 bp, Homo sapiens
tgtgtcccccactgcgtcgacccccactcatctactgcagaccgacatctcacgagggcctgcgggaagtggctttaggtttctgtatgtctgtgaatctaggaaatgatgagaaagcggataaagcggggccaccaggagccaggaggccccttcacccctgcctctgagctctgcacaggtccctctgcgtggacggtcacttcctcctcgcccagctccctcctcctgtccttcacagcaccactgatgtctgaagtgtagaccacctcttgtgtcccgtgagtccccaggccggtgcttgtggcacctaaagaagctccatgtctatcttaaggggaatgttctttttgattaatcagaggtattaacatgcccctaatgagtccatttgctaattgtattgtttaggggttgagaaaacaaaataaagagttgatatgtc

SEQ ID NO: 38257 - DNA, 178 bp, Homo sapiens
gacttttgggaatttgcatcaagcagatagaagcaggcgggggctcagcttttgaagttggatcatccagctgtctcactttgccacttatgggatctgtgacttgaagcaggtgactgacctctccactcctcagttatctatgaaatggggataatactagcatctacttcgaagg

SEQ ID NO: 38258 - DNA, 349 bp, Homo sapiens
gcagggctgaggaggacataaattcttaattagtggccactgtccttctaatcccaatgcaatggaaatatttgaaattcatctctacattctatgtatgaaagatttatttgggactccatctcaaaaaaaaaagaaagatttactttggcttgtcacataccttttttacgtctatggattctattaaattgtaggaattctactatgattgctgaattgcctggctcactgatgcctaatctatttttcatatttctgttaacatgaaattactgaagcccttattctaaaaatgaaatttgaattatctatcctagaacatcttctcagttactatcctcaccaa

SEQ ID NO: 38259 - DNA, 761 bp, Homo sapiens
tgccagcttgctgagtccaaaccccaagcacagaggggcatgatcagacagctctggggcacagactgagaggaggaactcagcacacccttcctttccaaggccagtgacattgtctgacagtggttgccttcaagcaggcagcatcttggttgcttccagcggcagaaagctggccagtgcttacacacgtgtttccagttggagtgttatcagccatggttctgacaatattctagggtccttagatgagcacacttcctgtatctgcattatttttatagcattagtggggttgatccccaggctcacctttccttaccaaataccatcccatcagactgggattaatgggaggagaagctttgaagtcacatgctcaatttcttgagttgattttccccgacctcatcctttgatgctaagcaagaagggctctgaaattctcattcctatttcttacatgaatgagtagtgaagaggggagatgctggttttggtgcagggcaaaattagtctttctggtttaaacacgaatcacgataacccaaacccaggaaggtccatgctgcgattccctggcacttcttctttgtagtcacttcggtgaccggcttgtgctgcaccctccattgactagccttggcatattgacaagagcaggatgcccctccatccatcccatcctcaccatctctccttccaaccttctcactacggggtgggggaggggaaagccccaaatcttaaaaaaaaaaaaa

SEQ ID NO: 38260 - DNA, 823 bp, Homo sapiens
tgccagcttgctgagtccaaaccccaagcacagaggggcatgatcagacagctctggggcacagactgagaggaggaactcagcacacccttcctttccaaggccagtgacattgtctgacagtggttgccttcaagcaggcagcatcttggttgcttccagcggcagaaagctggccagtgcttacacacgtgtttccagttggagtgttatcagccatggttctgacaatattctagggtccttagatgagcacacttcctgtatctgcattatttttatagcattagtggggttgatccccaggctcacctttccttaccaaataccatcccatcagactgggattaatgggaggagaagctttgaagtcacatgctcaatttcttgagttgattttccccgacctcatcctttgatgctaagcaagaagggctctgaaattctcattcctatttcttacatgaatgagtagtgaagaggggagatgctggttttggtgcagggcaaaattagtctttctggtttaaacacgaatcacgataacccaaacccaggaaggtccatgctgcgattccctggcacttcttctttgtagtcacttcggtgaccggcttgtgctgcaccctccattgactagccttggcatattgacaagagcaggatgcccctccatccatcccatcctcaccatctctccttccaacctttgtttatcctcttctacctgtttttggtggtttcttttttttgtttcgttttttgttttttgtttttgttttaagtttattttgttttatttttgtttcccttcctcccttct

SEQ ID NO: 38261 - DNA, 879 bp, Homo sapiens
ctccttggagtcagtctaaatggatgtgaagccacttcgtccaagtcccctcctttttatccatccctgttcataatccccaactcagaaggcattttccaggtcaggaatgggatcgattttcaacattgaggtttggggtgggccatagacaggccagcaccgtggagtcagtcccaaccttcagttttggaagggtcaaagaagatacaattgggccctgcctcaagaaggctagtggggagaacgtggactccatgaataactcatcatagctgtgtcttctctgccgcactctggggaaggataaatggactcagagagaataggatggggatggtctagaaaagttttagggtgaggtgtgatcatatcacatacaaccagtcaggacttgctggctaatgaaagcctgggcatgcccatctctgctcccaagttcttagagttcagatgtcttagctctgggttaggacccaaccactcaccttacccccaaccccagggtaaagagatagggttatggggcatgtggagaatggaatggacgaaaggtgactcagccccagagaggtgttttcctcctaccaattgaaagggagatgctagggaagagaccaggtcctcctcttcttgctgcgtcacctccccagtccaacttcaggctgcccacgctccttgtctctacaaaaggactgcagaagccggaaagagtgacaactgctgacgtgcacgggatcctagtaactgctggtttctaggtgactaaacctggcagagagaatcatggaaccacaggctgacagagttaaagggcccttaagacagccctgaacctgactccatcttacaatggaggagctggagccccagcaaagg

SEQ ID NO: 38262 - DNA, 1911 bp, Homo sapiens
ggctagaaaactattttagaaagcacatattactttgaaacagcagtaggcaaagtaataccaaattgtgatgtaatcatcaagaaacccatatttgtaataaggttaattaaatttgctgcagtcttgggacaagcctcctgtaagtgtgccagtaaatctggtcttgctttatcaaactgaagggcaccccctccttctcccagaatgagtagctcattgccagtggacacacgcaggctggcaacaataactaatatgttatgagaggttagacaagtttaaataggattcgtctctgaactgaagggcaaattgtaagaaatttctttgtctgcttgtgatgctgttaaattgaaagcacaatgggaggtttggtggaagcaacaaaggttgaaatgatggcctgctgcttggagcaagcatcatggtttccccagtggtccagacatctgctgacaacagccactcctggtcaggttctgctccacatagggcgtgagaacactttacaccatttaactcatcagagtcttcgagctcaacactgtgctccacatcaagaatgtttttgtaataaaacagagctaattaaacatttcaaagggaaacattattttaactctaattagatatgattacaattctctttttttttcctgtgccagtgctgaagtgcagtaaagccccctcattttgttttctgtgctcaattttataacaaagtcttatcaaataaaacaatactatcctgtcctatggcattgcttccagtatgatgacatgttcaaaaacctttatcaaatttaagatgatttttttttcaaaaacagaacaactatggtaacaacaataaatcgaatgtgttcatgttggtgggtaagcatgttaacttttattcatgtatagctttttttctgaaacactttaaaggtgatgttctgttattgttttattttaaacctgtcaggtctgtacaagcaaaaagtatctccatttcacaggtggggaatccagggcacagataagataagcaggtcaggagcaaagcaaggctggctaagatgtatgactcactcagagctcactttctgggggcaccccactctgagggtcatgaaagaacttttgctcaaggtagctaaaacctaccggataaaaactcataaaatgttcatgaaagtcatgctggattgggaatacacagacaaaatacctctttaatcaatgacgtgtgaaatgctgtaatatgcttttaactaattaatgaacaaaaatctttgaactctaaaaatattagttgtacccatgacatatgtcaactttcatttttatttaaaaacataggatagtaatgaaagcctaaagaatttcataaagatttgagataagatttctacagaatagaaaatgctggtgtgttggaaaacagatcagttgaaagcccttcagtgatagaggaagactgggagttttaaatgtttgaatactttttaatgaattcaatgagacattttctttgcttcttcaaagccagaaataagatatagggggactatcaaacatattatgatagaataaatatattttatatggtcttgagaaatagtaagcttattttatttatttatttatttatttttttacttcttgcatcgtattctatgaactcactttcaagagagagagacgttgtctatccacaggttttctgcagtcctaattaaaaagaactgcagtgagaagtttttcatttcaacttccaacccaagcttgagggcatagcagtaactgcagagtatattgtgttcattttgctgtttgagtagttcaggaaaaaggagttgcctttcaaacaccaaacaactaatatgattccctgcggacactgctatcacatcaagatttctt

SEQ ID NO: 38263 - DNA, 447 bp, Homo sapiens
taaaggaactggatttacccttccacttgcaacaacttaaaaaaaaatcactttcagacattgcaaatcaaatggcaaaagacagtgattcctgagatggagaagtaaataagatgagccctacaaatattatgccttactgcctggagagttttcaggctgcaagcacaggaaggggaaaatcaggcaacaggcagtatggatattcttcctgaattgagaagaaggagctgattgtctggagaggtcaagacagccagtgttcatagggcagagtgtcacaaaacagataactgcacagagtaaaccccagaggtctgtaaagggtcccatttgagtcttcagctgacttcatgcaagtgaagaaactacctgagaccacagaaagaacaacctggaaggatcagagggaacaatctatggtgctcacacaagactgacaattgt

SEQ ID NO: 38264 - DNA, 355 bp, Homo sapiens
tttttttttaaacagggtctcactctgtcacccaagctggagtgcagaggcacgatctcgattcattgcatcctccacttcctgggctcaagcaattctcccacttcagcctctggagtcgctgggactacaggtgcccaccaccatgcctgcccaattcttgtatttttgtagagacagggtttcaccatgttgcccaggctggtctcaaactcctgggctcaagcaatctactcgtgttggcctcccaaagtgctgggattacaggtgtgagccaccgcacccagcaataatttttaaagtatgtttaaaaaagcaaagaatttttccaataagtgggaatgtttttgtataa

SEQ ID NO: 38265 - DNA, 129 bp, Homo sapiens
tcaggtcaaatagatggaagttgaagtttgaagatttgggttaaagtactggttctgctaattgtttctctggctttgcatgagtgattctgtcactcttaaatttcagttttctcatctgtaaaggga

SEQ ID NO: 38266 - DNA, 285 bp, Homo sapiens
agaagttaattccaaccctcatagattactttgaggggttttagatttcagtggagaaagtccctgcagatgttgtggaaatagcaggagaactagaattagaagtaaagcctgcctgggaggggaaggacacgcaccggagcctgttaggggatgggaagtaataggagggagagtattaggaccaatacctaatgcatgcggggcttaaaacctagatgacaggttaataggtgcaggaaaccatcatggcacatgtatacttatgtaaacaatcccacactt

SEQ ID NO: 38267 - DNA, 386 bp, Homo sapiens
tttgagacagagttttgctcttgttgcccaggctggagtgcaatggcatgatctcggctcactgcaatgtccacctcctgggttcaagcaattcttctgcctcaggctcctgagtagctgggattacaggcacacaccaccacgcctgtctagttttgtatttttagtagatatggggtttcaccatgtcggtcaggctggtcgtgaactcctgacctcaggtgatccacccacctcagcctcccaaagtgctgggattacaggcgttgagccaccgcacccagccaagaatactcttctgactctcaaaaataaatctgtatagaatgcaagtcaaaaaaagggatgacatgtacagaacttccagagaaagttgctagaagcag

SEQ ID NO: 38268 - DNA, 517 bp, Homo sapiens
agtgtcttggggctcagggggtaatcctgtgtcggcagatggatgaagagtgtaaatcctagtggatctgcctgagttagggaatcaagttaacaaaacaatcagatgagcaagagatagtctgttgggcttaatggagaacagaacatttggacagaaaagttttctggacatttctggcttctttgaaagacaagtttaatgagcctcccagcaagattgctggctcagggtggagcaataaggccacttttgttgttattttattcttgtgttgtccatggcaataatgtcatcattttcatttggtgggacatcagggtgtcagtaagtcttgttactataatagtaaattaaattatctgtgatttggttacaggacttttgcatcaagattttgtaaaggaacaagatgatggtagggtggttccccacatctgtctaaatatttgttaaaaaaaggacaaagagttgtgatttttaagtgctttgaataattcatgtctttccattaaag

SEQ ID NO: 38269 - DNA, 345 bp, Homo sapiens
ctccttatgttatagataaaatgactctggcacactgaggtcaaattttgatcaccctctcccacccaagatccagacaccaaaggtagagacagtgtccttgtgttcttggtagactgaggttaggctcactttcattttttccagccccttcttatgctaatagatgttgctgatctcaccatatgctgagtccatatatcattatctttaataaacattaattgagagtttctcctattgtatacaaggttctgttctgcgcacaggcaaattcagtgacaaaaaagacataacccattcatttaaagaccttaaaatcttcaagaaataacatcagggttc

SEQ ID NO: 38270 - DNA, 1333 bp, Homo sapiens
gaatctggcgcggcctttgtctcacttcagccagagagcggggttagggcttcattgccttgtgtcctctgctccgggagacttcggtgattctgccactccctccgtcgctctgtgacctgctggcattgaatgatttatagctaagactccaggacacccctgaagccgagaaatgaaatcccaagttgaccgtcaagtccaacgctcgctgcagacatctagtggacccggcgctcgcggacggaagcggacagacctagttggatccttatcccaccaatctggcccacctttgctgccatctaactccgctgaccggcccaccgttcctccactgtccgctggttgacccgggcagcggagagaggaggttcttgtgtactatgtttaacattgacaagaagataattaggaaataaatatatataaatacaggaacataaagagaaataaagaggaagcaccacagtcaactaaaaaagagagattcccagcaacctacacaaccatttctataggctctcagctgatgcttagtgtttggacaactcacacatgcagattgacagatgaccaacttataaaagagatttttaataattcttaatgatttcacagggtgttgtcaatggaaatatggattcttctacagcaaacatgtacatctatatcatgtggaacaaggatagtgggaaaacctctgattgtgaggacgtagaactgagaagagcatatgaaatgtcataagaaaaacacttctggagcatgtcgtcttcaagaaaatggtgcccagacagtcaggattgtgttacattttaataggaatggggatatttgtgatatactgacaaaccaagacaggtgactataaaactgcaatgtaaagtgtcagcttctcctcacacctttatagtagacatctgagaacctcactcctgtcagcatattcttggggttgaatctcaagtgatccatagaatcttagataaagcagatgaaaataggcttttctgtcttcctaagtaaacagcaatgaagttgagagaaagaagatattgctggaagtcatgataaagtctatcttctgtgaccatatgtttccttagagagttttagacattgaccctcatctaaaaaattgtgaaaaaggactctcaccagtctgttaatatgtatgtatatgaaagaaattactggtaaacttctaaggcaggcattggtgttacttttttttatctttattgtgtctgtgaaatgattgtgtgtattttttctttgattagacaatgagattcccaaataaattttattaaagccaaaaaaaccttta

SEQ ID NO: 38271 - DNA, 1085 bp, Homo sapiens
gaatctggcgcggcctttgtctcacttcagccagagagcggggttagggcttcattgccttgtgtcctctgctccgggagacttcggtgattctgccactccctccgtcgctctgtgacctgctggcattgaatgatttatagctaagactccaggacacccctgaagccgagaaatgaaatcccaagttgaccgtcaagtccaacgctcgctgcagacatctagtggacccggcgctcgcggacggaagcggacagacctagttggatccttatcccaccaatctggcccacctttgctgccatctaactccgctgaccggcccaccgttcctccactgtccgctggttgacccgggcagcggagagaggagggtgttgtcaatggaaatatggattcttctacagcaaacatgtacatctatatcatgtggaacaaggatagtgggaaaacctctgattgtgaggacgtagaactgagaagagcatatgaaatgtcataagaaaaacacttctggagcatgtcgtcttcaagaaaatggtgcccagacagtcaggattgtgttacattttaataggaatggggatatttgtgatatactgacaaaccaagacaggtgactataaaactgcaatgtaaagtgtcagcttctcctcacacctttatagtagacatctgagaacctcactcctgtcagcatattcttggggttgaatctcaagtgatccatagaatcttagataaagcagatgaaaataggcttttctgtcttcctaagtaaacagcaatgaagttgagagaaagaagatattgctggaagtcatgataaagtctatcttctgtgaccatatgtttccttagagagttttagacattgaccctcatctaaaaaattgtgaaaaaggactctcaccagtctgttaatatgtatgtatatgaaagaaattactggtaaacttctaaggcaggcattggtgttacttttttttatctttattgtgtctgtgaaatgattgtgtgtattttttctttgattagacaatgagattcccaaataaattttattaaagccaaaaaaaccttta

SEQ ID NO: 38272 - DNA, 551 bp, Homo sapiens
gaatctggcgcggcctttgtctcacttcagccagagagcggggttagggcttcattgccttgtgtcctctgctccgggagacttcggtgattctgccactccctccgtcgctctgtgacctgctggcattgaatgatttatagctaagactccaggacacccctgaagccgagaaatgaaatcccaagttgaccgtcaagtccaacgctcgctgcagacatctagtggacccggcgctcgcggacggaagcggacagacctagttggatccttatcccaccaatctggcccacctttgctgccatctaactccgctgaccggcccaccgttcctccactgtccgctggttgacccgggcagcggagagaggaggcggcaccaacagaaggcttctgcaaagctgagagctccttttacccatggatcaggagcagagtttgcagctacactgtcaggctgtgtttggatgttagcagttagtttagctttgcgtcttcagagcaattgttcttagctacttaaaaaaagaaaagaaaagaaaggaaaattt

SEQ ID NO: 38273 - DNA, 501 bp, Homo sapiens
aatcactctgacagttttgtgaattttaaccctctgttaaaatcacaagggacaacgctaagttttaatatctaaactggaattttagggggcaagatcagccccttagattgaaagagacctatggagttgggtgatgtcaggtgcctcggagtcttggggacagcaccgatctctgtccccacatgggcacacactcttgtcaggcctatctggcattcagtgatgacttctgtgttgacaggaaaatattgatgggatgaatggaaagggtataaaacatggaagaagaaactattctttcatcagtgattaaaggcagcggaaataaagccaagtaaagttcagtgtacaaattaataaggcaatcagtctctattgattactagatgcctggttgaagtggatcttgaattggtttcccatgggaaggatttggagattttaagtggctgagtggtaatgattaaaatccaactttattctaaagctaccatacat

SEQ ID NO: 38274 - DNA, 253 bp, Homo sapiens
gcgtgagccaccgtgcctggcctgcctttctcttaacgtgtgtattacatttactgatatgcatatgtagaacccggaatgtcagaaaatgccaagtattttccccatttaatggggagtgaaaccacagtgagaccaaaagcgccatggactgatgctggcccaggatcgaggactcctcattctgaacatcgactcaagatgatcttccactatatttttctccctggtgttttcatctccccacctccag

SEQ ID NO: 38275 - DNA, 294 bp, Homo sapiens
ggcaccttttccgtgacagcctgtgcgtcttcagaacacaatgcagtgaataatcagccatagatgggcaagggggaggcctggtcgggcttttgacacagccctctgtaggcgtgatggatgtggagaaactcaacccttcccaggggggtcaggtggcaccatcaaaacaaagagtgcaaacagttcagtcctggaaaagaactccccccacacttacccccctttctttttgctgtttgtgccaaaaagttacagtatccagccattcctgattaagttggaaatctatgc

SEQ ID NO: 38276 - DNA, 1947 bp, Homo sapiens
tgcaaaaaacctttcaaaaggctttcctggattagagaaagaaagggagtgagggaggagagatgagtggctattccagaacgacataaagaatttccagccttggacggacagctgggaacgtcttccaatttggactggtgtttacaagcgggaagctaggtggaccttggattttggcgggtgaagaggctaggttgtttaaggaggtggggcgcgtttcagtggctctctttgaaaaagcccagcaagatgtcagacctgctctcagtcttcctccacctcctccttctcttcaagttggttgccccggtgacctttcgccaccaccgctatgatgatcttgtgcggacgctgtacaaggtgcaaaacgaatgccccggcatcacgcgggtctacagcattgggcgcagcgtggaggggagacacctctacgtgctggagttcagcgaccaccctggaatccacgagcccttggaaccagaggtcaagtatgtggggaacatgcacggcaacgaagcgttgggccgcgagctgatgctgcagctgtcggagtttctgtgcgaggagttccggaacaggaaccagcgcatcgtccagctcatccaggacacgcgcattcacatcctgccatccatgaaccccgacggctacgaggtggctgctgcccagggcccaaacaagcctgggtatctagttggcaggaacaatgcaaatggagtggacctgaaccgcaacttccctgatctcaatacctatatctactataacgagaagtacggaggccccaaccaccacctgccccttccagacaactggaaaagtcaggtggaacccgagacccgggcggtgatccggtggatgcactccttcaactttgttctttcagccaatctccacggaggggcggtggtggccaattacccgtatgacaagtcctttgagcaccgggtccgaggggtccgccgcaccgccagcacccccacgcctgacgacaagctcttccagaagctggccaaggtctactcctatgcacatggatggatgttccaaggttggaactgcggagattacttcccagatggcatcaccaatggggcttcctggtattctctcagcaagggaatgcaagactttaattatctccataccaactgctttgagatcacgctggaactgagttgcgacaagtttccccccgaagaggagttacagcgggagtggctgggtaatcgggaagccctaatccagttcctggaacaggttcaccagggcatcaagggaatggtgcttgatgagaattacaataatctcgccaatgctgtcatttctgtcagtgggattaaccatgatgtcacttcaggtgaccatggtgattacttccggctgctgcttccaggtatctacactgttagtgccacagcacctgggtatgacccagagacagtaactgtgaccgtgggtcctgcggaaccaacgttggttaacttccacctcaaaagaagcatccctcaagtaagccctgtgaggagagctcccagcagaaggcacggagtcagagccaaagtgcagccccaagccagaaagaaagaaatggagatgaggcagctgcagagaggccctgcctgaaacccacagtgccaggcaacccttcagaaaggctttgctcctgctctcagatcagatcaagcattctttctattttattatctgggacatatttaaatacaaacatattcagaacaattcagaatggtctccatctgttccaggggtaagccatctctaggtcatcatgaaaaaaattaggatctattgaaaggtgatgtggtggccgggtgtggtggctcacatctgtaatcctagcactttgggaggccgaggcaggtggatcacctaagttcaagagttcggaaccagcctggccaacatggtgaaaccctgtct

SEQ ID NO: 38277 - DNA, 1892 bp, Homo sapiens
tgcaaaaaacctttcaaaaggctttcctggattagagaaagaaagggagtgagggaggagagatgagtggctattccagaacgacataaagaatttccagccttggacggacagctgggaacgtcttccaatttggactggtgtttacaagcgggaagctaggtggaccttggattttggcgggtgaagaggctaggttgtttaaggaggtggggcgcgtttcagtggctctctttgaaaaagcccagcaagatgtcagacctgctctcagtcttcctccacctcctccttctcttcaagttggttgccccggtgacctttcgccaccaccgctatgatgatcttgtgcggacgctgtacaaggtgggagacacctctacgtgctggagttcagcgaccaccctggaatccacgagcccttggaaccagaggtcaagtatgtggggaacatgcacggcaacgaagcgttgggccgcgagctgatgctgcagctgtcggagtttctgtgcgaggagttccggaacaggaaccagcgcatcgtccagctcatccaggacacgcgcattcacatcctgccatccatgaaccccgacggctacgaggtggctgctgcccagggcccaaacaagcctgggtatctagttggcaggaacaatgcaaatggagtggacctgaaccgcaacttccctgatctcaatacctatatctactataacgagaagtacggaggccccaaccaccacctgccccttccagacaactggaaaagtcaggtggaacccgagacccgggcggtgatccggtggatgcactccttcaactttgttctttcagccaatctccacggaggggcggtggtggccaattacccgtatgacaagtcctttgagcaccgggtccgaggggtccgccgcaccgccagcacccccacgcctgacgacaagctcttccagaagctggccaaggtctactcctatgcacatggatggatgttccaaggttggaactgcggagattacttcccagatggcatcaccaatggggcttcctggtattctctcagcaagggaatgcaagactttaattatctccataccaactgctttgagatcacgctggaactgagttgcgacaagtttccccccgaagaggagttacagcgggagtggctgggtaatcgggaagccctaatccagttcctggaacaggttcaccagggcatcaagggaatggtgcttgatgagaattacaataatctcgccaatgctgtcatttctgtcagtgggattaaccatgatgtcacttcaggtgaccatggtgattacttccggctgctgcttccaggtatctacactgttagtgccacagcacctgggtatgacccagagacagtaactgtgaccgtgggtcctgcggaaccaacgttggttaacttccacctcaaaagaagcatccctcaagtaagccctgtgaggagagctcccagcagaaggcacggagtcagagccaaagtgcagccccaagccagaaagaaagaaatggagatgaggcagctgcagagaggccctgcctgaaacccacagtgccaggcaacccttcagaaaggctttgctcctgctctcagatcagatcaagcattctttctattttattatctgggacatatttaaatacaaacatattcagaacaattcagaatggtctccatctgttccaggggtaagccatctctaggtcatcatgaaaaaaattaggatctattgaaaggtgatgtggtggccgggtgtggtggctcacatctgtaatcctagcactttgggaggccgaggcaggtggatcacctaagttcaagagttcggaaccagcctggccaacatggtgaaaccctgtct

SEQ ID NO: 38278 - DNA, 484 bp, Homo sapiens
ggagttccggaacaggaaccagcgcatcgtccagctcatccaggacacgcgcattcacatcctgccatccatgaaccccgacggctacgaggtggctgctgcccaggtacgaggtccaagggagatgccggggagagatcaaggccttcttaggaaataaagtccagtggacaagattccctctctgtcccactgtaaatatcacaaatgttaaaagtaaaagatgaaatggccaagagaaaaaatccatcagaaatataagaaaggatgaagaggtgggttcagtcctacagcacctcaggcaataaacatgggctctctctgagcctgcattccctcaacacctttccagatgacctcagggttttattgtgaggattaatgtggcaatatctgtgataacactttgtaacctggaaaatactcaacagatgtggagggatattgcaaaataaagctcctttcctggactttcagcatcaaa

SEQ ID NO: 38279 - DNA, 387 bp, Homo sapiens
  misc_feature (321)..(321): n is a, c, g, or t
caatatgggtggggaagccatcagggttaaacccctaggaagatccttctgtcaattcaagctagctccctgaacactgttttgtcctatcttacaaggacaagaccattcagctgggttccttttctttccactctggcgattcctctcccctcccctccccttcccttttctttctttctttttttttgagacactgccaaaaaaaaaaaaaaaaattagctggatgtggtgccggcgcctgtaattccacctactcaggagactgaagcaggagaattgcttgaccctgggaggcggaggttgcagtgagctgagatntctgccactgcactactccagcctgggcaacagagcaagactccatctccaaaaagaagaaattaa

SEQ ID NO: 38280 - DNA, 668 bp, Homo sapiens
agtttagagtagaagttcctaaaggaatcttacatgggtatttttatgtggacaccagcaagtgtgtgtgtacatgcacatgcatgtgtgtgtgtgtgcttttttgttttttgacttctcaatcattgtctcatcgacatcccttttgtctcatctgaaaaaatatcttggagatcattccacatcagtacacagagcttcctcagtctttgtttttttaaaacactaactgctacttgattcttttttttttttaaaatttatttatttattttgagatggagttttgctcttgttgtccggactggagtgcaatggtgtgatctagagtcactgcaacctctgccttctgggtttgagcaattctcctgcctcagcctaagctgggcttacaggcatctgccactatgcctggctaattttgtatttttagtagagacggggtttcatcatgttggtcaggcttgtcttgaactcctgacctcaagtgatccacctgcctcggcctccgaaaatcttgggattacggcgtcagccaccgtgcctggccatgactgttttttaaattaaaagaataattttgttttgtgaaatgtatcatgcataatagaatagaaaatgtttatgtaagagcagaagaagaataaaattaattcccgcatacactt

SEQ ID NO: 38281 - DNA, 539 bp, Homo sapiens
gtttgtcttttaggaaaaggcaggcagcattaaagaggtgctctgagacaaacattttttaaatccagaacatctaaaatacagggatagactcttatcaaagccatgtggctccatcctgagattgctgttgcagtccatccattggtcttgttctgtttgctataatagcatcacttctcccccagggctggtacccgagctggacaaagtgagtggataacagcatcaagcagtgtattgcatagcatccttgttctgaaaactttaagactttaatgtcatttaacttttaaaaggtttttgtcaagtaattcattttccatagaaacatgtttcagagatttaatcgccaatttatttttgtttcctttttagattttgaaatttagaaaaaatagaaccctctttgaagtgagaattgtgccagaagcaattcattactaagaagtaaacatttttaagaagtttgtttaaattattgaaaatatagaactcttgggctgggtgctttagaattacctttgaacacacctacc

SEQ ID NO: 38282 - DNA, 361 bp, Homo sapiens
gtccacctcttattcactctgtgactttgggtaggacatttaaccatagttaataagaatcatcacaactgtttgcctttctcacatactggtttcaaaatcaataaagtatttaaggcaatgctttaaaaaccatacagcactgtacaaatatgctatcccatggttaagtagaatttagtgggaaaattgataccatcaacatttgattgcaatgattttatctaatagaaaattatctttcctgggcacagtggctcacacctgtaatcccagcacttcgggaggccgaagtgggaggactgcttgaaaccaggagtttcagatcatcatgggcaatgtagggagactccatctctaa

SEQ ID NO: 38283 - DNA, 389 bp, Homo sapiens
ttcctcacctcaagtgatctgccctcctgggcctcccaaaatgctaggattacaggtgtgagccactgcacccaacccctccaccacttgttttgattcatcctttggcagattacttttcctaaatgctgaagaccagggggtgctcagtgtctacaaagtccttgttcctggatggatactaacttactgacacctctcaagtgccagcaaactctggtagcagggattgtcttcattttacatgtgaagtaacagaccagatgggtagcactgcttggggccacatagctaatactctaatgctcctgccgtgggcactgtgccaccctctgcagggcctcatgtgttgggactgcactggcattgcaccttttcatccctctgtg

SEQ ID NO: 38284 - DNA, 585 bp, Homo sapiens
gctgggactacaggcacccgccaccgcgcccagctaattttttgtatttttagtagagatggggtttcactgtgttagccaggatggtctcgatctcctgacctcgtgatccaccctcctcagcctcccaaagtgctgggattacaggtgtgagccaccgcgcctgacctgtttactactttttcttatgtttactaatgatggtatgattgacatactaaacaaattattgtggttatttaattatttccttagaataaataaaatgagttaatacatataaaacacttagaagaagacctggcatgtacaatttctcaataagaaatttccttgaactagtgttattggtcaaagggtatagatgcttgtaggcttcttgtgcctattgccaaactgtcctccagaaaggttatgccgatttctactttcacctacagtgtccacttttagttccctgcatcctcccaatctaaggtattattaaccagcccctaccaaaacaaacaaaaactgttaatctgtagataagtcagtattaccaccaaaagacatacccaagcctgttcatggcagcatttttca

SEQ ID NO: 38285 - DNA, 639 bp, Homo sapiens
agtaaaactgagggcaaacctgagttgggaacattttagctctaaatacatacagtacatttagctgccttggctaatttaacttttagacagggcaaatggaataaggcagatgttgaggtgctacattgttggttcagaaaaatggttgtgagttttgaaagaaggcatgattctggtaagatctgactgtgggcaaggggctgttgaaacaaacagtgcagtgtttccagggcagtggtgaaggacttgacctccgttgtagctgaaaatgaagtccttctctaacaaagccatagtagcagcagcagcagctgttgccactgccacctgcgttcagtggctgtgtgaggtggctagaccaggaaatgattccatggcactaggcatgtataaggaaagacttactttggctctggcaaagtggttgtacaggttgtgggtgtcactttaaacatacaaagatctgcttgctggaggaggggcagcttcttgaggatcaggtgtgcatctgaaagggatgagctcatccttctaaccagacctgctctagacgctgactgaatgttttcctagttccaagtcctgcagctgggagaagcaggaaatgattgacacttcaggcacttggtgagtagc

SEQ ID NO: 38286 - DNA, 564 bp, Homo sapiens
ggcaaagaggggagtgcactgagccatgtacgcaaaatagttgaaaaacattttagagacgtggaaagccaaaagatactgcaacgttcacaagcccagcaaccacagaaggaggctgccctgtcatcctgagtccgtacacatggaggactcttccagcatccagccaaggaggcgctggtggtggcttcagcggaggcaggccgggggagggaagggatcctatatgtcctgttggctcttaacaaagggtcagcatttccaaatcttagacttgaacaaacaaaacacccaacaaaaaagaacaagagaataatttaaaagttgaatcattacttgactaacagacttcggtccaccatgtccttttcacagccctcttctggaacagtcaccttgttaattttatttttgaaaattattttcccactctgccctttacttctgactttcctttcctagtttgttcctgccattctgtttttataagtggctacacttgccttctgaatgattgaaagaaacttttacatcttttcttccaaaataaaagtaacaagctga

SEQ ID NO: 38287 - DNA, 409 bp, Homo sapiens
ggcgccactgcactccagcctgggcaacagtaaaactctgtctcaaaacataaaaataaaatgaaataaacatgtttatgaaggacaacgggggcccctccaagtgaaatcaggatgccaggggaggagctgggcccagatgataagccaccgagttagtcactgggcccacggacgcggcaggcagtctcaccagcttcactgggttactcttaaatggctttgcaggaggctgggccacagtctcatatgacaaggagccgtgtaggtgattttcattcctcaagcacagtttctgctggttctgttctgccttctcggttttcctgatctctttcatcctctttgttatccctaagatgacacaaagcaaggccagccagagcttcccccgaaataacccatcatc

SEQ ID NO: 38288 - DNA, 171 bp, Homo sapiens
aaagtgggttaaggatagtgtaatgaaatagatcgatttcacttatgactatgtagtcaaggatcctaagtaaaatattagcaaactgaatacagcagtgtttttttaaaaaaagtataggcccaaactaaataggatgcattccagtatttccagaatggtcaacattag

SEQ ID NO: 38289 - DNA, 396 bp, Homo sapiens
atcagtaagagaaattatctgaagtggatttgaagactcttcctttgattctagtgaagagatcctttaagaccctgagaaaacatgtggcaattctctgtgaatttggaaaggaagcattcacctatgaaagaaaatgcttccatcaggtacttcaaggttgaagaggcagaggacgagttatccacaaggaatttggaagagaagcttgtttcaaagttggatgagccatgagaacaactaccaaataaatcattgtgtggaaaagaattgatttgggaatcaattgtctgggaaagaaaatcacaaagaagtgattgtgaagacattcatttgttcttcagatatgtaactgtttaatctgaagtaaactttgggatggaaaactattaggaa

SEQ ID NO: 38290 - DNA, 421 bp, Homo sapiens
atatatccctgttaattttttttttacaaataatatggtttaattgtgcatatgtaataacaattctacaataacacttacttcctacaacattagaccctgagaaaacatgtggcaattctctgtgaatttggaaaggaagcattcacctatgaaagaaaatgcttccatcaggtacttcaaggttgaagaggcagaggacgagttatccacaaggaatttggaagagaagcttgtttcaaagttggatgagccatgagaacaactaccaaataaatcattgtgtggaaaagaattgatttgggaatcaattgtctgggaaagaaaatcacaaagaagtgattgtgaagacattcatttgttcttcagatatgtaactgtttaatctgaagtaaactttgggatggaaaactattaggaa

SEQ ID NO: 38291 - DNA, 126 bp, Homo sapiens
gtccacaatcaagttccaaatgaagaaggtgttatgtctggctgtagctgttggtcacgtgaagatgacagacgatgagcttgtgtataacattcacctggctgtcaacttcttggtgtcattgct

SEQ ID NO: 38292 - DNA, 382 bp, Homo sapiens
aacttgaggctgtatttgtaaaagggatatttaatgaagaaaatgttttgcaccttgtcccactggcttgggttgaaatacgataatgtttccttttgtatttaaaaaacacaaacaggatctcatccggagatatcatgaccttagacattcctgagacgtctgaaagggaagtgaacatatgtcagcatgcttgggtttaaaatataccaacttcatttctctcatcattcaaatctgcatgaggctcatgtgactttgaacaagctgtgctggaggattaaagacgggtcctaatgagaacctctctcttccagtaaaatctaggaattgaaaagcagttactacctcttccatttttttcctaaaaaaaaaaaataac

SEQ ID NO: 38293 - DNA, 515 bp, Homo sapiens
gttcatcagctatcaatagtgtatgttatgtgtggcctaagacaattcttcaatgtggccccaggaagccaaattttatacatacctggcatagactctggagccagattatatgagttcaaaacttgactgcacccctcttactagctgtgtgaccctggccatttcccttccctgtgcctcagtttcccctgtggtacgaagtggcattaagaatacctacctctggaccaggcacggtggctcatgcctgtagtcccaccaccctgggaggctgaggtgggcagattgcttgatctcaggaattcgagaccagcctgggcaacatggtgaaaccctgtctctaccaaaaatacaaaaaaatagtcgggtgtggtggtttgcacctgtggtcccagctactcatgaggctaaggcaggaggatcacttgaaccctggggtggggcggaggttgcagtaagccgagattgtgccaccacactgcagcctgggtgacagagtgagacctcgtctc

SEQ ID NO: 38294 - DNA, 430 bp, Homo sapiens
gggctggcctgctgcgggacggcttctccaccagcctcccgttcaaggcctccatttctgccactgcggcgtctgcatggttcctgagcatcccaagcacattcccacctcaaggccttggtgcttgcagttcatctgcttctctcctggtctatgcctggctggttcttatttcttttgaattcggacgaggtgcacctcatgagagaggccttccttgacctccctcctccattcctctcacaggccccatctgacatgcttgccctccccctcccctacccccatccccttgtgagccccatgagagaagggcctctgtccttaggtagatgtgattccccagaacccaggacaggacagccacacaggaggaaactgacacacttttcttaaatgatggaataaagtactgactgtgtttcaagca

SEQ ID NO: 38295 - DNA, 301 bp, Homo sapiens
taaacagctgatattgacattatggtgagttttaaaaatagaaatccagtaagagaagacaattagtagagaaatggtttaaattatttgctgtgggaggtggaggggtgccccaggagtggaggacagagacattccagatgctgaagggtcttgatgcattccatgtcaccccaaacgtcaaacaaagcaaagctcttgtcctgacaatgcataatgctttagaacttacttctaattgtaaaaatagtgtatgttcttggtaaaataaaaatttgcatggtatagaagtttataagtt

SEQ ID NO: 38296 - DNA, 389 bp, Homo sapiens
cttaatacgaggaaaagcaatcagtatgctccgaaaggttaactattctggtcattaccatcatccaattctctgctctcaacaatcacattagctttcttcaacagctgccttctgcagctgataaaaactgcactatctgtaatatctttgagagaggaagtaaaaaatacaaatcactgcttaaagtcctcactgctaataccagaaactaagcagaaaagggaaagctaatcttattaaaacccttgcagttctggtctctaattacaaacacacatttattagaaggtaggcacattactgggcacaacactatgaccttccaggtatttctttaacccagaacaataataaaagtgttacaaggtgccttccatattgtcctg

SEQ ID NO: 38297 - DNA, 1169 bp, Homo sapiens
aatgaaatttgaagtttggataggagacattgtaaaactcaagaatgggaaaaaaaaattttaacagaagtatgtatgaaggaaatattttaagtataatctacccaaagaaaataactgctacagccaacattaaaggttttattccctgttttgttaagtaacttcactccaaattgtgacattctttagagaaaatattttccttaagagtagttatttacgtgttttattgggggagcatattttcaggggggcaacatcttgctaagaacatttgattagcctcacttctgtcctcaccttctatattgcttacttttcaagatatttcttctgagcccttttctttgtatgcccagctccctgttatgtaattaagtagttgattaccattccaaatgcttcccctacacaaggctgttgtccaccctgtttcatgaatttgtgaattaagtaggtgcctaatattttcctactattagggtgaaaaggaataagaaactaaagtggcttccaaatgtttgtgtcttggtttcttcaccctagtgcaaaataggaaatgtttattggcagtcatttcttttccattactccttttaaccacattacaaaaagctaggattttgtgtctagaaggagacttgtattaaaagacaagattcttagtagttattcatcaggcttaagtttcctggtgtatttcttgtgggagaggtagaaggacattttgtagtagtattctaactattaatataatgctgcttgggttatcagaaagtattgaatacttcagataagtcaagttagtatttagtatagcagctgttcttcagagcacaggaaactgggatagtatgtagtattatgctgtttccattattgtttctcattgcataacacttttaatttatatgttggtatacaatttgcccctttactaaaaaaaaaaatctagtttcattcttgttccttgccacattaagcagttttttcatttacgttttaaattttcttaatattagaagaaaaagaaaacagaacaaaagagaaatgtcatgacttagaaaaggaaattttaagttttatggaatactgtagctttattttctgacatttctgcttatagatagattagaaaatccttgtttcttttgtttgctttgttt

SEQ ID NO: 38298 - DNA, 2580 bp, Homo sapiens
tatttgcacctagaaattttaggcaagtgatagctgcgtaatcatactgcggcaccgtttttttcttgcagcagtagctgcttgcggaggaggtctgcccactgcagctctctgcagtctccggctctctcctgcaggatcggtcaacgcagccgtcgccgccctctgcacccagcccaggtcgccactgcttcagtccggttctcaaagcctcagcaccatcttttatccccgagcagcctggatcgtcgttccctcagtccggacgccactgctaggtccgaccaccgccgcttctgatatttcggtgagtcttttcctgtggaggtttggtctcccgatctctgtggtagccaccttaggcgtgtacggtcctttgaaaaatggccgagtcagagaaccgcaaggagctgtcagaatccagtcaagaagaggctggtaatcagataatggtggaagggctcggggaacatctggagcgcggtgaagatgccgctgctgggcttggagacgatgggaagtgcggtgaagaagctgccgctgggcttggggaagaaggggaaaacggtgaagatactgctgctgggtccggggaagatgggaaaaaaggtggcgatactgatgaggactcagaggcagaccgtccaaaaggacttatcggttatgttttagatacagactttgttgaaagtctacctgtgaaagttaagtaccgtgtgttagcccttaaaaagcttcaaactagagcggccaatttagaatccaaattcctgagggaatttcatgacattgaaagaaagtttgctgaaatgtaccaacccttactggaaaaaagacgtcagatcatcaatgcaatctatgaacctacagaagaggaatgtgaatataaatcagactctgaggactgtgatgatgaggaaatgtgtcatgaagagatgtatggtaatgaggagggtatggtacatgaatatgtggatgaggacgatggttatgaggactattattatgattatgctgtggaagaggaggaggaggaggaggaggaggacgacattgaggctactggagaagagaataaagaagaggaggatcctaagggaattcctgatttttggctaactgttttaaaaaacgttgatacactcactcctttgattaagaaatatgatgagcctattctgaagctcctgacagatattaaagttaagctttcagatcctggcgagcccctcagtttcacactagaatttcacttcaaacccaatgaatatttcaaaaatgagttgttgacaaagacctatgtgctgaagtcaaagctagcatattatgatccccatccctataggggaactgcgattgagtattccacaggctgtgagatagattggaatgaaggaaagaatgtcactttgaaaaccatcaagaagaaacagaaacatcggatctggggaacaatccgaactgtaactgaagattttcccaaggattcatttttcaattttttctctcctcatggaatcacctcaaatggaagggatggaaatgatgattttttacttggtcacaatttacgtacttacataattccaagatcagtattatttttctcaggtgatgcactggaatctcagcaggagggggtagttagagaagttaatgatgcaatttatgacaaaattatttatgataattggatggctgcaattgaggaagttaaagcttgttgcaaaaaccttgaggcattagtagaagacattgatcgttagagcagagtatacatggccctgaaattaactgccctagatatagttactcaaggtataagaagccttgtgttctgtatttttcttgtagtgttagttaaaacatatgtttcaaaaatataagaaaagttcaaaaactaattaatttgaccttgagttttagtagtagaatgttttcaagaaatgtacactgtggtaaatgatttaaaacactagtatagtgttgtgtagcttaatccttctgaagtctttttgtcatgtagctattaatctgtggctatgaaatgatcagaaatgctaagtgagatcaatatttgtttggaaaaaaaatcttgggaaacaacccaagggttttcgctgttgttgtttttctttttctatttttgtttacttagtcctttagctagtggatttaattttgttgtgcctgcttcattttgcaataacaatgcagtagaatttaaaacttggatgcttaagaggcctgcatatagataagaatttcaggcaaaactacatttattgttaataacagcttgttcataggctcttgtattttatgtaactgtgataaataatgaaacttagttatattgaggttattgtttgtcggtgaagtgttagtcacagtattttcaaaagtttgcacatattgttctgtgtaattgtgtaagccataattacagtgtttaattctcttttcctattacatcattcattgaaagtgatcactttaccattttgaaaagatatttcgtgttctttcactgcaaaataaaaagaataaaaatttaaatgtctcatgtttaaaacttaa

SEQ ID NO: 38299 - DNA, 2526 bp, Homo sapiens
tatttgcacctagaaattttaggcaagtgatagctgcgtaatcatactgcggcaccgtttttttcttgcagcagtagctgcttgcggaggaggtctgcccactgcagctctctgcagtctccggctctctcctgcaggatcggtcaacgcagccgtcgccgccctctgcacccagcccaggtcgccactgcttcagtccggttctcaaagcctcagcaccatcttttatccccgagcagcctggatcgtcgttccctcagtccggacgccactgctaggtccgaccaccgccgcttctgatatttcggtgagtcttttcctgtggaggtttggtctcccgatctctgtggtagccaccttaggcgtgtacggtcctttgaaaaatggccgagtcagagaaccgcaaggagctgtcagaatccagtcaagaagaggctggtaatcagataatggtggaagggctcggggaacatctggagcgcggtgaagatgccgctgctgggcttggagacgatgggaagtgcggtgaagaagctgccgctgggcttggggaagaaggggaaaacggtgaagatactgctgctgggtccggggaagatgggaaaaaaggtggcgatactgatgaggactcagaggcagaccgtccaaaaggacttatcggttatgttttagatacagactttgttgaaagtctacctgtgaaagttaagtaccgtgtgttagcccttaaaaagcttcaaactagagcggccaatttagaatccaaattcctgagggaatttcatgacattgaaagaaagtttgctgaaatgtaccaacccttactggaaaaaagacgtcagatcatcaatgcaatctatgaacctacagaagaggaatgtgaatataaatcagactctgaggactgtgatgatgaggaaatgtgtcatgaagagatgtatggtaatgaggagggtatggtacatgaatatgtggatgaggacgatggttatgaggactattattatgattatgctgtggaagaggaggaggaggaggaggaggaggacgacattgaggctactggagaagagaataaagaagaggaggatcctaagggaattcctgatttttggctaactgttttaaaaaacgttgatacactcactcctttgattaagaaatatgatgagcctattctgaagctcctgacagatattaaagttaagctttcagatcctggcgagcccctcagtttcacactagaatttcacttcaaacccaatgaatatttcaaaaatgagttgttgacaaagacctatgtgctgaagtcaaagctagcatattatgatccccatccctataggggaactgcgattgagtattccacaggctgtgagatagattggaatgaaggaaagaatgtcactttgaaaaccatcaagaagaaacagaaacatcggatctggggaacaatccgaactgtaactgaagattttcccaaggattcatttttcaattttttctctcctcatggaatcacctcaaatggaagggatggaaatgatgattttttacttggtcacaatttacgtacttacataattccaagatcagtattatttttctcaggtgatgcactggaatctcagcaggagggggtagttagagaagttaatgatgcaatttatgacaaaattatttatgataattggatggctgcaattgaggaagttaaagcttgttgcaaaaaccttgaggcattagtagaagacattgatcgttagagcagagtatacatggccctgaaattaactgccctagatatagttactcaaggtataagaagccttgtgttctgtatttttcttgtagtgttagttaaaacatatgtttcaaaaatataagaaaagttcaaaaactaattaatttgaccttgagttttagtagtagaatgttttcaagaaatgtacactgtggtaaatgatttaaaacactagtatagtgttgtgtagcttaatccttctgaagtctttttgtcatgtagctattaatctgtggctatgaaatgatcagaaatgctaagtgagatcaatatttgtttggaaaatttttgtttacttagtcctttagctagtggatttaattttgttgtgcctgcttcattttgcaataacaatgcagtagaatttaaaacttggatgcttaagaggcctgcatatagataagaatttcaggcaaaactacatttattgttaataacagcttgttcataggctcttgtattttatgtaactgtgataaataatgaaacttagttatattgaggttattgtttgtcggtgaagtgttagtcacagtattttcaaaagtttgcacatattgttctgtgtaattgtgtaagccataattacagtgtttaattctcttttcctattacatcattcattgaaagtgatcactttaccattttgaaaagatatttcgtgttctttcactgcaaaataaaaagaataaaaatttaaatgtctcatgtttaaaacttaa

SEQ ID NO: 38300 - DNA, 1125 bp, Homo sapiens
tatttgcacctagaaattttaggcaagtgatagctgcgtaatcatactgcggcaccgtttttttcttgcagcagtagctgcttgcggaggaggtctgcccactgcagctctctgcagtctccggctctctcctgcaggatcggtcaacgcagccgtcgccgccctctgcacccagcccaggtcgccactgcttcagtccggttctcaaagcctcagcaccatcttttatccccgagcagcctggatcgtcgttccctcagtccggacgccactgctaggtccgaccaccgccgcttctgatatttcggtgagtcttttcctgtggaggtttggtctcccgatctctgtggtagccaccttaggcgtgtacggtcctttgaaaaatggccgagtcagagaaccgcaaggagctgtcagaatccagtcaagaagaggctggtaatcagataatggtggaagggctcggggaacatctggagcgcggtgaagatgccgctgctgggcttggagacgatgggaagtgcggtgaagaagctgccgctgggcttggggaagaaggggaaaacggtgaagatactgctgctgggtccggggaagatgggaaaaaaggtggcgatactgatgaggactcagaggcagaccgtccaaaaggacttatcggttatgttttagatacagactttgttgaaagtctacctgtgaaagttaagtaccgtgtgttagcccttaaaaagcttcaaactagagcggccaatttagaatccaaattcctgagggaatttcatgacattgaaagaaagtttgctgaaatgtaccaacccttactggaaaaaagacgtcagatcatcaatgcaatctatgaacctacagaagaggaatgtgaatataaatcagactctgaggactgtgatgatgaggaaatgtgtcatgaagagatgtatggtaatgaggagggtatggtacatgaatatgtggatgaggacgatggttatgaggactattattatgattatgctgtggaagaggtagagttattttatgatttttttatttgttgtggtttgaatttatgtttatttttttgtttattattatatttaaaggtattatttttattaattttgt

SEQ ID NO: 38301 - DNA, 1041 bp, Homo sapiens
ggtagtacgggaagggtataaccaacattttcggggtatgggcccgatagcttatttagcctcgtgccgaattcggcacgatggaatctcagcaggagggggtagttagagaagttaatgatgcaatttatgacaaaattatttatgataattggatggctgcaattgaggaagttaaagcttgttgcaaaaaccttgaggcattagtagaagacattgatcgttagagcagagtatacatggccctgaaattaactgccctagatatagttactcaaggtataagaagccttgtgttctgtatttttcttgtagtgttagttaaaacatatgtttcaaaaatataagaaaagttcaaaaactaattaatttgaccttgagttttagtagtagaatgttttcaagaaatgtacactgtggtaaatgatttaaaacactagtatagtgttgtgtagcttaatccttctgaagtctttttgtcatgtagctattaatctgtggctatgaaatgatcagaaatgctaagtgagatcaatatttgtttggaaaaaaaatcttgggaaacaacccaagggttttcgctgttgttgtttttctttttctatttttgtttacttagtcctttagctagtggatttaattttgttgtgcctgcttcattttgcaataacaatgcagtagaatttaaaacttggatgcttaagaggcctgcatatagataagaatttcaggcaaaactacatttattgttaataacagcttgttcataggctcttgtattttatgtaactgtgataaataatgaaacttagttatattgaggttattgtttgtcggtgaagtgttagtcacagtattttcaaaagtttgcacatattgttctgtgtaattgtgtaagccataattacagtgtttaattctcttttcctattacatcattcattgaaagtgatcactttaccattttgaaaagatatttcgtgttctttcactgcaaaataaaaagaataaaaatttaaatgtctcatgtttaaaacttaa

SEQ ID NO: 38302 - DNA, 784 bp, Homo sapiens
agaaacttaaattctcccaagataggcatgatttgtaaatgagctagctgggaagctgggataaaatatttaagattcattgattttggctggtcaaacatgccccattcaaatagggccgccttcaagttctcaggctgagaccccactatgattttagcttttaaaaacttagttgacatctcaagtatgttctcacttcatgcttccagttatatatattattctattgtcccaaacgtaataggtccagaacaaaaatattataatatcttactccacaatagctcataatcagaactacaaagtttggaattttatcgtttgtcagttgtttccatgataaattataaaatctttggaaaaccaaaattatattttactccatttatatattttccataatatctagaacagggccgggtacataaaaatcacttatgggaccagtggtggcactttgggaggcactttggggacgcctgatcaacatagtgagaccccatctctacaaaaaatttaaaaactagctgggcatggtggctactcaaaacgctgaagtggaaggatcgcttgagcccaggagttcaaggctgcagtgagctatgattgtgccactgcactgtagcctgggtgacagagcaagactctgtctctaaaaaaaaaaaaaaaaagaaagaaacaaattgcttatgaataaatacttgttcactagttttattagaaacttaaattctcccaagataggcatgatttgtaaatgagctagctgggaagctgggat

SEQ ID NO: 38303 - DNA, 1600 bp, Homo sapiens
ctgggccgcggctacccagagtcagggccacggagcttaggagaccttgggtcagctctgcaaaggggttgtttactgaatgcttctggtatctgcagccccgctggggttcggacagggggtctggaatagggcttcacaactacagcagggctaggaccctcttgggctggaaggagctggagaggcctctgcaagctgtcacaggctcttggtgctggcactggctcaggctttcacacacacacacgcgcacacacacacacacacacacacggacaggcacccccttggtggccttcacagtttcaccttcaggctcaaagctggctctgcaggggacatgagaggcacaccgaagacccacctcctggccttctccctcctctgcctcctctcaaaggtgcgtacccagctgtgcccgacaccatgtacctgcccctggccacctccccgatgcccgctgggagtacccctggtgctggatggctgtggctgctgccgggtatgtgcacggcggctgggggagccctgcgaccaactccacgtctgcgacgccagccagggcctggtctgccagcccggggcaggacccggtggccggggggccctgtgcctcttggcagaggacgacagcagctgtgaggtgaacggccgcctgtatcgggaaggggagaccttccagccccactgcagcatccgctgccgctgcgaggacggcggcttcacctgcgtgccgctgtgcagcgaggatgtgcggctgcccagctgggactgcccccaccccaggagggtcgaggtcctgggcaagtgctgccctgagtgggtgtgcggccaaggagggggactggggacccagccccttccagcccaaggaccccagttttctggccttgtctcttccctgccccctggtgtcccctgcccagaatggagcacggcctggggaccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacacggtgtccaccatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtcccctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgctgccttttctggagtttgtaaaattgttcctgaatacaagcctatgcgtga

SEQ ID NO: 38304 - DNA, 1953 bp, Homo sapiens
ctgggccgcggctacccagagtcagggccacggagcttaggagaccttgggtcagctctgcaaaggggttgtttactgaatgcttctggtatctgcagccccgctggggttcggacagggggtctggaatagggcttcacaactacagcagggctaggaccctcttgggctggaaggagctggagaggcctctgcaagctgtcacaggctcttggtgctggcactggctcaggctttcacacacacacacgcgcacacacacacacacacacacacggacaggcacccccttggtggccttcacagtttcaccttcaggctcaaagctggctctgcaggggacatgagaggcacaccgaagacccacctcctggccttctccctcctctgcctcctctcaaaggtgcgtacccagctgtgcccgacaccatgtacctgcccctggccacctccccgatgcccgctgggagtacccctggtgctggatggctgtggctgctgccgggtatgtgcacggcggctgggggagccctgcgaccaactccacgtctgcgacgccagccagggcctggtctgccagcccggggcaggacccggtggccggggggccctgtgcctcttggcagaggacgacagcagctgtgaggtgaacggccgcctgtatcgggaaggggagaccttccagccccactgcagcatccgctgccgctgcgaggacggcggcttcacctgcgtgccgctgtgcagcgaggatgtgcggctgcccagctgggactgcccccaccccaggagggtcgaggtcctgggcaagtgctgccctgagtgggtgtgcggccaaggagggggactggggacccagccccttccagcccaaggaccccagttttctggccttgtctcttccctgccccctggtgtcccctgcccagaatggagcacggcctggggaccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacacggtgtccaccatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtcccctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgctgccttttctggagtttgtaaaattgttcctgaatacaagcctatgcgtgatcttgtgtgtcaggcctgtgttttctgagaaagccctcccattatccggggcagaattcaggggcagagttctctgtgaacctcacaaggtgaaatcacatggtcttaaagaaagccagaagacaggccttcaagtgatccaagaaacccaattcatattaataataattaacttttttatttatttatttttttgagatggagttttgctcttgttgcccaggctggagctggagtacaatagcacgatctcgactcactgcagcctcccgggttcaagtgattctcctgcctcaagactcctgagtagctgggattataggcgcatgccaccatgctcggctttttttttt

SEQ ID NO: 38305 - DNA, 1800 bp, Homo sapiens
ctgggccgcggctacccagagtcagggccacggagcttaggagaccttgggtcagctctgcaaaggggttgtttactgaatgcttctggtatctgcagccccgctggggttcggacagggggtctggaatagggcttcacaactacagcagggctaggaccctcttgggctggaaggagctggagaggcctctgcaagctgtcacaggctcttggtgctggcactggctcaggctttcacacacacacacgcgcacacacacacacacacacacacggacaggcacccccttggtggccttcacagtttcaccttcaggtaaatgggctcatcctttgagccatgaggatgggaagcgaagcaaggaatgaaaaagctagtgtgtttgtgtgtgtgtgtgtgtgtgtgtgtgtgtgtgcacgcgcgcgcgcgcgtgtgtacgcgtgcgtgtgcctgtgtgtgcctgggagtgacctcacagctgccggaacataaagactcacaggtccgtctcccaggctcaaagctggctctgcaggggacatgagaggcacaccgaagacccacctcctggccttctccctcctctgcctcctctcaaaggtgcgtacccagctgtgcccgacaccatgtacctgcccctggccacctccccgatgcccgctgggagtacccctggtgctggatggctgtggctgctgccgggtatgtgcacggcggctgggggagccctgcgaccaactccacgtctgcgacgccagccagggcctggtctgccagcccggggcaggacccggtggccggggggccctgtgcctcttggcagaggacgacagcagctgtgaggtgaacggccgcctgtatcgggaaggggagaccttccagccccactgcagcatccgctgccgctgcgaggacggcggcttcacctgcgtgccgctgtgcagcgaggatgtgcggctgcccagctgggactgcccccaccccaggagggtcgaggtcctgggcaagtgctgccctgagtgggtgtgcggccaaggagggggactggggacccagccccttccagcccaaggaccccagttttctggccttgtctcttccctgccccctggtgtcccctgcccagaatggagcacggcctggggaccctgctcgaccacctgtgggctgggcatggccacccgggtgtccaaccagaaccgcttctgccgactggagacccagcgccgcctgtgcctgtccaggccctgcccaccctccaggggtcgcagtccacaaaacagtgccttctagagccgggctgggaatggggacacggtgtccaccatccccagctggtggccctgtgcctgggccctgggctgatggaagatggtccgtgcccaggcccttggctgcaggcaacactttagcttgggtccaccatgcagaacaccaatattaacacgctgcctggtctgtctggatcccgaggtatggcagaggtgcaagacctagtcccctttcctctaactcactgcctaggaggctggccaaggtgtccagggtcctctagcccactccctgcctacacacacagcctatatcaaacatgcacacgggcgagctttctctccgacttcccctgggcaagagatgggacaagcagtcccttaatattgaggctgcagcaggtgctgggctggactggccatttttctgggggtaggatgaagagaaggcacacagagattctggatctcctgctgccttttctggagtttgtaaaattgttcctgaatacaagcctatgcgtga

SEQ ID NO: 38306 - DNA, 454 bp, Homo sapiens
cagttgtagcagtgtacacctgtggtcccagtaacttggcaagctgaagtgaaaggattgcttgaacctaggagttcaaggctgcaatgaaccataatcacaccacttcactccagcctaggcaacagtgagatcctacctcaaaaaaaaggcaactgcaatactgttgtgtctctgaaacatacgcatgcactatgggctgtgggagaacatggcactcagatcttcctcccagggttggattaaggtgaatctggaggaatcttggtctgagttaactcagagaaagtgtgatgagctgctcaaacagtgggtaaagagattgagcaatgggggaggactggccatggatgacacagccagattttgaggagagcctgggtggctgacaaggatggtggagagctggttttgctagggtggtaaacctgcctttcctggagccaagacacca

SEQ ID NO: 38307 - DNA, 1261 bp, Homo sapiens
agatacatgcatctgatttggtattgtgatttacttcagaccctgaaaccaaatatctgatcttccattagacttaggggtcatgatatgagtggaatttacattttagatactataggggaaagaaaagtctcaaaaagaagtattgcatgtctaaaagctagtgccctgagtactcatgaattcgattccaagagtagtggtgtaaattgccttggagccctgcatccacgtcttgtaactaacttttgaattttgcctgacatgattctctcttgatgaagaaatgacatatattatctttgaatatctacaaggaaagttaccaacttatgtaggggtgaaatttggataggcggtatgctcaaagcagccagcaatgagtgctctgttttgatccttcttcttattatggaaaggagtacaggacctcttcagtcttccccttaccagaggtagcctctgcaaatggcataccagatgggactctaagatgcttgtgtggtggcttcttgtccttctctttgacttctgtggcatggtgctagtgcatgtaccctgtggtattgcccctctgtccgtagtgtgaactgtcctgtgagctttatgtcaggagactgtgaccttcatgtccagcttcaaagagttgtgcatgaactcggtaatacacatcacacggctgagagtcccctttccaggcagggccagcatgtgtagaatatctttcagaatatggtttcaccatgaaacaggggtggtagatttattcccttgtgtcaggccaaagaagttcttacaaagtacagtgggtagtgtctaaagcgacactttactcacagcctggcttgagtcaacaggaacaccatagcacccacaaatacttctacttgaatcatattctgtgctttttcaatcactagtgcagaataggctgcatttgacacagactgttaggcaatattgatttttttgttttgtttttatttggttttatctgagataacttatgttcaaggtgagaataagaaatagccaactagttaaaatgtatgaaaagaaaactttcccctgctgtatttgttgtgtaacataaataagccttctgagaagcagggtgaataaagtttagggagctgggacacctggtcctgctagctggaccactggctcatcatgcaatgaaaaggtgagcagacttaacccctccgtgcctcagctttttccccacagacacctacctcacaggggcattgagaaaaaa

SEQ ID NO: 38308 - DNA, 656 bp, Homo sapiens
ctgaagtgccacatgcatgccaggtatttgatagctgtgaggtcagaggtggcatctctatggcccatatgggcagtggcgtgattgggacaccctcacagaccctgcatttgtattgctcagttcatcgtcctatttcagaacccagagtcccttatgacagagcctttcagacctaagcagctcagctccacatagaaaattctttctgagtcttcagccacactcaggccccccacacacctcacccactcctgtctctgtgtctttcccccttctcagaggaccactggacctgctctaaaggagagcgtgtggtgtacgtcaccccctccacaacttcccagcctcgagccaggagcgtccatgcatttattttctaagggaaaaaaaaataagtattttagggaactatactgtctacatttagctctcctgggtgtctatgttcttttctaaatatttgtttttctcgatcctcgggtgttagcatatggtctgcacttcctttgtagtgtatttggtattttcaacattaccgaaacccctttcttgttgttttttattgttttgttttgtttgagacaaagtctcattgtatagcccactgcactccagcctgaaaaaacagggcaagaccgtttctgaaaaaaaaa

SEQ ID NO: 38309 - DNA, 1067 bp, Homo sapiens
gaaacttttctatagttggctcaaatttagtataattcttgtcttgtgcatatatgtcatataactcatggtcctgaataatgaaataacacacaaagcctagtatattaaaacttgacctgtaaaaagcacatgcggctgggcgcagtggctcatgcctgtaatcctagcactttgggaggccgagacgggtggatcacgaggtcaagagatcgagaccatcctggcaaacatggtgaaaccccatctctactaaaaatacaaaaaatgagctgggcatggtggtgggcttctgtagtcccagctacttgggaggctgaggcaggagaatcacttgaacacgggaggtggaggttgcagtgagccaagattgcaccactgcactccagcgtggtgacaaagggagactccgactcaaaaaaaaaaagcagcacatgcctattagccttgtcctttcaccatttctcattataaaagagtgccctggcataagcctgtgaatgtttagggaaatataatgctttaacttggattagagtttagctttttggaattttcagttcttaatattaaggtaatgcttactaaagcacaaaaagtaaatgtcctgtggtaattatgttcaagtggaattgtacattgattcttaccttagagggtagtgtgactgatggtcataagagctgattaaaagctaaaatggaggcaacgatttaaagtactggttttcatttgaatgtgaaaaagaataaaccactggtttggataaatcttataaaaatattgtgcgtagtcatcgtaaaaaggagaaagaaaatgtgacaaaagatagaggaaagttaaaatcatttgtaatctcacacagaaatagctacccaaccactgttaacactttggagtttttctattttgtttcacgaataagtttgctttttaaaggcaaaatttagatgtggagtttttgtaataatgatactggtaatgataatgcttataattaatatcatttgttaaatatttaccttacgcctagccttttattaaatgctttgtatttagtagctcat

SEQ ID NO: 38310 - DNA, 436 bp, Homo sapiens
tttttttgagatggaatcttgctctgctgcccaggctggagtgcagtggcacaatcccagctcactgcaacctccgcttcctgggttcaagcaattctcctgcctcagtctcccgagtagctgggattacaggcgcgcgccaccacacccggctaatttttgaatttttagtagatgcacggttttaccacgttggccaggctggcctcgaactcctgacctcaagtgatctgcttgcctcagcctcttaaagtgctgggattacaggcatgagccaccacggctggccctaggcaacattctaaccaccctgcaaggatgttatctttcccctcccaaattcccatgccttttgcattttgctgatagctactatgttctctttgacatatatttattggcatacctggtttacatactcctttctgacagaaat

SEQ ID NO: 38311 - DNA, 669 bp, Homo sapiens
gcaaagactcatttcctaatgacagccttttgtaactgaagatctaaataaggtaaaaaataaaaatgcttctccatttctacaagaagtggccagccaggaaagggacttcttgtctaaccctcctgtgaaaatgaggctcattcagtcagatttcaacccagccttctccactttctgcctccatcacccttccgggggcagaatttagcagtggtctgccaccccgagcagccgctcccacaggaactgcctcattaagctctgtgaccagtaactcccaacttaggaaaagctcaagaaggaccactctgctttgtttgcacttttccaagaacccttactacataaaacgttctaaacttgggaacactaacttttgcactgtttcccaccgagccacagagctcgcaccagcatcacgctctccctttgccaggatctgagctcgctggaggaaaatacaagttcctctttcagcttctttccttcacttctggagacaagctttccagctaccaaaacagaacgtttcccaggttttcctcccacacctatgaactttgttccttgattaaatcctagtttcccctctaaacagaactggactatgtccaaccaatgtcttcagtttctgcaaacattaactctgatgttttttttcaagag

SEQ ID NO: 38312 - DNA, 383 bp, Homo sapiens
gctagaaagtgggcttggcagggatacagcaaaactccatgccctagtttccaccatgggtacagctgccccttgtccagaggtgtccacagcgtaggtacctggtggatgggtcaaggggaaggaagtcaatggccagtccagaagctttccccacagcgtcttttgatgttgtgctgaccgggaagtggtgttgtgccctggtggtcaagacctttgcctgtggagacatgctgcctggccagcctccatgctgggcaggtttcttgactgacacggaagtgaagtagatagtacctacctcaaagggtggttgtgaggcccaaatgagataatacatgtaaatcctgtggcagtgtgcccagctgtgcaagatcttaaaa

SEQ ID NO: 38313 - DNA, 384 bp, Homo sapiens
aaggaatgaaattccactgaaaccttttttgcctgtttggattgtgcctcattgacagtgataccactctggggctaagtctgatgtgtcacaacccaacagggtggggctttatctctttttcaattgattacatgaaataattgtattaaatagaaaatataaaggtataaatgccttgatatttatttcttatcagtccttatattccttagtagatctctatttaaagctctaaaattatttatcttctcctcccctgatacttcttttcagtctaaactctccaaattttgtgaatgtgaagaaacttacaaactctgaatatttctgaaaacaatcttctattgtaaaagtaatatgatcccattaaacaaaatttgt

SEQ ID NO: 38314 - DNA, 1853 bp, Homo sapiens
gaagaaatagacaaattcacaattgtggtcagatttcagcacccttccttcaatagataatagatcaagtagttggaaaaccaagaaggctatagaagacttgaacagtgctatcaaccacattgacttaattggcgtttatagaacgctactcaacagcaaactgcacactttttccaagcatagccagaacatttttcaagatagaccatattctgggtgggaaaataagtcaattaattctgaaggatttaaatcatacaaagagtgttcactgaccataatggaattaaattagaaaggaatctggaaaaatatcttgtaactgaacatcacacttccaaataacccaggggcacatcctgagacattaaaaacatcttaacaaatttaaaagaatagaaaccatacaaaatactttctgagactacagaattaaactaaaagttaatactgaaaaaagtgctggaaattttccaaatatttggaaattaaacagtatgcttctaaataacccatggatcaaagaaaaatctcaagaaaaatgtttaaatatttttaattttaatgaaaatacagtttatgaaaccatgtgggatacagctgaaacagtgcttcaaaatttgtagcattaaatgatgtattagaaaagaaaaagaacctaaaatcaataacctcagtttccacctttggaaactagaaaaagagaaacaaattaaacctgcagtgagcagaagaaagtaaatactgaaaattagagcggaaatcaacaaagttgaaaacaggaaaacaatggagaaaatcaacaaaataaaaagctggttctttgaaaagatcagtaaaatgataaatctctagccaggcaaccaaggaaaaatgagtacaccaattgccaatattaggaatgaaagaggtgttattctgctaatcccatggataaaatacaggattagtaagagaatagtataaataagctctcactcacatatttgataaattagataaaatagactagttccttgaaatacacatataaacttaaaacagcttctagacagcagacccagatggttgtactggtgaattctaccagccagccagtgtgacacaaacgaaatcaatcagcaccaaaaagaaatgagctggccgggtgcagtggctcacacctataaccccagcacctttggaggccgagatgggtggatcactgaaagttgggagttcgagaccagcctggccaacatggtgaaactgtgtctctactaaaaatacaaaaattagcctggcatgatggtgggcgcctgtaatctcaggtatacagactatacctgtagtcccagctactcgagaggctgaggtggagaattgctttaacctgggaggtggaggttacagtgagccgagattgccctactgcaccccagtctgggcgattgagccagactccatctcaaaaaaaaaaaaaaaaaaaaagaagaagaagaagaaaaaaataaaaaaaaaagaagtgagctatcaagccatgaaaaggcatggaagaaaattaaatgtgtattactaaagtaaaagaagccagtctcaaaaggctgcatactatataatttcaactatatgacattttagaaaatgcaaaactagacagtaaaaagatcggcaaaacttctctgtatgatgttataatgatggagaactgtcataaattttttcaaacccatagaatgtacaacaccaagagtgaactctaaaccatggattctgggtgataatgatgtgtcaatggaagtttatcagttgtaacaaatgtaccactctagtgggggatgtcgataatggagaaggctaagtgtgttggg

SEQ ID NO: 38315 - DNA, 318 bp, Homo sapiens
acagatagtaagtgaagtgaggctcaagagatgttgagttacttatccacggtcacacaggaattggcagagctaggcctggaacgtaggtcttctgtcatctgtaaatccagtgctgccctttgcacgtgacatcactgagggtgagaggccccgtgttccaatcacaacatgcattgcagcttcctgggggaaatgaagcaaaaacaaaactaaaaaacctgattatgtaagtttcctttggacaaccgaagagcttccatcattttcaactagcttccagtcttggtgtcagctgaactaagtcctatacaatgc

SEQ ID NO: 38316 - DNA, 2455 bp, Homo sapiens
ctcatcagacgggatgctggactgtgggttgggggcagcctcagcctctccaacctggcacccactgcccgtggcccttaggcacctgcttggggtcctggagccccttaaggccaccagcaaatcctaggagaccgagtcttggcacgtgaacagagccagatttcacactgagcagctgcagtcggagaaatcagagaaagcgtcacccagccccagattccgaggggcctgccagggactctctcctcctgctccttggaaaggaagaccccgaaagacccccaagccaccggctcagacctgcttctgggctgccatgggacttgcggccaccgccccccggctgtcctccacgctgccgggcagataagggcagctgctgcccttggggcacctgctcactcccgcagcccagccactcctccagggccagcccttccctgactcagtgaccacctctgctgccccgaggccatgtaggccgtgcttaggcctctgtggacacactgctggggacggcgcctgagctctcagggggacgaggaacaccaccatgccccggggcttcacctggctgcgctatcttgggatcttccttggcgtggccttggggaatgagcctttggagatgtggcccttgacgcagaatgaggagtgcactgtcacgggttttctgcgggacaagctgcagtacaggagccgacttcagtacatgaaacactacttccccatcaactacaagatcagtgtgccttacgagggggtgttcagaatcgccaacgtcaccaggctgcagagggcccaggtgagcgagcgggagctgcggtatctgtgggtcttggtgagcctcagtgccactgagtcggtgcaggacgtgctgctcgagggccacccatcctggaagtacctgcaggaggtgcagacgctgctgctgaatgtccagcagggcctcacggatgtggaggtcagccccaaggtggaatccgtgttgtccctcttgaatgccccagggccaaacctgaagctggtgcggcccaaagccctgctggacaactgcttccgggtcatggagctgctgtactgctcctgctgtaaacaaagctccgtcctaaactggcaggactgtgaggtgccaagtcctcagtcttgcagcccagagccctcattgcagtatgcggccacccagctgtaccctccgcccccgtggtcccccagctccccgcctcactccacgggctcggtgaggccggtcagggcacagggcgagggcctcttgccctgagcaccctggatggtgactgcggataggggcagccagaccagctcccacaggagttcaactgggtctgagacttcaaggggtggtggtgggagccccccttgggagaggacccctgggaagggtgtttttcctttgagggggattctgtgccacagcagggctcagcttcctgccttccatagctgtcatggcctcacctggagcggaggggacctggggacctgaaggtggatggggacacagctcctggcttctcctggtgctgccctcactgtccccccgcctaaagggggtactgagcctcctgtggcccgcagcagtgagggcacagctgtgggttgcaggggagacagccagcacggcgtggccattctatgaccccccagcctggcagactggggagctgggggcagagggcggtgccaagtgccacatcttgccatagtggatgctcttccagtttcttttttctattaaacaccccacttcctttgaaaaaaaaaaaaaacaaaaaaaaaaagaaaaaaaaaaaaaacaacacaaaaaaaaaaaaaacacgataaatacataaaaaacaaacaaaaaaaaaacaaaaaaaaaaaggggcgcgcggcgcccccaataatctcccctcgctggggtggcgcgcccctattcgccgcgcccccccgcctcgtcgtctttctgacgaagcgggcgcggctcccctcttctggagggggtgtctattctattctctgcgcgcagtagcttgcgtggtctgcttctaaacaaacccgcgctgcgtcgcggtgggtactcttcgtgtgtgtcgtggcggtttcttgtgtgggcggggcgccctcctctcttcctctgggggtgggggggtcgacctctgtctggggggcgggccccactcctctcgccatgcatgtttttttgtcgtccgtcgtgctgggtagtctatctcatgctttccttgctggccgcgcttagtactcaggtgtcgtggtctcctcaccgcggtctctacgctcgtgtgggccgtccgagtcacaagaatttgtctgctgctgcgcgtgttgacggttgtctatccctcggctgatcgatgacttctttttctctatgcgccgaggagcgacgctgtcgtgtcagtatacacagccgcacgcgaccgcccgggtt

SEQ ID NO: 38317 - DNA, 1831 bp, Homo sapiens
  misc_feature (1831)..(1831): n is a, c, g, or t
ctcatcagacgggatgctggactgtgggttgggggcagcctcagcctctccaacctggcacccactgcccgtggcccttaggcacctgcttggggtcctggagccccttaaggccaccagcaaatcctaggagaccgagtcttggcacgtgaacagagccagatttcacactgagcagctgcagtcggagaaatcagagaaagcgtcacccagccccagattccgaggggcctgccagggactctctcctcctgctccttggaaaggaagaccccgaaagacccccaagccaccggctcagacctgcttctgggctgccatgggacttgcggccaccgccccccggctgtcctccacgctgccgggcagataagggcagctgctgcccttggggcacctgctcactcccgcagcccagccactcctccagggccagcccttccctgactcagtgaccacctctgctgccccgaggccatgtaggccgtgcttaggcctctgtggacacactgctggggacggcgcctgagctctcagggggacgaggaacaccaccatgccccggggcttcacctggctgcgctatcttgggatcttccttggcgtggccttggggaatgagcctttggagatgtggcccttgacgcagaatgaggagtgcactgtcacgggttttctgcgggacaagctgcagtacaggagccgacttcagtacatgaaacactacttccccatcaactacaagatcagtgtgccttacgagggggtgttcagaatcgccaacgtcaccaggctgcagagggcccaggtgagcgagcgggagctgcggtatctgtgggtcttggtgagcctcagtgccactgagtcggtgcaggacgtgctgctcgagggccacccatcctggaagtacctgcaggaggtgcagacgctgctgctgaatgtccagcagggcctcacggatgtggaggtcagccccaaggtggaatccgtgttgtccctcttgaatgccccagggccaaacctgaagctggtgcggcccaaagccctgctggacaactgcttccgggtcatggagctgctgtactgctcctgctgtaaacaaagctccgtcctaaactggcaggactgtgaggtgccaagtcctcagtcttgcagcccagagccctcattgcagtatgcggccacccagctgtaccctccgcccccgtggtcccccagctccccgcctcactccacgggctcggtgaggccggtcagggcacagggcgagggcctcttgccctgagcaccctggatggtgactgcggataggggcagccagaccagctcccacaggagttcaactgggtctgagacttcaaggggtggtggtgggagccccccttgggagaggacccctgggaagggtgtttttcctttgagggggattctgtgccacagcagggctcagcttcctgccttccatagctgtcatggcctcacctggagcggaggggacctggggacctgaaggtggatggggacacagctcctggcttctcctggtgctgccctcactgtccccccgcctaaagggggtactgagcctcctgtggcccgcagcagtgagggcacagctgtgggttgcaggggagacagccagcacggcgtggccattctatgaccccccagcctggcagactggggagctgggggcagagggcggtgccaagtgccacatcttgccatagttgtactgctttataaaaaccaggtgtgcgtttttttttcgtaagttaaaccacccccccacgttccattcctcctctctcctcctcgctccccccctctn

SEQ ID NO: 38318 - DNA, 1779 bp, Homo sapiens
ctcatcagacgggatgctggactgtgggttgggggcagcctcagcctctccaacctggcacccactgcccgtggcccttaggcacctgcttggggtcctggagccccttaaggccaccagcaaatcctaggagaccgagtcttggcacgtgaacagagccagatttcacactgagcagctgcagtcggagaaatcagagaaagcgtcacccagccccagattccgaggggcctgccagggactctctcctcctgctccttggaaaggaagaccccgaaagacccccaagccaccggctcagacctgcttctgggctgccatgggacttgcggccaccgccccccggctgtcctccacgctgccgggcagataagggcagctgctgcccttggggcacctgctcactcccgcagcccagccactcctccagggccagcccttccctgactcagtgaccacctctgctgccccgaggccatgtaggccgtgcttaggcctctgtggacacactgctggggacggcgcctgagctctcagggggacgaggaacaccaccatgccccggggcttcacctggctgcgctatcttgggatcttccttggcgtggccttggggaatgagcctttggagatgtggcccttgacgcagaatgaggagtgcactgtcacgggttttctgcgggacaagctgcagtacaggagccgacttcagtacatgaaacactacttccccatcaactacaagatcagtgtgccttacgagggggtgttcagaatcgccaacgtcaccaggctgcagagggcccaggtgagcgagcgggagctgcggtatctgtgggtcttggtgagcctcagtgccactgagtcggtgcaggacgtgctgctcgagggccacccatcctggaagtacctgcaggaggtgcagacgctgctgctgaatgtccagcagggcctcacggatgtggaggtcagccccaaggtggaatccgtgttgtccctcttgaatgccccagggccaaacctgaagctggtgcggcccaaagccctgctggacaactgcttccgggtcatggagctgctgtactgctcctgctgtaaacaaagctccgtcctaaactggcaggactgtgaggtgccaagtcctcagtcttgcagcccagagccctcattgcagtatgcggccacccagctgtaccctccgcccccgtggtcccccagctccccgcctcactccacgggctcggtgaggccggtcagggcacagggcgagggcctcttgccctgagcaccctggatggtgactgcggataggggcagccagaccagctcccacaggagttcaactgggtctgagacttcaaggggtggtggtgggagccccccttgggagaggacccctgggaagggtgtttttcctttgagggggattctgtgccacagcagggctcagcttcctgccttccatagctgtcatggcctcacctggagcggaggggacctggggacctgaaggtggatggggacacagctcctggcttctcctggtgctgccctcactgtccccccgcctaaagggggtactgagcctcctgtggcccgcagcagtgagggcacagctgtgggttgcaggggagacagccagcacggcgtggccattctatgaccccccagcctggcagactggggagctgggggcagagggcggtgccaagtgccacatcttgccatagtggatgctcttccagtttcttttttctattaaacaccccacttcctttg

SEQ ID NO: 38319 - DNA, 1689 bp, Homo sapiens
agagatgtctgcatgaggaacagaggctgctttgtggattggggagctccccattagcggaggcagagccagatttcacactgagcagctgcagtcggagaaatcagagaaagcgtcacccagccccagattccgaggggcctgccagggactctctcctcctgctccttggaaaggaagaccccgaaagacccccaagccaccggctcagacctgcttctgggctgccatgggacttgcggccaccgccccccggctgtcctccacgctgccgggcagataagggcagctgctgcccttggggcacctgctcactcccgcagcccagccactcctccagggccagcccttccctgactcagtgaccacctctgctgccccgaggccatgtaggccgtgcttaggcctctgtggacacactgctggggacggcgcctgagctctcagggggacgaggaacaccaccatgccccggggcttcacctggctgcgctatcttgggatcttccttggcgtggccttggggaatgagcctttggagatgtggcccttgacgcagaatgaggagtgcactgtcacgggttttctgcgggacaagctgcagtacaggagccgacttcagtacatgaaacactacttccccatcaactacaagatcagtgtgccttacgagggggtgttcagaatcgccaacgtcaccaggctgcagagggcccaggtgagcgagcgggagctgcggtatctgtgggtcttggtgagcctcagtgccactgagtcggtgcaggacgtgctgctcgagggccacccatcctggaagtacctgcaggaggtgcagacgctgctgctgaatgtccagcagggcctcacggatgtggaggtcagccccaaggtggaatccgtgttgtccctcttgaatgccccagggccaaacctgaagctggtgcggcccaaagccctgctggacaactgcttccgggtcatggagctgctgtactgctcctgctgtaaacaaagctccgtcctaaactggcaggactgtgaggtgccaagtcctcagtcttgcagcccagagccctcattgcagtatgcggccacccagctgtaccctccgcccccgtggtcccccagctccccgcctcactccacgggctcggtgaggccggtcagggcacagggcgagggcctcttgccctgagcaccctggatggtgactgcggataggggcagccagaccagctcccacaggagttcaactgggtctgagacttcaaggggtggtggtgggagccccccttgggagaggacccctgggaagggtgtttttcctttgagggggattctgtgccacagcagggctcagcttcctgccttccatagctgtcatggcctcacctggagcggaggggacctggggacctgaaggtggatggggacacagctcctggcttctcctggtgctgccctcactgtccccccgcctaaagggggtactgagcctcctgtggcccgcagcagtgagggcacagctgtgggttgcaggggagacagccagcacggcgtggccattctatgaccccccagcctggcagactggggagctgggggcagagggcggtgccaagtgccacatcttgccatagtggatgctcttccagtttcttttttctattaaacaccccacttcctttg

SEQ ID NO: 38320 - DNA, 802 bp, Homo sapiens
  misc_feature (776)..(776): n is a, c, g, or t
  misc_feature (795)..(795): n is a, c, g, or t
caaagcatcccaactccgcccgggacgcggttccagtccgcaccaacttggcgtaattgacatgggtaggtggggccgggacgcgtcccctgcccctctgcggcaacgacatggagcgctggggcggcctccgcgcccgcggcgtgcggaccgcggttcctgaaaaattacccgcgctgtgcggtacggtaagacccggcgtccgcgtctggatctcaaggctgagcgagcgctcatcgggctcaagaatctcgctctatggcccaggctggagtacagtgacacgatcacggctcactgcagtctctgcctcccagatggaaatcctgtatgaatgtggaagccattagcagagtaattgctgtctgttaccatgacaaccagccgctgcagtcacctgcccgaagtcctgccagactgcaccagctcagctgcacccgtggtgaagacggtggaggattgtggcagcctagtgaatgggcagccgcagtatgtcatgcaagtttcagccaaggacgggcagctgctgtcaacagtagtgcggactcttgccacccagagccccttcaatgaccggccgatgtgcaggatctgccacgagggcagcagccaagaggacttgctctctccatgtgaatgtacagggaccttggggacaattcatcggagctgcctggagcactggctgtcatcctcaaacaccagctactgtgaactctgccacttcaggtttgcagtcgagcgcaaacccaggccgttagtggagtggcttgaanaaacccttggccccccaancattgaa

SEQ ID NO: 38321 - DNA, 1820 bp, Homo sapiens
ataaggctaggtacgaggctgggtgagcaggtccgtgaattgtcagcgcgctgtgggcgactgtgtggccgcggcggccgccaggcttgccgcactccccctgaggtgcccgccggaaccaatgtgccctggtccactgggccgtgagcagccaccgactgggggcaacttggcacttagaaccgcagcagggacgtcggtttgctatcgggactcggcgaggacgatggaaatcctgtatgaatgtggaagccattagcagagtaattgctgtctgttaccatgacaaccagccgctgcagtcacctgcccgaagtcctgccagactgcaccagctcagctgcacccgtggtgaagacggtggaggattgtggcagcctagtgaatgggcagccgcagtatgtcatgcaagtttcagccaaggacgggcagctgctgtcaacagtagtgcggactcttgccacccagagccccttcaatgaccggccgatgtgcaggatctgccacgagggcagcagccaagaggacttgctctctccatgtgaatgtacagggaccttggggacaattcatcggagctgcctggagcactggctgtcatcctcaaacaccagctactgtgaactctgccacttcaggtttgcagtcgagcgcaaacccaggccgttagtggagtggctgagaaaccctggcccccagcatgagaagcggactctgtttggcgacatggtgtgcttcttgtttataactcccctggccaccatctcgggctggctgtgcctgcggggcgccgtggaccacctgcactttagtagtcggctggaagccgtcggactgattgcactcactgtcgcactcttcactatttacctcttttggacactagtgtcatttaggtaccactgtcgattgtacaacgagtggcgtcggaccaatcagagggtgattctcctcattccaaagtctgtcaatgtaccttctaaccagccgtccttgctgggcctccattcggtcaagaggaactcaaaggagacagttgtttgatgtttgtatggttggttggttgtttgattcattgtttggggtttggaagtgtctgcactggggtcatgcactgagcgacccccaagcccttccttaagcctgtgggtctaagaacatccagagcatattagcacatcactccaagcaacaacctccgccagaagaaagcaaatgctgttttacttcaaatgatggatgctgcaatcatatgatatttgctaagctgccaaacatgtttatttagcagatactgtatggaattttctgaacacctctttaacgtatgaggaaggttgtcctgctacggatgcaattcaattcttccttttttattactatttcaaacacacacacatatatatatatattaaacttagatgataatcaaaatcaaaaagtcaacgtaaaaactggtttcttggtttggttgggtcttatttgagttagtttgtttctcagtttctcgtatggattctttggggtactttggtagcctgagtggtctttttcatctctttcgcgtccattactcaaggagacagcataacagatgcagaacaagtcatatttgaagaatgttttgtactaaacttcatttaattattcagtttttaaagggaaaaagggcgtgagctcacacagtgagctgtttatttaaatatcattaaggagaaaaaaaaatatggtgagaagctcgctcctttcaacttgtttggtactgacagctgatagaagctattttctaataataaacatccagtgtgtgaaagacaaaa

SEQ ID NO: 38322 - DNA, 3070 bp, Homo sapiens
tattccaggctgttcggctgcgagtgacccctgagaggtcgggatctccgagctcgtccgatgtctccatcccagccaggagcttgcgaaggggaaggagggcggaagcagagtgggacagatgtggttcgttctggggcttcctgtccacgaagatggataattctagcgacccgcctgggattttggaatcctggcggacccaaaagacagcagaagtcaccgcagaggatgccaccccgcacggcagcccgcccagagcgacggtctcacaggttccggcgccgtcgagcgcccaagcctcctgttggccgccagctgtgtccgcgacgcgctgggtcgggaggaggagacccgaggcgccggtaagtcccccgctgcaggtggcccggagggcaggggtgaggacggggacgtgtactgaactttgggaggtttgcggggctggagttttgtttcagagatagccagatcgagatcagaacgttttccagagagcccaggtttccacttgtggctgggcgacccggtccggaattcatcctttctcggccctcagcttcctccgggcggggttccgatggggcagctaagttccgcgcctcctgccggtgccagatactggcgtgtcgacccgcgctgcggttggcttcttgctccacagcgctatgcgcgcggcggctccgagggctcctggtctctctcagccaacggccttctggggccgccgcctccctctagagctgctcgggtcccattgcagagagtcccgcagcgcccgccggcagccacggcacttcgcaataaccaacttccccgccgccggcgcgtcccgccagcctgccctcggccgcaggcgactggacggcggttacggggcggtcccagcgccaccacgactggctgtcggctccgccagtcatgggctgatgacgccccggggctggctccgcccctagcggcagccccgcctcccctccagagcctggtcggcttagccctgctttccgcctcactcgttgagcaggtccgtgaattgtcagcgcgctgtgggcgactgtgtggccgcggcggccgccaggcttgccgcactccccctgaggtgcccgccggaaccaatgtgccctggtccactgggccgtgagcagccaccgactgggggcaacttggcacttagaaccgcagcagggacgtcggtttgctatcgggactcggcgaggacgatggaaatcctgtatgaatgtggaagccattagcagagtaattgctgtctgttaccatgacaaccagccgctgcagtcacctgcccgaagtcctgccagactgcaccagctcagctgcacccgtggtgaagacggtggaggattgtggcagcctagtgaatgggcagccgcagtatgtcatgcaagtttcagccaaggacgggcagctgctgtcaacagtagtgcggactcttgccacccagagccccttcaatgaccggccgatgtgcaggatctgccacgagggcagcagccaagaggacttgctctctccatgtgaatgtacagggaccttggggacaattcatcggagctgcctggagcactggctgtcatcctcaaacaccagctactgtgaactctgccacttcaggtttgcagtcgagcgcaaacccaggccgttagtggagtggctgagaaaccctggcccccagcatgagaagcggactctgtttggcgacatggtgtgcttcttgtttataactcccctggccaccatctcgggctggctgtgcctgcggggcgccgtggaccacctgcactttagtagtcggctggaagccgtcggactgattgcactcactgtcgcactcttcactatttacctcttttggacactagtgtcatttaggtaccactgtcgattgtacaacgagtggcgtcggaccaatcagagggtgattctcctcattccaaagtctgtcaatgtaccttctaaccagccgtccttgctgggcctccattcggtcaagaggaactcaaaggagacagttgtttgatgtttgtatggttggttggttgtttgattcattgtttggggtttggaagtgtctgcactggggtcatgcactgagcgacccccaagcccttccttaagcctgtgggtctaagaacatccagagcatattagcacatcactccaagcaacaacctccgccagaagaaagcaaatgctgttttacttcaaatgatggatgctgcaatcatatgatatttgctaagctgccaaacatgtttatttagcagatactgtatggaattttctgaacacctctttaacgtatgaggaaggttgtcctgctacggatgcaattcaattcttccttttttattactatttcaaacacacacacatatatatatatattaaacttagatgataatcaaaatcaaaaagtcaacgtaaaaactggtttcttggtttggttgggtcttatttgagttagtttgtttctcagtttctcgtatggattctttggggtactttggtagcctgagtggtctttttcatctctttcgcgtccattactcaaggagacagcataacagatgcagaacaagtcatatttgaagaatgttttgtactaaacttcatttaattattcagtttttaaagggaaaaagggcgtgagctcacacagtgagctgtttatttaaatatcattaaggagaaaaaaaaatatggtgagaagctcgctcctttcaacttgtttggtactgacagctgatagaagctattttctaataataaacatccagtgtgtgaaagacaaaacccactgattgcaatactctttttttaatgataaaacctgtgaagtttcccaaagcaggttttaaaaggaaaaaaaggaaaagcaaaaaggttgctgttctcactcccatctcatttagtgcatgtcttaattcgggattcgtaatgaattggaggatcattagacatttctaggaaccctagacctgttttgcatgtcaattagcattcccattgctctattgaatttctagcttgacaggtagatgtggca

SEQ ID NO: 38323 - DNA, 1224 bp, Homo sapiens
tatgtggggaaaagacgggtacaggagagggaaaacagaggttaggctgcagcgactctcttaattatccaccgctcagtggctgagaaaccctggcccccagcatgagaagcggactctgtttggcgacatggtgtgcttcttgtttataactcccctggccaccatctcgggctggctgtgcctgcggggcgccgtggaccacctgcactttagtagtcggctggaagccgtcggactgattgcactcactgtcgcactcttcactatttacctcttttggacactagtgtcatttaggtaccactgtcgattgtacaacgagtggcgtcggaccaatcagagggtgattctcctcattccaaagtctgtcaatgtaccttctaaccagccgtccttgctgggcctccattcggtcaagaggaactcaaaggagacagttgtttgatgtttgtatggttggttggttgtttgattcattgtttggggtttggaagtgtctgcactggggtcatgcactgagcgacccccaagcccttccttaagcctgtgggtctaagaacatccagagcatattagcacatcactccaagcaacaacctccgccagaagaaagcaaatgctgttttacttcaaatgatggatgctgcaatcatatgatatttgctaagctgccaaacatgtttatttagcagatactgtatggaattttctgaacacctctttaacgtatgaggaaggttgtcctgctacggatgcaattcaattcttccttttttattactatttcaaacacacacacatatatatatatattaaacttagatgataatcaaaatcaaaaagtcaacgtaaaaactggtttcttggtttggttgggtcttatttgagttagtttgtttctcagtttctcgtatggattctttggggtactttggtagcctgagtggtctttttcatctctttcgcgtccattactcaaggagacagcataacagatgcagaacaagtcatatttgaagaatgttttgtactaaacttcatttaattattcagtttttaaagggaaaaagggcgtgagctcacacagtgagctgtttatttaaatatcattaaggagaaaaaaaaatatggtgagaagctcgctcctttcaacttgtttggtactgacagctgatagaagctattttctaataataaacatccagtgtgtgaaagacaaaa

SEQ ID NO: 38324 - DNA, 1224 bp, Homo sapiens
cggaaaggtgagcaaaattaagagaaaagaaaagaaagagatttatctgcaacgactctcttaatttccaccgctacactggctgagaaaccctggcccccagcatgagaagcggactctgtttggcgacatggtgtgcttcttgtttataactcccctggccaccatctcgggctggctgtgcctgcggggcgccgtggaccacctgcactttagtagtcggctggaagccgtcggactgattgcactcactgtcgcactcttcactatttacctcttttggacactagtgtcatttaggtaccactgtcgattgtacaacgagtggcgtcggaccaatcagagggtgattctcctcattccaaagtctgtcaatgtaccttctaaccagccgtccttgctgggcctccattcggtcaagaggaactcaaaggagacagttgtttgatgtttgtatggttggttggttgtttgattcattgtttggggtttggaagtgtctgcactggggtcatgcactgagcgacccccaagcccttccttaagcctgtgggtctaagaacatccagagcatattagcacatcactccaagcaacaacctccgccagaagaaagcaaatgctgttttacttcaaatgatggatgctgcaatcatatgatatttgctaagctgccaaacatgtttatttagcagatactgtatggaattttctgaacacctctttaacgtatgaggaaggttgtcctgctacggatgcaattcaattcttccttttttattactatttcaaacacacacacatatatatatatattaaacttagatgataatcaaaatcaaaaagtcaacgtaaaaactggtttcttggtttggttgggtcttatttgagttagtttgtttctcagtttctcgtatggattctttggggtactttggtagcctgagtggtctttttcatctctttcgcgtccattactcaaggagacagcataacagatgcagaacaagtcatatttgaagaatgttttgtactaaacttcatttaattattcagtttttaaagggaaaaagggcgtgagctcacacagtgagctgtttatttaaatatcattaaggagaaaaaaaaatatggtgagaagctcgctcctttcaacttgtttggtactgacagctgatagaagctattttctaataataaacatccagtgtgtgaaagacaaaa

SEQ ID NO: 38325 - DNA, 2817 bp, Homo sapiens
tattccaggctgttcggctgcgagtgacccctgagaggtcgggatctccgagctcgtccgatgtctccatcccagccaggagcttgcgaaggggaaggagggcggaagcagagtgggacagatgtggttcgttctggggcttcctgtccacgaagatggataattctagcgacccgcctgggattttggaatcctggcggacccaaaagacagcagaagtcaccgcagaggatgccaccccgcacggcagcccgcccagagcgacggtctcacaggttccggcgccgtcgagcgcccaagcctcctgttggccgccagctgtgtccgcgacgcgctgggtcgggaggaggagacccgaggcgccggtaagtcccccgctgcaggtggcccggagggcaggggtgaggacggggacgtgtactgaactttgggaggtttgcggggctggagttttgtttcagagatagccagatcgagatcagaacgttttccagagagcccaggtttccacttgtggctgggcgacccggtccggaattcatcctttctcggccctcagcttcctccgggcggggttccgatggggcagctaagttccgcgcctcctgccggtgccagatactggcgtgtcgacccgcgctgcggttggcttcttgctccacagcgctatgcgcgcggcggctccgagggctcctggtctctctcagccaacggccttctggggccgccgcctccctctagagctgctcgggtcccattgcagagagtcccgcagcgcccgccggcagccacggcacttcgcaataaccaacttccccgccgccggcgcgtcccgccagcctgccctcggccgcaggcgactggacggcggttacggggcggtcccagcgccaccacgactggctgtcggctccgccagtcatgggctgatgacgccccggggctggctccgcccctagcggcagccccgcctcccctccagagcctggtcggcttagccctgctttccgcctcactcgttgagcaggtccgtgaattgtcagcgcgctgtgggcgactgtgtggccgcggcggccgccaggcttgccgcactccccctgaggtgcccgccggaaccaatgtgccctggtccactgggccgtgagcagccaccgactgggggcaacttggcacttagaaccgcagcagggacgtcggtttgctatcgggactcggcgaggacgatggaaatcctgtatgaatgtggaagccattagcagagtaattgctgtctgttaccatgacaaccagccgctgcagtcacctgcccgaagtcctgccagactgcaccagctcagctgcacccgtggtgaagacggtggaggattgtggcagcctagtgaatgggcagccgcagtatgtcatgcaagtttcagccaaggacgggcagctgctgtcaacagtagtgcggactcttgccacccagagccccttcaatgaccggccgatgtgcaggatctgccacgagggcagcagccaagaggacttgctctctccatgtgaatgtacagggaccttggggacaattcatcggagctgcctggagcactggctgtcatcctcaaacaccagctactgtgaactctgccacttcaggtttgcagtcgagcgcaaacccaggccgttagtggagtggctgagaaaccctggcccccagcatgagaagcggactctgtttggcgacatggtgtgcttcttgtttataactcccctggccaccatctcgggctggctgtgcctgcggggcgccgtggaccacctgcactttagtagtcggctggaagccgtcggactgattgcactcactgtcgcactcttcactatttacctcttttggacactagtgtcatttaggtaccactgtcgattgtacaacgagtggcgtcggaccaatcagagggtgattctcctcattccaaagtctgtcaatgtaccttctaaccagccgtccttgctgggcctccattcggtcaagaggaactcaaaggagacagttgtttgatgtttgtatggttggttggttgtttgattcattgtttggggtttggaagtgtctgcactggggtcatgcactgagcgacccccaagcccttccttaagcctgtgggtctaagaacatccagagcatattagcacatcactccaagcaacaacctccgccagaagaaagcaaatgctgttttacttcaaatgatggatgctgcaatcatatgatatttgctaagctgccaaacatgtttatttagcagatactgtatggaattttctgaacacctctttaacgtatgaggaaggttgtcctgctacggatgcaattcaattcttccttttttattactatttcaaacacacacacatatatatatatattaaacttagatgataatcaaaatcaaaaagtcaacgtaaaaactggtttcttggtttggttgggtcttatttgagttagtttgtttctcagtttctcgtatggattctttggggtactttggtagcctgagtggtctttttcatctctttcgcgtccattactcaaggagacagcataacagatgcagaacaagtcatatttgaagaatgttttgtactaaacttcatttaattattcagtttttaaagggaaaaagggcgtgagctcacacagtgagctgtttatttaaatatcattaaggagaaaaaaaaatatggtgagaagctcgctcctttcaacttgtttggtactgacagctgatagaagctattttctaataataaacatccagtgtgtgaaagacaaaa

SEQ ID NO: 38326 - DNA, 3139 bp, Homo sapiens
tattccaggctgttcggctgcgagtgacccctgagaggtcgggatctccgagctcgtccgatgtctccatcccagccaggagcttgcgaaggggaaggagggcggaagcagagtgggacagatgtggttcgttctggggcttcctgtccacgaagatggataattctagcgacccgcctgggattttggaatcctggcggacccaaaagacagcagaagtcaccgcagaggatgccaccccgcacggcagcccgcccagagcgacggtctcacaggttccggcgccgtcgagcgcccaagcctcctgttggccgccagctgtgtccgcgacgcgctgggtcgggaggaggagacccgaggcgccggtaagtcccccgctgcaggtggcccggagggcaggggtgaggacggggacgtgtactgaactttgggaggtttgcggggctggagttttgtttcagagatagccagatcgagatcagaacgttttccagagagcccaggtttccacttgtggctgggcgacccggtccggaattcatcctttctcggccctcagcttcctccgggcggggttccgatggggcagctaagttccgcgcctcctgccggtgccagatactggcgtgtcgacccgcgctgcggttggcttcttgctccacagcgctatgcgcgcggcggctccgagggctcctggtctctctcagccaacggccttctggggccgccgcctccctctagagctgctcgggtcccattgcagagagtcccgcagcgcccgccggcagccacggcacttcgcaataaccaacttccccgccgccggcgcgtcccgccagcctgccctcggccgcaggcgactggacggcggttacggggcggtcccagcgccaccacgactggctgtcggctccgccagtcatgggctgatgacgccccggggctggctccgcccctagcggcagccccgcctcccctccagagcctggtcggcttagccctgctttccgcctcactcgttgagcaggtccgtgaattgtcagcgcgctgtgggcgactgtgtggccgcggcggccgccaggcttgccgcactccccctgaggtgcccgccggaaccaatgtgccctggtccactgggccgtgagcagccaccgactgggggcaacttggcacttagaaccgcagcagggacgtcggtttgctatcgggactcggcgaggacgatggaaatcctgtatgaatgtggaagccattagcagagtaattgctgtctgttaccatgacaaccagccgctgcagtcacctgcccgaagtcctgccagactgcaccagctcagctgcacccgtggtgaagacggtggaggattgtggcagcctagtgaatgggcagccgcagtatgtcatgcaagtttcagccaaggacgggcagctgctgtcaacagtagtgcggactcttgccacccagagccccttcaatgaccggccgatgtgcaggatctgccacgagggcagcagccaagaggacttgctctctccatgtgaatgtacagggaccttggggacaattcatcggagctgcctggagcactggctgtcatcctcaaacaccagctactgtgaactctgccacttcaggtttgcagtcgagcgcaaacccaggccgttagtggagtggctgagaaaccctggcccccagcatgagaagcggactctgtttggcgacatggtgtgcttcttgtttataactcccctggccaccatctcgggctggctgtgcctgcggggcgccgtggaccacctgcactttagtagtcggctggaagccgtcggactgattgcactcactgtcgcactcttcactatttacctcttttggacactagtgtcatttaggtaccactgtcgattgtacaacgagtggcgtcggaccaatcagagggtgattctcctcattccaaagtctgtcaatgtaccttctaaccagccgtccttgctgggcctccattcggtcaagaggaactcaaaggagacagttgtttgatgtttgtatggttggttggttgtttgattcattgtttggggtttggaagtgtctgcactggggtcatgcactgagcgacccccaagcccttccttaagcctgtgggtctaagaacatccagagcatattagcacatcactccaagcaacaacctccgccagaagaaagcaaatgctgttttacttcaaatgatggatgctgcaatcatatgatatttgctaagctgccaaacatgtttatttagcagatactgtatggaattttctgaacacctctttaacgtatgaggaaggttgtcctgctacggatgcaattcaattcttccttttttattactatttcaaacacacacacatatatatatatattaaacttagatgataatcaaaatcaaaaagtcaacgtaaaaactggtttcttggtttggttgggtcttatttgagttagtttgtttctcagtttctcgtatggattctttggggtactttggtagcctgagtggtctttttcatctctttcgcgtccattactcaaggagacagcataacagatgcagaacaagtcatatttgaagaatgttttgtactaaacttcatttaattattcagtttttaaagggaaaaagggcgtgagctcacacagtgagctgtttatttaaatatcattaaggagaaaaaaaaatatggtgagaagctcgctcctttcaacttgtttggtactgacagctgatagaagctattttctaataataaacatccagtgtgtgaaagacaaaaaaaaaaaaaaaaaaaaaaaaaaaactttgggggccgcggggctggaaaaagctttttaaacccatccccggtggggcgcgccgccccaaatagtgatacgcgcgccagtgggccatagcgatggtccccaaggagagccccgcggcggcaaagaccctagcgtgcggggcgttcccccccaaataaaaaaagcgccccgggcgacaacacgggcgtctcccggcaacaactccccgaggtgcgcggcacagcaggcacaacacggggctcaccaacgggcggcccagcggagggcaaaataaaaataccgcgcaggggtgat

SEQ ID NO: 38327 - DNA, 1182 bp, Homo sapiens
  misc_feature (25)..(25): n is a, c, g, or t
acttaagctacgggcctctgtctanaagaccaacaagtggctgagaaaccctggcccccagcatgagaagcggactctgtttggcgacatggtgtgcttcttgtttataactcccctggccaccatctcgggctggctgtgcctgcggggcgccgtggaccacctgcactttagtagtcggctggaagccgtcggactgattgcactcactgtcgcactcttcactatttacctcttttggacactagtgtcatttaggtaccactgtcgattgtacaacgagtggcgtcggaccaatcagagggtgattctcctcattccaaagtctgtcaatgtaccttctaaccagccgtccttgctgggcctccattcggtcaagaggaactcaaaggagacagttgtttgatgtttgtatggttggttggttgtttgattcattgtttggggtttggaagtgtctgcactggggtcatgcactgagcgacccccaagcccttccttaagcctgtgggtctaagaacatccagagcatattagcacatcactccaagcaacaacctccgccagaagaaagcaaatgctgttttacttcaaatgatggatgctgcaatcatatgatatttgctaagctgccaaacatgtttatttagcagatactgtatggaattttctgaacacctctttaacgtatgaggaaggttgtcctgctacggatgcaattcaattcttccttttttattactatttcaaacacacacacatatatatatatattaaacttagatgataatcaaaatcaaaaagtcaacgtaaaaactggtttcttggtttggttgggtcttatttgagttagtttgtttctcagtttctcgtatggattctttggggtactttggtagcctgagtggtctttttcatctctttcgcgtccattactcaaggagacagcataacagatgcagaacaagtcatatttgaagaatgttttgtactaaacttcatttaattattcagtttttaaagggaaaaagggcgtgagctcacacagtgagctgtttatttaaatatcattaaggagaaaaaaaaatatggtgagaagctcgctcctttcaacttgtttggtactgacagctgatagaagctattttctaataataaacatccagtgtgtgaaagacaaaa

SEQ ID NO: 38328 - DNA, 2242 bp, Homo sapiens
tattccaggctgttcggctgcgagtgacccctgagaggtcgggatctccgagctcgtccgatgtctccatcccagccaggagcttgcgaaggggaaggagggcggaagcagagtgggacagatgtggttcgttctggggcttcctgtccacgaagatggataattctagcgacccgcctgggattttggaatcctggcggacccaaaagacagcagaagtcaccgcagaggatgccaccccgcacggcagcccgcccagagcgacggtctcacaggttccggcgccgtcgagcgcccaagcctcctgttggccgccagctgtgtccgcgacgcgctgggtcgggaggaggagacccgaggcgccggtaagtcccccgctgcaggtggcccggagggcaggggtgaggacggggacgtgtactgaactttgggaggtttgcggggctggagttttgtttcagagatagccagatcgagatcagaacgttttccagagagcccaggtttccacttgtggctgggcgacccggtccggaattcatcctttctcggccctcagcttcctccgggcggggttccgatggggcagctaagttccgcgcctcctgccggtgccagatactggcgtgtcgacccgcgctgcggttggcttcttgctccacagcgctatgcgcgcggcggctccgagggctcctggtctctctcagccaacggccttctggggccgccgcctccctctagagctgctcgggtcccattgcagagagtcccgcagcgcccgccggcagccacggcacttcgcaataaccaacttccccgccgccggcgcgtcccgccagcctgccctcggccgcaggcgactggacggcggttacggggcggtcccagcgccaccacgactggctgtcggctccgccagtcatgggctgatgacgccccggggctggctccgcccctagcggcagccccgcctcccctccagagcctggtcggcttagccctgctttccgcctcactcgttgagcaggtccgtgaattgtcagcgcgctgtgggcgactgtgtggccgcggcggccgccaggcttgccgcactccccctgaggtgcccgccggaaccaatgtgccctggtccactgggccgtgagcagccaccgactgggggcaacttggcacttagaaccgcagcagggacgtcggtttgctatcgggactcggcgaggacgatggaaatcctgtatgaatgtggaaccgtcggactgattgcactcactgtcgcactcttcactatttacctcttttggacactagtgtcatttaggtaccactgtcgattgtacaacgagtggcgtcggaccaatcagagggtgattctcctcattccaaagtctgtcaatgtaccttctaaccagccgtccttgctgggcctccattcggtcaagaggaactcaaaggagacagttgtttgatgtttgtatggttggttggttgtttgattcattgtttggggtttggaagtgtctgcactggggtcatgcactgagcgacccccaagcccttccttaagcctgtgggtctaagaacatccagagcatattagcacatcactccaagcaacaacctccgccagaagaaagcaaatgctgttttacttcaaatgatggatgctgcaatcatatgatatttgctaagctgccaaacatgtttatttagcagatactgtatggaattttctgaacacctctttaacgtatgaggaaggttgtcctgctacggatgcaattcaattcttccttttttattactatttcaaacacacacacatatatatatatattaaacttagatgataatcaaaatcaaaaagtcaacgtaaaaactggtttcttggtttggttgggtcttatttgagttagtttgtttctcagtttctcgtatggattctttggggtactttggtagcctgagtggtctttttcatctctttcgcgtccattactcaaggagacagcataacagatgcagaacaagtcatatttgaagaatgttttgtactaaacttcatttaattattcagtttttaaagggaaaaagggcgtgagctcacacagtgagctgtttatttaaatatcattaaggagaaaaaaaaatatggtgagaagctcgctcctttcaacttgtttggtactgacagctgatagaagctattttctaataataaacatccagtgtgtgaaagacaaaa

SEQ ID NO: 38329 - DNA, 490 bp, Homo sapiens
caccagcccagaagcagactcacagctctgacattttcaacaggtagataggagcagcgaacagattcaaactccctctcatcctcatctctcaccagctggacaacactgctgtgcagggacagcgtctcagacacagacggtgcttcttgaatcatttgtctttctggggccttccaagttgggttattttgtcctatcctttctagcgactgcatactgatactttctttcccctttttctcttgcttcctgccaacttaactttatccaggatggtctttgcatttgttgtgcccacaactctccaaccgctattcttttgtagattttatctgacagatttcattttaccttctgcacaggcatctgaccatcccctgacgtctgatgtcttctcccctcccaggcctgagtgcctgatcattccctcaagaatcttgcagaaaggccatcttccctggctactcccaaatggagttcaaagctc

SEQ ID NO: 38330 - DNA, 807 bp, Homo sapiens
actgtcagggaatgcagtccagtaggtttcagcctcattttacccagctcctattcaagatggagttgctctggttcacgtgcctctgacactgctagataaaatataggatgcaaataatacatcctgtaatatcctaaaatattatcctaaaaattaatttttgtgtatctgatattcaaatttaactgaacctcctatattttaatttgataattctagcaatccttcatataacatttctgagaggtaggtatttcttatatacagagttttatagataaggaaactgaggctcagaggcattggataatttttccaaaattggacttcagatgaaatctgctggtctgcagaggcatatgctctctaagcattattcctggcttggtgaatgtgaagtaagatgctgcatactgtgacatggcattctttgggacagcctagattctatctgtttaaaggagtgaattacatggcctctgggtcatcttcagatctgctgctcctaagataaaagtcctatccaatagttggaaaatgcaatactctgaatattatcttaatgtagggatggaactcttttgagcacaaaagcaaaatctgggccaaaagcctagtcactgtaagtactactggaagcagtgaagataaaatacattgtgcacgataaggtaccttttaaataatcttttaacagttttttgttttgcttaatatactcccctgtaaatattggtttcctttattagactattatagtaaaattaaattagcactttgcagaatatttttttcaaaaaaaaa

SEQ ID NO: 38331 - DNA, 261 bp, Homo sapiens
gactcagaagaaatgctctctgactcggttatgtctgggtttggattattcaacagttgcattgttttctgttagtcattttgtcccctcctcattatgtggaacccatagcttcagactggaaatgtagatcagagctctgggacagctgggatctgtttacctatgtacctgtttcccctgccgctcactgccagatatcctagactgagcctaacaacccatctaagagaaaaaggtagactcaagaaaaacgagaaa

SEQ ID NO: 38332 - DNA, 409 bp, Homo sapiens
gatgagttggcagtaagaagtagaaaccaggaaagagggcctgaagagacacagccagaccaatgatgtggaaaaatttaagtgtccacagaaggaagacacttggaaatagaaccttcaaggggcacaggtaagaataacactggagctgtctccaccattctgcccctagtacctactgtagtaggattagtattgacagtcacaactcagacatgttcatatctgaatgtgatggagtaacagcaactaactatatcctcacacctccttaaaaaaggcaaaatttggccaggcagggtgactcatgcctgtaatcccagcactttgggaggctgagggggtgtggatcaggaggtcaggagattgagactatcctggttaacgtggtgaaaccccttctctacta

SEQ ID NO: 38333 - DNA, 420 bp, Homo sapiens
cagaatcgacctgaccttgctgacagatggtacaaaatctggcagggtccttgcagggccagccacagattttctggggctgggtgcaagctgaaacttcaggctcttctgagcctggaaccctctgggacagcccagttcgcgcacctgccaaaccggccctgggtccgggatactgatgctggagtcttcaagagcctgggactagaggttcaaagacaccagctcagccccccgctaagctctgacatcccaaggctgcccttccccctctctgtgtctcaattttctcatctgtaaaatgggtatgatccaccaggtgggaggtgggggctggaggcttgcccagcatctcgtctggctcctgggggcaccagcatgggccccaaccagcgatgggagaggggatgggactgcttc

SEQ ID NO: 38334 - DNA, 398 bp, Homo sapiens
ttgggctcagaacctgcgaggatggcagcggtgtccagcagtgaagactgaaggtgtccacagctgtgataggggcttctgggtcctcttgcttgcttttcttcacaggaagaagtccctcctagctcctagggggtttgattgtgagcggcaagggtgtggcagagattatgctccaagacactgaatctgaaaggatgcatccagtcttgccaagtggtttcactaccaaggccagtctccatctatgatagacccaaggaagatcatttacaactagaatctagtcatttaggagattgtgtgctccctggaatgggccatctgcactgggtgtgaggtttatctcatttgaagggaaaaccaaaggaatcttctttgaatatcagcaccaggaa

SEQ ID NO: 38335 - DNA, 369 bp, Homo sapiens
cacagggctgtgagagacatgagggcagagtttgtggcttctaggtccattatgttcactgctccatggtcagaacttggtgcagagcccgacatatggtaggcatgaaatatacaaatttagaatacataatggagattagttgtatcacacattgctgttattacctctctgtctccttcatacccttttatccccagttgaagtgcttgtataccccagtgccctagcctctctcaaagtctcttctgacacaacactctctctctggtaatatatttccagaatttcaaatgtcttccatagctgtgtttacagcccagatgggccctcaagatttaggccaagaataacccaccacctacctgt

SEQ ID NO: 38336 - DNA, 854 bp, Homo sapiens
agcggaaatgcttgaggagagagagagagtaaggagccagccatgaatcctttccagaaaaatgagtccaaggaaactcttttttcacctgtctccattgaagaggtaccacctcgaccacctagccctccaaagaagccatctccgacaatctgtggctccaactatccactgagcattgccttcattgtggtgaatgaattctgcgagcgcttttcctattatggaatgaaagctgtgctgatcctgtatttcctgtatttcctgcactggaatgaagatacctccacatctatataccatgccttcagcagcctctgttattttactcccatcctgggagcagccattgctgactcgtggttgggaaaattcaaagtcctatcattgatcggcctgagtctaatagctttggggacaggaggcatcaaaccctgtgtggcagcttttggtggagaccagtttgaagaaaaacatgcagaggaacggactagatacttctcagtcttctacctgtccatcaatgcagggagcttgatttctacatttatcacacccatgctgagaggagatgtgcaatgttttggagaagactgctatgcattggcttttggagttccaggactgctcatggtaattgcacttgtacgtgtagccaatgggaacgcaagaatatacaataaaacaccccctgaaggacaccatagttggctcaagttttcaaattgtctctggtcgctaattacccaatcgctctcaaggaaccggtcggagacttccaaagcgacacgcatggctaacacgggcggtgccaaattccaaagcagccatcaggctgtcacgcctgacaagta

SEQ ID NO: 38337 - DNA, 3751 bp, Homo sapiens
agcggaaatgcttgaggagagagagagagtaaggagccagccatgaatcctttccagaaaaatgagtccaaggaaactcttttttcacctgtctccattgaagaggtaccacctcgaccacctagccctccaaagaagccatctccgacaatctgtggctccaactatccactgagcattgccttcattgtggtgaatgaattctgcgagcgcttttcctattatggaatgaaagctgtgctgatcctgtatttcctgtatttcctgcactggaatgaagatacctccacatctatataccatgccttcagcagcctctgttattttactcccatcctgggagcagccattgctgactcgtggttgggaaaattcaagacaatcatctatctctccttggtgtatgtgcttggccatgtgatcaagtccttgggtgccttaccaatactgggaggacaagtggtacacacagtcctatcattgatcggcctgagtctaatagctttggggacaggaggcatcaaaccctgtgtggcagcttttggtggagaccagtttgaagaaaaacatgcagaggaacggactagatacttctcagtcttctacctgtccatcaatgcagggagcttgatttctacatttatcacacccatgctgagaggagatgtgcaatgttttggagaagactgctatgcattggcttttggagttccaggactgctcatggtaattgcacttgttgtgtttgcaatgggaagcaaaatatacaataaaccaccccctgaaggaaacatagtggctcaagttttcaaatgtatctggtttgctatttccaatcgtttcaagaaccgttctggagacattccaaagcgacagcactggctagactgggcagctgagaaatatccaaagcagctcattatggatgtaaaggcactgaccagggtactattcctttatatcccattgcccatgttctgggctcttttggatcagcagggttcacgatggactttgcaagccatcaggatgaataggaatttggggttttttgtgcttcagccggaccagatgcaggttctaaatccccttctggttcttatcttcatcccgttgtttgactttgtcatttatcgtctggtctccaagtgtggaattaacttctcatcacttaggaaaatggctgttggtatgatcctagcgtgcctggcatttgcagttgcggcagctgtagagataaaaataaatgaaatggccccagcccagccaggtccccaggaggttttcctacaagtcttgaatctggcagatgatgaggtgaaggtgacagtggtgggaaatgaaaacaattctctgttgatagagtccatcaaatcctttcagaaaacaccacactattccaaactgcacctgaaaacaaaaagccaggattttcacttccacctgaaatatcacaatttgtctctctacactgagcattctgtgcaggagaagaactggtacagtcttgtcattcgtgaagatgggaacagtatctccagcatgatggtaaaggatacagaaagcagaacaaccaatgggatgacaaccgtgaggtttgttaacactttgcataaagatgtcaacatctccctgagtacagatacctctctcaatgttggtgaagactatggtgtgtctgcttatagaactgtgcaaagaggagaataccctgcagtgcactgtagaacagaagataagaacttttctctgaatttgggtcttctagactttggtgcagcatatctgtttgttattactaataacaccaatcagggtcttcaggcctggaagattgaagacattccagccaacaaaatgtccattgcgtggcagctaccacaatatgccctggttacagctggggaggtcatgttctctgtcacaggtcttgagttttcttattctcaggctccctctagcatgaaatctgtgctccaggcagcttggctattgacaattgcagttgggaatatcatcgtgcttgttgtggcacagttcagtggcctggtacagtgggccgaattcattttgttttcctgcctcctgctggtgatctgcctgatcttctccatcatgggctactactatgttcctgtaaagacagaggatatgcggggtccagcagataagcacattcctcacatccaggggaacatgatcaaactagagaccaagaagacaaaactctgatgactccctagattctgtcctgaccccaattcctggccctgtcttgaagcattttttttcttctactggattagacaagagagatagcagcatatcagagctgatctcctccacctttctccaatgacagaagttccaggactggttttccagtacatctttaaacaaggccccagagactctatgtctgcccgtccatcagtgaactcattaaaacttgtgcagtgttgctggagctggcctggtgtctccaaatgaccatgaaaatacacacgtataatggagatcattctctgtgggtatgcaaagttatgggaattcctttataggtaactgccatttaggactgatggccctaatttttgaggtgctgatttagaggcaaaattgcagaataacaaagaaatggtatttcaagtttttttttttataagcaatgtaattatgctattcacaggggcctcaagaattggtatgtatgatgtgatctggtccagccagggcctggcttgtcagctctctaggtttgatatgactttagtaaatttgtcaatatagatggtaggaagcagaatgccattttattaaaacacaggagaagttatatctctctgattatgatagtattttatttacttatccaaaccctcctttctcagtatggatagatcatggaaaccagattagagatagtaagcattagtaaacattgttctggagaacaggaacaggtgtaagttgtagaaatcctgaagagccagtcattcttttacagagtacattcttcttagcctctatggcgctggtctatgcccttcagtgaacagttgtataaacaataattataatttgcaaccttgtcttgtcaaccttgctgatccagctttttcttattattacaccttgtcttgcttattgcagcaaatattcaataacaacaatgtttctataagtccaacttcctttattaatgtttccatttagcctcaaaaatatcaaagtagttcctttttgatgttgttttcctgatttacttttcccataagttttaaataccatttctgccttgaagcctagaaattttctttttattcaaaaaaagttacattaatgctctaggtttgaggttctaaaatggaaatgtcaatagaggagcatggtcctatgtgaggttcctatcaaaatttgtgggagtagggatggtagagcatgagggttttgtttgtgtatgtgtatggtcatgaaaaaaaattgagaaacattactcatacacaatgaatgaatcagaggacagacacgggaatggcacgactgtctagtgtgttactaggaaaaaagttcagaatcactgttctagagagcttcatttccattggttttaaaacattattctcatgtagaacagtgttgggtctcatactgttaatgttaatacgtaacaatgttcatgttaacaggcacctgttaatattaacagataatgttactgttaacaggtaagagaaattgctctaagtgc

SEQ ID NO: 38338 - DNA, 2467 bp, Homo sapiens
agcggaaatgcttgaggagagagagagagtaaggagccagccatgaatcctttccagaaaaatgagtccaaggaaactcttttttcacctgtctccattgaagaggtaccacctcgaccacctagccctccaaagaagccatctccgacaatctgtggctccaactatccactgagcattgccttcattgtggtgaatgaattctgcgagcgcttttcctattatggaatgaaagctgtgctgatcctgtatttcctgtatttcctgcactggaatgaagatacctccacatctatataccatgccttcagcagcctctgttattttactcccatcctgggagcagccattgctgactcgtggttgggaaaattcaagacaatcatctatctctccttggtgtatgtgcttggccatgtgatcaagtccttgggtgccttaccaatactgggaggacaagtggtacacacagtcctatcattgatcggcctgagtctaatagctttggggacaggaggcatcaaaccctgtgtggcagcttttggtggagaccagtttgaagaaaaacatgcagaggaacggactagatacttctcagtcttctacctgtccatcaatgcagggagcttgatttctacatttatcacacccatgctgagaggagatgtgcaatgttttggagaagactgctatgcattggcttttggagttccaggactgctcatggtaattgcacttgttgtgtttgcaatgggaagcaaaatatacaataaaccaccccctgaaggaaacatagtggctcaagttttcaaatgtatctggtttgctatttccaatcgtttcaagaaccgttctggagacattccaaagcgacagcactggctagactgggcagctgagaaatatccaaagcagctcattatggatgtaaaggcactgaccagggtactattcctttatatcccattgcccatgttctgggctcttttggatcagcagggttcacgatggactttgcaagccatcaggatgaataggaatttggggttttttgtgcttcagccggaccagatgcaggttctaaatccccttctggttcttatcttcatcccgttgtttgactttgtcatttatcgtctggtctccaagtgtggaattaacttctcatcacttaggaaaatggctgttggtatgatcctagcgtgcctggcatttgcagttgcggcagctgtagagataaaaataaatgaaatggccccagcccagccaggtccccaggaggttttcctacaagtcttgaatctggcagatgatgaggtgaaggtgacagtggtgggaaatgaaaacaattctctgttgatagagtccatcaaatcctttcagaaaacaccacactattccaaactgcacctgaaaacaaaaagccaggattttcacttccacctgaaatatcacaatttgtctctctacactgagcattctgtgcaggagaagaactggtacagtcttgtcattcgtgaagatgggaacagtatctccagcatgatggtaaaggatacagaaagcagaacaaccaatgggatgacaaccgtgaggtttgttaacactttgcataaagatgtcaacatctccctgagtacagatacctctctcaatgttggtgaagactatggtgtgtctgcttatagaactgtgcaaagaggagaataccctgcagtgcactgtagaacagaagataagaacttttctctgaatttgggtcttctagactttggtgcagcatatctgtttgttattactaataacaccaatcagggtcttcaggcctggaagattgaagacattccagccaacaaaatgtccattgcgtggcagctaccacaatatgccctggttacagctggggaggtcatgttctctgtcacaggtcttgagttttcttattctcaggctccctctagcatgaaatctgtgctccaggcagcttggctattgacaattgcagttgggaatatcatcgtgcttgttgtggcacagttcagtggcctggtacagtgggccgaattcattttgttttcctgcctcctgctggtgatctgcctgatcttctccatcatgggctactactatgttcctgtaaagacagaggatatgcggggtccagcagataagcacattcctcacatccaggggaacatgatcaaactagagaccaagaagacaaaactctgatgactccctagattctgtcctgaccccaattcctggccctgtcttgaagcattttttttcttctactggattagacaagagagatagcagcatatcagagctgatctcctccacctttctccaatgacagaagttccaggactggttttccagtacatctttaaacaaggccccagagactctatgtctgcccgtccatcagtgaactcattaaaacttgtgcagtgttgctgga

SEQ ID NO: 38339 - DNA, 2819 bp, Homo sapiens
agcggaaatgcttgaggagagagagagagtaaggagccagccatgaatcctttccagaaaaatgagtccaaggaaactcttttttcacctgtctccattgaagaggtaccacctcgaccacctagccctccaaagaagccatctccgacaatctgtggctccaactatccactgagcattgccttcattgtggtgaatgaattctgcgagcgcttttcctattatggaatgaaagctgtgctgatcctgtatttcctgtatttcctgcactggaatgaagatacctccacatctatataccatgccttcagcagcctctgttattttactcccatcctgggagcagccattgctgactcgtggttgggaaaattcaagacaatcatctatctctccttggtgtatgtgcttggccatgtgatcaagtccttgggtgccttaccaatactgggaggacaagtggtacacacagtcctatcattgatcggcctgagtctaatagctttggggacaggaggcatcaaaccctgtgtggcagcttttggtggagaccagtttgaagaaaaacatgcagaggaacggactagatacttctcagtcttctacctgtccatcaatgcagggagcttgatttctacatttatcacacccatgctgagaggagatgtgcaatgttttggagaagactgctatgcattggcttttggagttccaggactgctcatggtaattgcacttgttgtgtttgcaatgggaagcaaaatatacaataaaccaccccctgaaggaaacatagtggctcaagttttcaaatgtatctggtttgctatttccaatcgtttcaagaaccgttctggagacattccaaagcgacagcactggctagactgggcagctgagaaatatccaaagcagctcattatggatgtaaaggcactgaccagggtactattcctttatatcccattgcccatgttctgggctcttttggatcagcagggttcacgatggactttgcaagccatcaggatgaataggaatttggggttttttgtgcttcagccggaccagatgcaggttctaaatccccttctggttcttatcttcatcccgttgtttgactttgtcatttatcgtctggtctccaagtgtggaattaacttctcatcacttaggaaaatggctgttggtatgatcctagcgtgcctggcatttgcagttgcggcagctgtagagataaaaataaatgaaatggccccagcccagccaggtccccaggaggttttcctacaagtcttgaatctggcagatgatgaggtgaaggtgacagtggtgggaaatgaaaacaattctctgttgatagagtccatcaaatcctttcagaaaacaccacactattccaaactgcacctgaaaacaaaaagccaggattttcacttccacctgaaatatcacaatttgtctctctacactgagcattctgtgcaggagaagaactggtacagtcttgtcattcgtgaagatgggaacagtatctccagcatgatggtaaaggatacagaaagcagaacaaccaatgggatgacaaccgtgaggtttgttaacactttgcataaagatgtcaacatctccctgagtacagatacctctctcaatgttggtgaagactatggtgtgtctgcttatagaactgtgcaaagaggagaataccctgcagtgcactgtagaacagaagataagaacttttctctgaatttgggtcttctagactttggtgcagcatatctgtttgttattactaataacaccaatcagggtcttcaggcctggaagattgaagacattccagccaacaaaatgtccattgcgtggcagctaccacaatatgccctggttacagctggggaggtcatgttctctgtcacaggtcttgagttttcttattctcaggctccctctagcatgaaatctgtgctccaggcagcttggctattgacaattgcagttgggaatatcatcgtgcttgttgtggcacagttcagtggcctggtacagtgggccgaattcattttgttttcctgcctcctgctggtgatctgcctgatcttctccatcatgggctactactatgttcctgtaaagacagaggatatgcggggtccagcagataagcacattcctcacatccaggggaacatgatcaaactagagaccaagaagacaaaactctgatgactccctagattctgtcctgaccccaattcctggccctgtcttgaagcattttttttcttctactggattagacaagagagatagcagcatatcagagctgatctcctccacctttctccaatgacagaagttccaggactggttttccagtacatctttaaacaaggccccagagactctatgtctgcccgtccatcagtgaactcattaaaacttgtgcagtgttgctggagctggcctggtgtctccaaatgaccatgaaaatacacacgtataatggagatcattctctgtgggtatgcaaagttatgggaattcctttataggtaactgccatttaggactgatggccctaatttttgaggtgctggtgctggcagggaacgctgttgtgtgtgttgactctgcttggctatacaagctggtgggttctccactgatgctggagcttctcatgctggcaggtgagagtgtttggtctggtgatctggagctactgtaaagaatgcccccttttgcacttaggcctggtgttgtggtagaaatggctaatgttgtttccattgagcctgcaaggtaggctt

SEQ ID NO: 38340 - DNA, 1812 bp, Homo sapiens
agcggaaatgcttgaggagagagagagagtaaggagccagccatgaatcctttccagaaaaatgagtccaaggaaactcttttttcacctgtctccattgaagaggtaccacctcgaccacctagccctccaaagaagccatctccgacaatctgtggctccaactatccactgagcattgccttcattgtggtgaatgaattctgcgagcgcttttcctattatggaatgaaagctgtgctgatcctgtatttcctgtatttcctgcactggaatgaagatacctccacatctatataccatgccttcagcagcctctgttattttactcccatcctgggagcagccattgctgactcgtggttgggaaaattcaagacaatcatctatctctccttggtgtatgtgcttggccatgtgatcaagtccttgggtgccttaccaatactgggaggacaagtggtacacacagtcctatcattgatcggcctgagtctaatagctttggggacaggaggcatcaaaccctgtgtggcagcttttggtggagaccagtttgaagaaaaacatgcagaggaacggactagatacttctcagtcttctacctgtccatcaatgcagggagcttgatttctacatttatcacacccatgctgagaggagatgtgcaatgttttggagaagactgctatgcattggcttttggagttccaggactgctcatggtaattgcacttgttgtgtttgcaatgggaagcaaaatatacaataaaccaccccctgaaggaaacatagtggctcaagttttcaaatgtatctggtttgctatttccaatcgtttcaagaaccgttctggagacattccaaagcgacagcactggctagactgggcagctgagaaatatccaaagcagctcattatggatgtaaaggcactgaccagggtactattcctttatatcccattgcccatgttctgggctcttttggatcagcagggttcacgatggactttgcaagccatcaggatgaataggaatttggggttttttgtgcttcagccggaccagatgcaggttctaaatccccttctggttcttatcttcatcccgttgtttgactttgtcatttatcgtctggtctccaagtgtggaattaacttctcgtaagtgttcactatgtctgtatggattactctaaattgactcagtctttgcccagtttgaaaaagattcaatgtcagtatttttcttagtgaggattggttttagtttatcatctatctgcttctatttttccatgttagactaactgcctattgaccctgaaaaatgtgaattagatataattaatgagagtcaaagccattactgtggacttaactgtgtaatggtggtggaggggcaggtctaggtttcatgccaaaccaaaaatatgtgaaatttagctcctaaaccaactttcttctttgttcttgaatgttgtctcttcaaagaaactcaaggcctttgatgactactaatccctttaaatctcctgttgtccctacaaaacaaatggggaacctagtaggactggggactgaattattcccaattactgcctgaaattttttctaaatagaaggactagtcttttttagagtttggcaaaagaaagtttcaagccttctttcattcttgatttaatagcaatttcattgtgatgaccactttaccagatgaaaatggccctttgtcatttgttcattgagcaaatgttgggaagtttaggaccaagtgtcatgaaaatataaatcaagcaaaaaaaaa

SEQ ID NO: 38341 - DNA, 2905 bp, Homo sapiens
gccagtggctctagagagggcagttttctaggtcagtgtagaagatctaaagtctagaatcaacattcagactctaaagggaaatgtccttcttattcctggggccagagaccaaatcaaaagctatcaaaacagaaatgtaccaaaacccatcctgagaggacaatctaggtgccaggttcagaaaaatagaaagatggtcttggaagggtccaaagtttctgcagactccaaaacaattataataacctactctgggctgggagtctgagttttgcataggtcacattggacttcatttataagaggataagatatcagttttatgtaaatactatcatatctttatatatgcataattatcttatttttcttagtaaagtctcagttgatagattccaccattataagggaaataaattagatgcacctaagctggattagtgaggaaactcagatttccatgaatgatcatgatagtgtccgtctagctagaggtctggtgaggatgtggcagataaaagttcaagaaaaagaaacttagggacagctaagactatggattactttttacgtgtgggttcattcgtctagttaacaatatacattaggtaccttttatgtgccagccactatcctaggcacctgggcactggggatatagttatacccaaaacataaaaggcccctaacctcttttatcaggtgttcctgtttgtttgatatgtaaataatatctctaccctcaggtttgttaacactttgcataaagatgtcaacatctccctgagtacagatacctctctcaatgttggtgaagactatggtgtgtctgcttatagaactgtgcaaagaggagaataccctgcagtgcactgtagaacagaagataagaacttttctctgaatttgggtcttctagactttggtgcagcatatctgtttgttattactaataacaccaatcagggtcttcaggcctggaagattgaagacattccagccaacaaaatgtccattgcgtggcagctaccacaatatgccctggttacagctggggaggtcatgttctctgtcacaggtcttgagttttcttattctcaggctccctctagcatgaaatctgtgctccaggcagcttggctattgacaattgcagttgggaatatcatcgtgcttgttgtggcacagttcagtggcctggtacagtgggccgaattcattttgttttcctgcctcctgctggtgatctgcctgatcttctccatcatgggctactactatgttcctgtaaagacagaggatatgcggggtccagcagataagcacattcctcacatccaggggaacatgatcaaactagagaccaagaagacaaaactctgatgactccctagattctgtcctgaccccaattcctggccctgtcttgaagcattttttttcttctactggattagacaagagagatagcagcatatcagagctgatctcctccacctttctccaatgacagaagttccaggactggttttccagtacatctttaaacaaggccccagagactctatgtctgcccgtccatcagtgaactcattaaaacttgtgcagtgttgctggagctggcctggtgtctccaaatgaccatgaaaatacacacgtataatggagatcattctctgtgggtatgcaaagttatgggaattcctttataggtaactgccatttaggactgatggccctaatttttgaggtgctgatttagaggcaaaattgcagaataacaaagaaatggtatttcaagtttttttttttataagcaatgtaattatgctattcacaggggcctcaagaattggtatgtatgatgtgatctggtccagccagggcctggcttgtcagctctctaggtttgatatgactttagtaaatttgtcaatatagatggtaggaagcagaatgccattttattaaaacacaggagaagttatatctctctgattatgatagtattttatttacttatccaaaccctcctttctcagtatggatagatcatggaaaccagattagagatagtaagcattagtaaacattgttctggagaacaggaacaggtgtaagttgtagaaatcctgaagagccagtcattcttttacagagtacattcttcttagcctctatggcgctggtctatgcccttcagtgaacagttgtataaacaataattataatttgcaaccttgtcttgtcaaccttgctgatccagctttttcttattattacaccttgtcttgcttattgcagcaaatattcaataacaacaatgtttctataagtccaacttcctttattaatgtttccatttagcctcaaaaatatcaaagtagttcctttttgatgttgttttcctgatttacttttcccataagttttaaataccatttctgccttgaagcctagaaattttctttttattcaaaaaaagttacattaatgctctaggtttgaggttctaaaatggaaatgtcaatagaggagcatggtcctatgtgaggttcctatcaaaatttgtgggagtagggatggtagagcatgagggttttgtttgtgtatgtgtatggtcatgaaaaaaaattgagaaacattactcatacacaatgaatgaatcagaggacagacacgggaatggcacgactgtctagtgtgttactaggaaaaaagttcagaatcactgttctagagagcttcatttccattggttttaaaacattattctcatgtagaacagtgttgggtctcatactgttaatgttaatacgtaacaatgttcatgttaacaggcacctgttaatattaacagataatgttactgttaacaggtaagagaaattgctctaagtgc

SEQ ID NO: 38342 - DNA, 2094 bp, Homo sapiens
cttttccaagccttgatatttattctaacctaaattcatcctgttccagataccctgcagtgcactgtagaacagaagataagaacttttctctgaatttgggtcttctagactttggtgcagcatatctgtttgttattactaataacaccaatcagggtcttcaggcctggaagattgaagacattccagccaacaaaatgtccattgcgtggcagctaccacaatatgccctggttacagctggggaggtcatgttctctgtcacaggtcttgagttttcttattctcaggctccctctagcatgaaatctgtgctccaggcagcttggctattgacaattgcagttgggaatatcatcgtgcttgttgtggcacagttcagtggcctggtacagtgggccgaattcattttgttttcctgcctcctgctggtgatctgcctgatcttctccatcatgggctactactatgttcctgtaaagacagaggatatgcggggtccagcagataagcacattcctcacatccaggggaacatgatcaaactagagaccaagaagacaaaactctgatgactccctagattctgtcctgaccccaattcctggccctgtcttgaagcattttttttcttctactggattagacaagagagatagcagcatatcagagctgatctcctccacctttctccaatgacagaagttccaggactggttttccagtacatctttaaacaaggccccagagactctatgtctgcccgtccatcagtgaactcattaaaacttgtgcagtgttgctggagctggcctggtgtctccaaatgaccatgaaaatacacacgtataatggagatcattctctgtgggtatgcaaagttatgggaattcctttataggtaactgccatttaggactgatggccctaatttttgaggtgctgatttagaggcaaaattgcagaataacaaagaaatggtatttcaagtttttttttttataagcaatgtaattatgctattcacaggggcctcaagaattggtatgtatgatgtgatctggtccagccagggcctggcttgtcagctctctaggtttgatatgactttagtaaatttgtcaatatagatggtaggaagcagaatgccattttattaaaacacaggagaagttatatctctctgattatgatagtattttatttacttatccaaaccctcctttctcagtatggatagatcatggaaaccagattagagatagtaagcattagtaaacattgttctggagaacaggaacaggtgtaagttgtagaaatcctgaagagccagtcattcttttacagagtacattcttcttagcctctatggcgctggtctatgcccttcagtgaacagttgtataaacaataattataatttgcaaccttgtcttgtcaaccttgctgatccagctttttcttattattacaccttgtcttgcttattgcagcaaatattcaataacaacaatgtttctataagtccaacttcctttattaatgtttccatttagcctcaaaaatatcaaagtagttcctttttgatgttgttttcctgatttacttttcccataagttttaaataccatttctgccttgaagcctagaaattttctttttattcaaaaaaagttacattaatgctctaggtttgaggttctaaaatggaaatgtcaatagaggagcatggtcctatgtgaggttcctatcaaaatttgtgggagtagggatggtagagcatgagggttttgtttgtgtatgtgtatggtcatgaaaaaaaattgagaaacattactcatacacaatgaatgaatcagaggacagacacgggaatggcacgactgtctagtgtgttactaggaaaaaagttcagaatcactgttctagagagcttcatttccattggttttaaaacattattctcatgtagaacagtgttgggtctcatactgttaatgttaatacgtaacaatgttcatgttaacaggcacctgttaatattaacagataatgttactgttaacaggtaagagaaattgctctaagtgc

SEQ ID NO: 38343 - DNA, 180 bp, Homo sapiens
ctgactcgtggttgggaaaattcaagtaaggaagatgggaggtcacatccctacaagtttcacaggttgtgcagaaggctatcacttctagcctcttgcttctgagtaagaacatacctatgtcatgcgtgaaaaataagaatctctgtacatctgtgtagtgtgggaaatttaaaaaaa

SEQ ID NO: 38344 - DNA, 445 bp, Homo sapiens
ccatattcttctcatatttatttccccctgcagtgggccgaattcattttgttttcctgcctcctgctggtgatctgcctgatcttctccatcatgggctactactatgttcctgtaaagacagaggatatgcggggtccagcagataagcacattcctcacatccaggggaacatgatcaaactagagaccaagaagacaaaactctgatgactccctagattctgtcctgaccccaattcctggccctgtcttgaagcattttttttcttctactggattagacaagagagatagcagcatatcagagctgatctcctccacctttctccaatgacagaagttccaggactggttttccagtacatctttaaacaaggccccagagactctatgtctgcccgtccatcagtgaactcattaaaacttgtgcagtgttgctgga

SEQ ID NO: 38345 - DNA, 3662 bp, Homo sapiens
  misc_feature (11)..(11): n is a, c, g, or t
  misc_feature (19)..(19): n is a, c, g, or t
aaaaaaagagnaaaagaanaaaaaaggaaaaaaaaaaaaaataaaaaaaatcttctttacaatctgtggctccaactatccactgagcattgccttcattgtggtgaatgaattctgcgagcgcttttcctattatggaatgaaagctgtgctgatcctgtatttcctgtatttcctgcactggaatgaagatacctccacatctatataccatgccttcagcagcctctgttattttactcccatcctgggagcagccattgctgactcgtggttgggaaaattcaagacaatcatctatctctccttggtgtatgtgcttggccatgtgatcaagtccttgggtgccttaccaatactgggaggacaagtggtacacacagtcctatcattgatcggcctgagtctaatagctttggggacaggaggcatcaaaccctgtgtggcagcttttggtggagaccagtttgaagaaaaacatgcagaggaacggactagatacttctcagtcttctacctgtccatcaatgcagggagcttgatttctacatttatcacacccatgctgagaggagatgtgcaatgttttggagaagactgctatgcattggcttttggagttccaggactgctcatggtaattgcacttgttgtgtttgcaatgggaagcaaaatatacaataaaccaccccctgaaggaaacatagtggctcaagttttcaaatgtatctggtttgctatttccaatcgtttcaagaaccgttctggagacattccaaagcgacagcactggctagactgggcagctgagaaatatccaaagcagctcattatggatgtaaaggcactgaccagggtactattcctttatatcccattgcccatgttctgggctcttttggatcagcagggttcacgatggactttgcaagccatcaggatgaataggaatttggggttttttgtgcttcagccggaccagatgcaggttctaaatccccttctggttcttatcttcatcccgttgtttgactttgtcatttatcgtctggtctccaagtgtggaattaacttctcatcacttaggaaaatggctgttggtatgatcctagcgtgcctggcatttgcagttgcggcagctgtagagataaaaataaatgaaatggccccagcccagccaggtccccaggaggttttcctacaagtcttgaatctggcagatgatgaggtgaaggtgacagtggtgggaaatgaaaacaattctctgttgatagagtccatcaaatcctttcagaaaacaccacactattccaaactgcacctgaaaacaaaaagccaggattttcacttccacctgaaatatcacaatttgtctctctacactgagcattctgtgcaggagaagaactggtacagtcttgtcattcgtgaagatgggaacagtatctccagcatgatggtaaaggatacagaaagcagaacaaccaatgggatgacaaccgtgaggtttgttaacactttgcataaagatgtcaacatctccctgagtacagatacctctctcaatgttggtgaagactatggtgtgtctgcttatagaactgtgcaaagaggagaataccctgcagtgcactgtagaacagaagataagaacttttctctgaatttgggtcttctagactttggtgcagcatatctgtttgttattactaataacaccaatcagggtcttcaggcctggaagattgaagacattccagccaacaaaatgtccattgcgtggcagctaccacaatatgccctggttacagctggggaggtcatgttctctgtcacaggtcttgagttttcttattctcaggctccctctagcatgaaatctgtgctccaggcagcttggctattgacaattgcagttgggaatatcatcgtgcttgttgtggcacagttcagtggcctggtacagtgggccgaattcattttgttttcctgcctcctgctggtgatctgcctgatcttctccatcatgggctactactatgttcctgtaaagacagaggatatgcggggtccagcagataagcacattcctcacatccaggggaacatgatcaaactagagaccaagaagacaaaactctgatgactccctagattctgtcctgaccccaattcctggccctgtcttgaagcattttttttcttctactggattagacaagagagatagcagcatatcagagctgatctcctccacctttctccaatgacagaagttccaggactggttttccagtacatctttaaacaaggccccagagactctatgtctgcccgtccatcagtgaactcattaaaacttgtgcagtgttgctggagctggcctggtgtctccaaatgaccatgaaaatacacacgtataatggagatcattctctgtgggtatgcaaagttatgggaattcctttataggtaactgccatttaggactgatggccctaatttttgaggtgctgatttagaggcaaaattgcagaataacaaagaaatggtatttcaagtttttttttttataagcaatgtaattatgctattcacaggggcctcaagaattggtatgtatgatgtgatctggtccagccagggcctggcttgtcagctctctaggtttgatatgactttagtaaatttgtcaatatagatggtaggaagcagaatgccattttattaaaacacaggagaagttatatctctctgattatgatagtattttatttacttatccaaaccctcctttctcagtatggatagatcatggaaaccagattagagatagtaagcattagtaaacattgttctggagaacaggaacaggtgtaagttgtagaaatcctgaagagccagtcattcttttacagagtacattcttcttagcctctatggcgctggtctatgcccttcagtgaacagttgtataaacaataattataatttgcaaccttgtcttgtcaaccttgctgatccagctttttcttattattacaccttgtcttgcttattgcagcaaatattcaataacaacaatgtttctataagtccaacttcctttattaatgtttccatttagcctcaaaaatatcaaagtagttcctttttgatgttgttttcctgatttacttttcccataagttttaaataccatttctgccttgaagcctagaaattttctttttattcaaaaaaagttacattaatgctctaggtttgaggttctaaaatggaaatgtcaatagaggagcatggtcctatgtgaggttcctatcaaaatttgtgggagtagggatggtagagcatgagggttttgtttgtgtatgtgtatggtcatgaaaaaaaattgagaaacattactcatacacaatgaatgaatcagaggacagacacgggaatggcacgactgtctagtgtgttactaggaaaaaagttcagaatcactgttctagagagcttcatttccattggttttaaaacattattctcatgtagaacagtgttgggtctcatactgttaatgttaatacgtaacaatgttcatgttaacaggcacctgttaatattaacagataatgttactgttaacaggtaagagaaattgctctaagtgc

SEQ ID NO: 38346 - DNA, 3235 bp, Homo sapiens
  misc_feature (11)..(11): n is a, c, g, or t
  misc_feature (19)..(19): n is a, c, g, or t
aaaaaaagagnaaaagaanaaaaaaggaaaaaaaaaaaaaataaaaaaaatcttctttacaatctgtggctccaactatccactgagcattgccttcattgtggtgaatgaattctgcgagcgcttttcctattatggaatgaaagctgtgctgatcctgtatttcctgtatttcctgcactggaatgaagatacctccacatctatataccatgccttcagcagcctctgttattttactcccatcctgggagcagccattgctgactcgtggttgggaaaattcaagacaatcatctatctctccttggtgtatgtgcttggccatgtgatcaagtccttgggtgccttaccaatactgggaggacaagtggtacacacagtcctatcattgatcggcctgagtctaatagctttggggacaggaggcatcaaaccctgtgtggcagcttttggtggagaccagtttgaagaaaaacatgcagaggaacggactagatacttctcagtcttctacctgtccatcaatgcagggagcttgatttctacatttatcacacccatgctgagaggagatgtgcaatgttttggagaagactgctatgcattggcttttggagttccaggactgctcatggtaattgcacttgatcacttaggaaaatggctgttggtatgatcctagcgtgcctggcatttgcagttgcggcagctgtagagataaaaataaatgaaatggccccagcccagccaggtccccaggaggttttcctacaagtcttgaatctggcagatgatgaggtgaaggtgacagtggtgggaaatgaaaacaattctctgttgatagagtccatcaaatcctttcagaaaacaccacactattccaaactgcacctgaaaacaaaaagccaggattttcacttccacctgaaatatcacaatttgtctctctacactgagcattctgtgcaggagaagaactggtacagtcttgtcattcgtgaagatgggaacagtatctccagcatgatggtaaaggatacagaaagcagaacaaccaatgggatgacaaccgtgaggtttgttaacactttgcataaagatgtcaacatctccctgagtacagatacctctctcaatgttggtgaagactatggtgtgtctgcttatagaactgtgcaaagaggagaataccctgcagtgcactgtagaacagaagataagaacttttctctgaatttgggtcttctagactttggtgcagcatatctgtttgttattactaataacaccaatcagggtcttcaggcctggaagattgaagacattccagccaacaaaatgtccattgcgtggcagctaccacaatatgccctggttacagctggggaggtcatgttctctgtcacaggtcttgagttttcttattctcaggctccctctagcatgaaatctgtgctccaggcagcttggctattgacaattgcagttgggaatatcatcgtgcttgttgtggcacagttcagtggcctggtacagtgggccgaattcattttgttttcctgcctcctgctggtgatctgcctgatcttctccatcatgggctactactatgttcctgtaaagacagaggatatgcggggtccagcagataagcacattcctcacatccaggggaacatgatcaaactagagaccaagaagacaaaactctgatgactccctagattctgtcctgaccccaattcctggccctgtcttgaagcattttttttcttctactggattagacaagagagatagcagcatatcagagctgatctcctccacctttctccaatgacagaagttccaggactggttttccagtacatctttaaacaaggccccagagactctatgtctgcccgtccatcagtgaactcattaaaacttgtgcagtgttgctggagctggcctggtgtctccaaatgaccatgaaaatacacacgtataatggagatcattctctgtgggtatgcaaagttatgggaattcctttataggtaactgccatttaggactgatggccctaatttttgaggtgctgatttagaggcaaaattgcagaataacaaagaaatggtatttcaagtttttttttttataagcaatgtaattatgctattcacaggggcctcaagaattggtatgtatgatgtgatctggtccagccagggcctggcttgtcagctctctaggtttgatatgactttagtaaatttgtcaatatagatggtaggaagcagaatgccattttattaaaacacaggagaagttatatctctctgattatgatagtattttatttacttatccaaaccctcctttctcagtatggatagatcatggaaaccagattagagatagtaagcattagtaaacattgttctggagaacaggaacaggtgtaagttgtagaaatcctgaagagccagtcattcttttacagagtacattcttcttagcctctatggcgctggtctatgcccttcagtgaacagttgtataaacaataattataatttgcaaccttgtcttgtcaaccttgctgatccagctttttcttattattacaccttgtcttgcttattgcagcaaatattcaataacaacaatgtttctataagtccaacttcctttattaatgtttccatttagcctcaaaaatatcaaagtagttcctttttgatgttgttttcctgatttacttttcccataagttttaaataccatttctgccttgaagcctagaaattttctttttattcaaaaaaagttacattaatgctctaggtttgaggttctaaaatggaaatgtcaatagaggagcatggtcctatgtgaggttcctatcaaaatttgtgggagtagggatggtagagcatgagggttttgtttgtgtatgtgtatggtcatgaaaaaaaattgagaaacattactcatacacaatgaatgaatcagaggacagacacgggaatggcacgactgtctagtgtgttactaggaaaaaagttcagaatcactgttctagagagcttcatttccattggttttaaaacattattctcatgtagaacagtgttgggtctcatactgttaatgttaatacgtaacaatgttcatgttaacaggcacctgttaatattaacagataatgttactgttaacaggtaagagaaattgctctaagtgc

SEQ ID NO: 38347 - DNA, 2684 bp, Homo sapiens
gaacagtctaatgcagtctttaataataggctacagagtttggatttcatcctttagagtctaaagtttagatataattgtttctcctttccaccacagatcacttaggaaaatggctgttggtatgatcctagcgtgcctggcatttgcagttgcggcagctgtagagataaaaataaatgaaatggccccagcccagccaggtccccaggaggttttcctacaagtcttgaatctggcagatgatgaggtgaaggtgacagtggtgggaaatgaaaacaattctctgttgatagagtccatcaaatcctttcagaaaacaccacactattccaaactgcacctgaaaacaaaaagccaggattttcacttccacctgaaatatcacaatttgtctctctacactgagcattctgtgcaggagaagaactggtacagtcttgtcattcgtgaagatgggaacagtatctccagcatgatggtaaaggatacagaaagcagaacaaccaatgggatgacaaccgtgaggtttgttaacactttgcataaagatgtcaacatctccctgagtacagatacctctctcaatgttggtgaagactatggtgtgtctgcttatagaactgtgcaaagaggagaataccctgcagtgcactgtagaacagaagataagaacttttctctgaatttgggtcttctagactttggtgcagcatatctgtttgttattactaataacaccaatcagggtcttcaggcctggaagattgaagacattccagccaacaaaatgtccattgcgtggcagctaccacaatatgccctggttacagctggggaggtcatgttctctgtcacaggtcttgagttttcttattctcaggctccctctagcatgaaatctgtgctccaggcagcttggctattgacaattgcagttgggaatatcatcgtgcttgttgtggcacagttcagtggcctggtacagtgggccgaattcattttgttttcctgcctcctgctggtgatctgcctgatcttctccatcatgggctactactatgttcctgtaaagacagaggatatgcggggtccagcagataagcacattcctcacatccaggggaacatgatcaaactagagaccaagaagacaaaactctgatgactccctagattctgtcctgaccccaattcctggccctgtcttgaagcattttttttcttctactggattagacaagagagatagcagcatatcagagctgatctcctccacctttctccaatgacagaagttccaggactggttttccagtacatctttaaacaaggccccagagactctatgtctgcccgtccatcagtgaactcattaaaacttgtgcagtgttgctggagctggcctggtgtctccaaatgaccatgaaaatacacacgtataatggagatcattctctgtgggtatgcaaagttatgggaattcctttataggtaactgccatttaggactgatggccctaatttttgaggtgctgatttagaggcaaaattgcagaataacaaagaaatggtatttcaagtttttttttttataagcaatgtaattatgctattcacaggggcctcaagaattggtatgtatgatgtgatctggtccagccagggcctggcttgtcagctctctaggtttgatatgactttagtaaatttgtcaatatagatggtaggaagcagaatgccattttattaaaacacaggagaagttatatctctctgattatgatagtattttatttacttatccaaaccctcctttctcagtatggatagatcatggaaaccagattagagatagtaagcattagtaaacattgttctggagaacaggaacaggtgtaagttgtagaaatcctgaagagccagtcattcttttacagagtacattcttcttagcctctatggcgctggtctatgcccttcagtgaacagttgtataaacaataattataatttgcaaccttgtcttgtcaaccttgctgatccagctttttcttattattacaccttgtcttgcttattgcagcaaatattcaataacaacaatgtttctataagtccaacttcctttattaatgtttccatttagcctcaaaaatatcaaagtagttcctttttgatgttgttttcctgatttacttttcccataagttttaaataccatttctgccttgaagcctagaaattttctttttattcaaaaaaagttacattaatgctctaggtttgaggttctaaaatggaaatgtcaatagaggagcatggtcctatgtgaggttcctatcaaaatttgtgggagtagggatggtagagcatgagggttttgtttgtgtatgtgtatggtcatgaaaaaaaattgagaaacattactcatacacaatgaatgaatcagaggacagacacgggaatggcacgactgtctagtgtgttactaggaaaaaagttcagaatcactgttctagagagcttcatttccattggttttaaaacattattctcatgtagaacagtgttgggtctcatactgttaatgttaatacgtaacaatgttcatgttaacaggcacctgttaatattaacagataatgttactgttaacaggtaagagaaattgctctaagtgc

SEQ ID NO: 38348 - DNA, 569 bp, Homo sapiens
  misc_feature (50)..(50): n is a, c, g, or t
aagagtctttatctagacaacataatttttggaaaaataaagcaaattcnactttattggagttattggacagatcagcaaattgttattttaaaaagttttcttgtttaggcaatttggtaagtggtttctagttataaactagccactgttgattaacttgagaaggtgaagcaggggagttctgaagagattacctagagctacttaaccctaagttaagtaaaattttcactttcattcttttcattctctcataaactggttgaaaaaacactgtactaccaacaaaggtgtcagttgcttgtgctgccctgtctatgttatgctctgaataggtctcggtaaagattatatggaaatactataaagaatacataaggtaaaatactagtcagaaagggttcagaagaagttagcatcaactgtatgaaaattctaggtaaagctaagtactattgagttggaaaaaagtaattctatcatgtttgcttgttttcctctactgtttttaatgtgatgttgtaatatattttaaaaataaaacttgaaaacgttgaaaaaaaaaa

SEQ ID NO: 38349 - DNA, 302 bp, Homo sapiens
gtacacagactttcctgagtctgagttaattacctgagccaatccacagaacctgtctgaacagtgcccagcatactgtaagtgctcaatacacatcgacttttgttattgcattcaagcccttcacagcaataaactgcgagagaggcactattctcattttacagattggaaaacagtttcagaaatgttgagtgacatgtaaggtcacatcacatagcatataaaggactcaatctcacgaatctgtgctcataaatatttctggaatggaagagaaatgtgtaaagtataaaaaaagc

SEQ ID NO: 38350 - DNA, 653 bp, Homo sapiens
catggcactccaggcccgggtgacagtgcgagactctgtctttaaaaacaaaaaaaaaaaagaattgctaaatgcagtattctttggtgttcgctgtgggaaatgtgttctgatgagagggaggcaatccataatgtgcccctttgtatgcagggtgggcaaaacactgcttccaactagttacgtctaagatactaggttatcccactggttaccaaacaactcaactatggtttgctgccttccatagctggccctgtccttaaatcccaacatcgtctgaaaataatataggaagcttttgaggactgtcttgtttctacccactcacattccagttatggggaccgaggcgggcgtgggagaagaaacgggatcgtcaaagtgggactgtttccgtgtggcatgatggcaatttcaagcaaggaatgttgctgaatgctcagagcctgccccgggaccaaaagcttttcatgaacttgggtttcatttgtatttgaacatcagtcatctctcttggggtcctctcttgaaagctacttttgcccagtaggctagaaagtggggcaccgtaggtttaatagcagcatgcagggatgacagagtattaaaaacactttttaaaagtcattcttactagtttttgtcatgaa

SEQ ID NO: 38351 - DNA, 758 bp, Homo sapiens
aaactaaggcttggggaagtggaataatttgcctgacatcacacagctgaggagtgccagaaccacaatgtcagcccgatctgactgggctcagctcagtccctacctctgtcctgcttcccacaccaacacctgaaaactcagagaggccctgcagtaaggggcctgttccatactgtgactcagcatgcccaaacctcagaaccctttggtcaccagccacctaccttttcttaggggctctagtgttgatctccctgatctagtctgaccccaccattctaccagtgaagaagctgaaggatattcaaggctttccagggtgtgttcaccatatgggtcagacacccagccaaggccagaccttgaaggctgctgatagctggtggtcggcctccctgggcagttagtgaaaagggcagaaagaagtccatcttggagcaagcattgtcctgagaggacctggcctcccatccagacacttgcttaatgcatagagatggttggtgttgacgtggaaccctatcactcaattcaacaaatatgcctgtatttgtacaagatgtacaagatgtatttgtagaagacgtatatttgtacaagatgtaagattttttctaagaggaagatcagtcattcttcaaaaagcaggaagatacaactctatagtcatctaaaaagttgaggaaacgttcactgtatttattttcctcatttcagaggtttattgataagaataaactatatcaatactatat

SEQ ID NO: 38352 - DNA, 1843 bp, Homo sapiens
  misc_feature (1)..(1): n is a, c, g, or t
nagacggagtctcgctctgtcacccaggctggagtgtaagggcgcgatctcggctcactgcaacctccgcctcccaggttcaagcaattctcctgcctcagccacctgaatagctaggattacaggcgcccgcccccacacccggctaatattttttgtatttttagtagagacagggtttcaccgtgttgatcaggctggtctcgaactcctgacctcacgatccgcccgcctcggcctcccaaagtgctgggattacaggcgtgagtggtggccctatttttaaaccattcgttacgctgtgtagacagagctttattgccctggaaaagattttttttttaactctcatgcagttcagtctttccatcatttcactttgtgagtcactcacataattgtcaatcattcctctgaccttcttaagaatttacaccttaccgtctctgtgattgaagcagacttctcgctttatttcccttaggctcatttttctgtgggctctcccttaaagacacatggccacagacacctccttcgcatatgtaatctgccttcccctgcggccttccgtggtcacagcaacagggactgctcaccccctccagctggggcttttctaacaagcacagtcagaaatgcgcaggcctggggttggggatgaacagaagttgattagtgggcacagaaatacagttagatagaaggaatagttccagcattcgatattacagtagggagactgcatttaacaataattgattgtatatttgaaaacagctagaagaataagaatattcccaacacaaagaaaagataagcgaggtgaaggaaatcccagttaccctcattcagtccattacacattcgatacaggtatcaaaatatcataggcacctcaaagacatgtacaactcttaatttaacatttttgaaagaaaaaaaaaccggccagagcattaaaacaaataaaataagaaacacagaggccagtgttaggtgaagaactccgctgcttcagaaagagaatagcagcgctcgcttaccgtgggaacacggccagttaacaaaatgggttttggttttttgttttgttttgttttaccattggtaataagatagttaacataagtggtcagaacttcgctgaatttgtaataaagcatttgttaagcgtgtaaaagtccaaattaaaagtcttgaagaaaaacagctatggcaatgagcctagacatttttcaaaaaaaaaagctaagccgtcctaccagcaatctctctttctcctaagaatgtcatgccttctcaagacctgatgaaaggaataagatatttgtgcctttttataaaagcatctattacgaaagtaaaattcagttgcttacagttttggccgctttgtagcactattataaacagcccaaatttatggccttggacttactgcatgacacatggcctggttacctgtcatggaatgctgcagtggtggtttgccaagcttctgtggatgtttgaagactttatttttgcagtcttaaccttgggctggacctaagtgtatgtaaaccatatgatgcctgtattgtttatagatgctgacaaaagaaaactagaccttttgttttttgttgtaagatttttgttttcatgcctatgctcatagtagatagtttgcaaatgaaagttgatttgccatacttttaaataatattgttttagcttgaatattctataatacacttttatagagtataacatgctaaatcactgttttgttgtaagaagggtgtaaacattttgttaataaaatgctatgtttacaaatataaaaaaacctcccaaa

SEQ ID NO: 38353 - DNA, 338 bp, Homo sapiens
cacagtttttatgttcatcttgcacaatgctgtctcttcctgaagacctgatgcacgtctcagaacctgtggccgccctggctgtgtgtgaaacatttggagatacctggagtacggacagtcacctctgactccccactcagaatcaccaatactacagctctggacggcacgtctgagccatccagccacaactctgcaggagctcccactggagggtacatttcctttttcggcttttgtctaaagtcaggccctctgtttttgactcaaaacggttaaacaaaagttatgggaggccattgatttggactgagctcctgcactagactccaaca

SEQ ID NO: 38354 - DNA, 555 bp, Homo sapiens
gaagcaaagtcataatgggtctgatgtcctttgctgaggagcttagactaaactgtttaggtaaaaggagccagcaaaatctttaagtgagggagtaacataagatttgcatgttagaaggctctctctggctgctatgtacagagggaggctaatggcagcagatctggtgaggatgctgggcccgtgatctgggaacttgcctgccccaaggcagcaatcatgggagtggagtcaaggaaacactaaagaagtagacatgataggactttttaagtgggaatggccagggctctggccatttggaagcctaaagagaatggaatagcatgagttcggtttgggggaaattcagtggtaagatgcttgtttgtcagaaacacacttgagatgggagatcagtttggtgtcatccatgtcctcttggtaagtggaaactataatataaaatctttcaggccaggtgcagtggctcacacctgtaatcccagcactttgggaggccaaggtgagtggatcacctgaggtcaggagttcgagaccagcctggccaac

SEQ ID NO: 38355 - DNA, 248 bp, Homo sapiens
tcaaacagtagccagttagttctttgctgaggaaagggaaccattgctgaatgcttttgagattgctcttggaaattagtctctatatgaagcacagagccatttgattttatttcaagacacatgtagaggtcttgtcatcaagagattagcaacataaataatgtaaatgactattattagaagtaataccttaatctctagactaagcaatagaaaggatggaagcaaagtcaaaatatcataga

SEQ ID NO: 38356 - DNA, 367 bp, Homo sapiens
taagagtcagttgaggaccattaatttagccccagaaaggttgctctgcagatagtatggataataaagcaggcccatgttccacagctattctgagctgcccgtgtttcactgcttctccatttctgactgaatatgctggagaaatatgtggtcctgctaactctttctttttacctctaaattttaaggcctccggattttgggctcccaccatatggcatttgttttcattgggtagggcctttagccagttctgttcacctgagtcttgcagcgtctgctcctttggcttaggtaaatcgtgtcttttcaaactgtaggctcccttacaatagtgttgacacgtggattaatgcttccagaa

SEQ ID NO: 38357 - DNA, 380 bp, Homo sapiens
tacttttttccttcatgtatcagcccacttgcagacagcatgaattgttttgtaaacttacaggatgccactgtaagaaaagacgggcctaggtgcagtagctcacgtctgtaatcccagcactttgggaggctgaggcgggtgtatcacctgtggtcaagaatttgagaccagcctggccaacatggtgaaacctcagctctactaaaaatacaaaaattagctgggtgtggtggcacacacctgcaatcccagctacttgggagcctgaggcaagagaatcacttgaacccgggaggcagaggttgcagtgagctgagatcatgccaatgcactccagcctgggcaacaagagtgaaactccatctcaaaaaaaaaaa

SEQ ID NO: 38358 - DNA, 227 bp, Homo sapiens
taagatttttcttacctaatatattatttttttaattcttggcatttgtgttttgttttgagacatagtctctttctgtcgcccaggctagagtgcagtggcgctatctctctcattgcaaactcagcctttcaggctcaagcgattctcctgcctcagcctcctgagtagccggactcacaggagcacaccaccacgtctggcatttttgtatttttggggaaatg

SEQ ID NO: 38359 - DNA, 745 bp, Homo sapiens
ggcacaaaggggtcgaggctacagagccatggccggggctacgcaggcagaggcggcgacactgtagtgagaagagactgtgatccgaggacagggaaatccaaaaagaagtccgctcccagtattttgtcaaatggacggattggacaggttggaaaattcaaaaatggaacactgattctgagcccagttgatatcaagaaaataaattcttccagagtggccaaatgaagtactttgtcaaataaaacgaggatgggaacaactgagtcaactgcagcggccctggaccctgtgcgactctagatagatcgttcttaacacgcatttcacagactgctttttcattttagaaaaaaagtcaaacagaagtaacatttctagttgccgaagtgtctgcttcatggtgctgaacgtgtcaggcccagtgcagcatgaatgtgaagtgaacccactgaaaagtgatttttaatgttctccagcaaacttcactcctgtttcatgttcactggtatttggtgcatttgcttgtaatacagttttttataactttactgttttgtaaatgctagtagtttacattaaattgccttatatttttaatgatttaatgttatgatatcatgaaagaaccaagaatctagtaatttatcagttttgtggaaaagcagttttaatttttagcctaccatgtgtacaaaatctacttcataagaagttatataaataaaataggtttgtagta

SEQ ID NO: 38360 - DNA, 1423 bp, Homo sapiens
ccggaagcgggggtgcagcgcggcagaatgagggttgattcctcggctgaccccacaatgtcgcaggagcaagggccggggtcctccacgcctcccagttctccgacacttcttgacgctctgctccagaacctttacgactttggaggtacagaaggtgaaacagaacagaagaagatcataaagaaaagggaaaacaagaagagagatgtgatggcttcagcggccttggcagcagagccatctcccctacctggttctctcataagaggccagaggaagagcgcttcgagcttcttcaaggaacttagagaagagcggcattgtgctccttctgggacccccacaggaccagagatccttgctgctgcagttcctccctcttccctaaagaacaatagggaacaagtagaagtggtagaatttcacagcaataaaaaaagaaaattgacgccagatcataacaagaacacaaagcaggctaatcctagtgttttggagagagatgtggatacacaagaatttaacctagaaaaagctcgtttagaagtgcaccggtttggtatcacgggttatggaaaaggaaaggagagaatcctggaacaggaacgtgccattatgctgggcgctaagcctcctaaaaagagttatgtgaattacaaggttttacaggagcaaattaaagaaaaaaaggcagcaaaggaagaagaaaagagactggcccaagaaacagatattttcaagaaaaagaagaggaaaggacaggaggacaggaaatccaaaaagaagtccgctcccagtattttgtcaaatggacggattggacaggttggaaaattcaaaaatggaacactgattctgagcccagttgatatcaagaaaataaattcttccagagtggccaaatgaagtactttgtcaaataaaacgaggatgggaacaactgagtcaactgcagcggccctggaccctgtgcgactctagatagatcgttcttaacacgcatttcacagactgctttttcattttagaaaaaaagtcaaacagaagtaacatttctagttgccgaagtgtctgcttcatggtgctgaacgtgtcaggcccagtgcagcatgaatgtgaagtgaacccactgaaaagtgatttttaatgttctccagcaaacttcactcctgtttcatgttcactggtatttggtgcatttgcttgtaatacagttttttataactttactgttttgtaaatgctagtagtttacattaaattgccttatatttttaatgatttaatgttatgatatcatgaaagaaccaagaatctagtaatttatcagttttgtggaaaagcagttttaatttttagcctaccatgtgtacaaaatctacttcataagaagttatataaataaaataggtttgtagta

SEQ ID NO: 38361 - DNA, 1527 bp, Homo sapiens
ccggaagcgggggtgcagcgcggcagaatgagggttgattcctcggctgaccccacaatgtcgcaggagcaagggccggggtcctccacgcctcccagttctccgacacttcttgacgctctgctccagaacctttacgactttggaggtacagaaggtgaaacagaacagaagaagatcataaagaaaagggaaaacaagaagagagatgtgatggcttcagcggccttggcagcagagccatctcccctacctggttctctcataagaggccagaggaagagcgcttcgagcttcttcaaggaacttagagaagagcggcattgtgctccttctgggacccccacaggaccagagatccttgctgctgcagttcctccctcttccctaaagaacaatagggaacaagtagaagtggtagaatttcacagcaataaaaaaagaaaattgacgccagatcataacaagaacacaaagcaggctaatcctagtgttttggagagagatgtggatacacaagaatttaacctagaaaaagctcgtttagaagtgcaccggtttggtatcacgggttatggaaaaggaaaggagagaatcctggaacaggaacgtgccattatgctgggcgctaagcctcctaaaaagagttatgtgaattacaaggttttacaggagcaaattaaagaaaaaaaggcagcaaaggaagaagaaaagagactggaatgcctgatgctgcgtaatttataaagaaaggaggctgatttggagcatggttctgcagactgcatggaaagcatagcactggcatctgctcggcctccggtgcccaagaaacagatattttcaagaaaaagaagaggaaaggacaggaggacaggaaatccaaaaagaagtccgctcccagtattttgtcaaatggacggattggacaggttggaaaattcaaaaatggaacactgattctgagcccagttgatatcaagaaaataaattcttccagagtggccaaatgaagtactttgtcaaataaaacgaggatgggaacaactgagtcaactgcagcggccctggaccctgtgcgactctagatagatcgttcttaacacgcatttcacagactgctttttcattttagaaaaaaagtcaaacagaagtaacatttctagttgccgaagtgtctgcttcatggtgctgaacgtgtcaggcccagtgcagcatgaatgtgaagtgaacccactgaaaagtgatttttaatgttctccagcaaacttcactcctgtttcatgttcactggtatttggtgcatttgcttgtaatacagttttttataactttactgttttgtaaatgctagtagtttacattaaattgccttatatttttaatgatttaatgttatgatatcatgaaagaaccaagaatctagtaatttatcagttttgtggaaaagcagttttaatttttagcctaccatgtgtacaaaatctacttcataagaagttatataaataaaataggtttgtagta

SEQ ID NO: 38362 - DNA, 1670 bp, Homo sapiens
ccggaagcgggggtgcagcgcggcagaatgagggttgattcctcggctgaccccacaatgtcgcaggagcaagggccggggtcctccacgcctcccagttctccgacacttcttgacgctctgctccagaacctttacgactttggaggtacagaaggtgaaacagaacagaagaagatcataaagaaaagggaaaacaagaagagagatgtgatggcttcagcggccttggcagcagagccatctcccctacctggttctctcataagaggccagaggaagagcgcttcgagcttcttcaaggaacttagagaagagcggcattgtgctccttctgggacccccacaggaccagagatccttgctgctgcagttcctccctcttccctaaagaacaatagggaacaagtagaagtggtagaatttcacagcaataaaaaaagaaaattgacgccagatcataacaagaacacaaagcaggctaatcctagtgttttggagagagatgtggatacacaagaatttaacctagaaaaagctcgtttagaagtgcaccggtttggtatcacgggttatggaaaaggaaaggagagaatcctggaacaggaacgtgccattatgctgggcgctaagcctcctaaaaagagttatgtgaattacaaggttttacaggagcaaattaaagaaaaaaaggcagcaaaggaagaagaaaagagactggcccaagaaacagatattttcaagaaaaagaagaggaaaggacaggaggacaggaaatccaaaaagaagtccgctcccagtattttgtcaaatggacggattggacaggttggaaaattcaaaaatggaacactgattctgagcccagttgatatcaagaaaataaattcttccagagtggccaaatgaagtactttgtcaaataaaacgaggatgggaacaactgagtcaactgcagcggccctggaccctgtgcgactctagatagatcgttcttaacacgcatttcacagactgctttttcattttagaaaaaaagtcaaacagaagtaacatttctagttgccgaagtgtctgcttcatggtgctgaacgtgtcaggcccagtgcagcatgaatgtgaagtgaacccactgaaaagtgatttttaatgttctccagcaaacttcactcctgtttcatgttcactggtatttggtgcatttgcttgtaatacagttttttataactttactgttttgtaaatgctagtagtttacattaaattgccttatatttttaatgatttaatgttatgatatcatgaaagaaccaagaatctagtaatttatcagttttgtggaaaagcagttttaatttttagcctaccatgtgtacaaaatctacttcataagaagttatataaataaaataggtttgtagtaaaaaaaaaaaaaggggggcgaataaaatatcctcgaggggcaaaattagggaaccaggtttttgtacaaacgggcccaatggaagccgactacaagacagcacgcgcgagggttacacagtcgtgacgggaaacacgcagacgggacctggaggagaccacctgggggcaactggaacacaccagaatagagccaagacaaacacaaggcggagaaagccacacgcggaaggcacacagaaatgaga

SEQ ID NO: 38363 - DNA, 1304 bp, Homo sapiens
ccggaagcgggggtgcagcgcggcagaatgagggttgattcctcggctgaccccacaatgtcgcaggagcaagggccggggtcctccacgcctcccagttctccgacacttcttgacgctctgctccagaacctttacgactttggaggtacagaaggtgaaacagaacagaagaagatcataaagaaaagggaaaacaagaagagagatgtgatggcttcagcggccttggcagcagagccatctcccctacctggttctctcataagaggccagaggaagagcgcttcgagcttcttcaaggaacttagagaagagcggcattgtgctccttctgggacccccacaggaccagagatccttgctgctgcagttcctccctcttccctaaagaacaatagggaacaagtagaagtggtagaatttcacagcaataaaaaaagaaaattgacgccagatcataacaagaacacaaagcaggctaatcctagtgttttggagagagatgtggatacacaagaatttaacctagaaaaagctcgtttagaagtgcaccggtttggtatcacgggttatggaaaaggaaaggagagaatcctggaacaggaacgtgccattatgctgggcgctaagcctcctaaaaagagttatgtgaattacaaggttttacaggagcaaattaaagaaaaaaaggcagcaaaggaagaagaaaagagactggtaggtgtgatggtctgtcctttattcaactagaatgggaagatggatgctctttgccacagtggaatgccggaagccgctgcttggagagcaatgaaggcaccagagttaaaggatcccatgctccccatttcttcgagttagctctgtttagtaataccagccaagtaatctggcgtacttacatgcaagatttgctttgaaatagcaaactccttgtcttagtccgtttttgttgctgtaaaggaatgcctgatgctgcgtaatttataaagaaaggaggctgatttggagcatggttctgcagactgcatggaaagcatagcactggcatctgctcggcctccggtgcagcatggggagacgtgccaggtcctttaacaaacaggcccatgggagtgggacgaccagcgggacctctctttccgaggaaggccaggcccaaggggcccggcggaccaaccccaaaggccggcaagggggagaaaaccgcggggggggagacacaaggcgcggcgggcagacatcgaacaggataggtaaaggacacaatcacgcggagagatatcgcaccagaacccctc

SEQ ID NO: 38364 - DNA, 568 bp, Homo sapiens
cagggtaggagaagggaaggaaaggttggagtgtgtttttccatgtaggtctatatagcacacatccaagaagggggtttggttgaaggcactctccattgacgagatatccatgtttaggcatgaaatgtacatatttgtgtcttcattagtgatgctacctctgctttcctcgctttgttctggcattcccttcctgctgtcacttacatatccccacagacacctcgtctgccccacatccccaccgctgaccccattttccagccgtctaatctaccccctctcatcgccggcaccactcctaatgcccacttgcccaaccttgatatctgggtattcccacccaaaggcctgatgctgacagtcctgagtttttcactcactgttaaatgaaacatccatagctggatctgtgggttaaactgtgggcaaattatacaaaagattatttgctgaaggatccaggcttccttttcaggagaatagtcagatcctgtcttacgtttattgctagatataaaatgactaattcccagagagagtttctaagcaagaaaaaaaaaaa

SEQ ID NO: 38365 - DNA, 463 bp, Homo sapiens
aggccagtcagggtaatatttggagtctaagatgcggttgacactcgagtcctacagcattctttgtgtgtgtgcatttgcatgcatactcagatccctgtgaagtggaaatggatttgtggtattcttctgtttgcaaacccagataaccttaaagggctaaagagattttgctctgattatttagaaagattgacctttttaatacccaatgtaggactgtctctttcaaagacatcattgagaagagtggggtaggcaatagcaaacacctggtcagagttaatgaagatgcatgatctcccgaatgtttgtgatgtgcttttaaaccacgtaaagatctgtgataaatggcaaatgtgaagagattgtaaaaggcaaaaatgtttgttattgaaaattaaaatagaaaagactagtgtttaataaattaatgtctgcacctttgaaagtaaaaaaaatt

SEQ ID NO: 38366 - DNA, 96 bp, Homo sapiens
tctattctgacatttatgtctcccttcaatcacgtctttggccttagaagattgagttactggattctttatatattctagtggtcatctctgaaa

SEQ ID NO: 38367 - DNA, 534 bp, Homo sapiens
aacggggtttcgccatgttggccaggctggtcttgaactcccgagctcaggtgatctgcctgcctctgttcatggatttgactattccctctctttctctctctccctctctctctctctctccccacttccttccagttctcgatttcttggaaaaccagaaaaacaacttagtttcagcttggtgtaaaacttccgcatgagggacttcattttggtttagtcttttgggcctagtgcaggagctcagtccaaacccatggcttcctgtaaactttatttaacaccattccttgtcccatattattgtcttcctggtgccagaaaaaggggtccctagctgggtgtggtggctcacacctgtaatcccagcactttgggaggctgaggtgggtggatcacctcttgaacacctcaggagttcaagaccagcctgaccaacatggagaaaccccgtctctactaaaaatacaaaattagccggacgtggtggcacatgcttttaatcccagctacttgggaggctgaggtagg

SEQ ID NO: 38368 - DNA, 162 bp, Homo sapiens
gtgcattttcattagaactgagccgtcccagtgtcctctcagcgttgatgttgatgtcttcatcattccggggtgcagtaacaaagtggcatccactgaatggcctataaacaacagaaatttgtttctcaccgttctggaggctagaagtctgagatcaag

SEQ ID NO: 38369 - DNA, 489 bp, Homo sapiens
aaaatctagggaatctccattccatttcaaagcctgggaaaaatcctctccagcttttagctccacccctctgggctctcctatctccgtctgagtcaccctgattcttttatgaaaagcaacacattcacatgtgagtagttttatcagcctgcttcctatcagtagaatttggggggtccaacagccctattactttctgtctctttcaatccaaactagaactgtttatgttggcataaaattctcaagaacctaatgggctgtggaagtattccacatgggtccactccattaaagttcacattcacaaataaaccaggctgcacatttaatactttgcttggaaatctcagctaaatatacaagttcatcacttgcaaatttggctttccatataaccataggatacaattctgctaaacttagttgctactatgtaacaaggatcccctttctgccagtttccaataagaaagacctcacttc

SEQ ID NO: 38370 - DNA, 483 bp, Homo sapiens
ccagtgtgttcttgaagcccttcctacactgattgtggtcaagtcagaacctgcctacacagtgcaggcccatcatgcggcattcaggacgttgctctccaagcctgcgcagcacaggaatgcctgctctctgtttcctttaccagtgctcagtgacctttaccagagacctgttcttgctgactccgattgtgtgcttctctgattagaaacgaatttttcttggctgggtacagtggcttatgcctgtattcccagcactttgggacgccaaggtggaagaattgcttgaacccaggcattcaagactagcttgggcaatatggcaaaccctgtctctacaaaagaaaaaaaaaatacaaaaattagctgggcatcgtgcgtgcctgtagtcccagctacttggtaggctgaagcaagaggattgcatgagcctgggaggttgaggctgcagtgagtcgtgttcactgagaccctatctca

SEQ ID NO: 38371 - DNA, 592 bp, Homo sapiens
  misc_feature (515)..(515): n is a, c, g, or t
  misc_feature (543)..(543): n is a, c, g, or t
  misc_feature (555)..(555): n is a, c, g, or t
ttggtcatagtagaaaattaaaacattgttatttctttaggatattaaaaaaatatgccttttgagttttaagaaggtagcctataaactaaacagtgtctagttacttaacaatgctaatcatgtaatgtaggtactttgtaaatgcttaaaatatggaaagattttcaaacatttattgagctgtttgtgatgggaaagaaacaaatgaataacacttcatttattgaagtgttaatgtgttaattaagaagtcagcaaaatttgaatagaaattctataaaagtgataaaatcaattagcacaaagattttatatccaaatcacctctggaacattaagggttgactgagctgactttggaagtcttaacatcttggtgaattagagatcaccctttaagtggacaacagggctgggcgcagtggctcatgcctataatccccaaagtgctaggggttacagggagtgagtcacccacaccccagcctcccagatgggtctttttaaggaanttgctagctttttgggcctcactacttnttcgcgctgttngggaaggggtttttgcttgctgccggaattgggctag

SEQ ID NO: 38372 - DNA, 412 bp, Homo sapiens
ttgctggtaaaatgatgtctgctgagacaatcggagcctaaagggggctaattctctctagacagggggtattggagatcatctaaaaatggaacctggcagccacacggcacactaggaaaccttggcttggcctacgtaataggctgcaagatgcataaaatcatcaggatgccatgagcccctccccaccaaattaataactccatatttagtaagctaagtactgatttgcttttgaataaaacttatgctaaacatataatttgcataaaatgtttatcaacttatattattcacagggtgggggaagatcagtgatattactgattgcacaaaaaccagaaggaataagtgtgctgaagaagtatcagcatctatttcgaaagtttgtactcattttaagatattc

SEQ ID NO: 38373 - DNA, 330 bp, Homo sapiens
gccttctcacgagagcagggaaggattgaactcaaggtctccttaagttgccaagctcaaagattcatgagtctgacttacataaccaccaggggccatttcctcattcgaaacagagggacttgctgaggaccccaagcacttccacttctagaagtcgaagccattctcggaggaggcgtaggagacacgggcggatccacaggagctccagggcatcccctggaaacggaggttccttctgtccttccgaaagcctgacgtccatgtgctttcttacaatttgcctctttctcctaaaaatagaatttttctaattcccttatttga

SEQ ID NO: 38374 - DNA, 490 bp, Homo sapiens
taatgaccacccctagagaagacagcaaggatttttaaaaagagagatgaagaatatatacccagaagaagccaagctttggcaagaaaacctttcgagtgtcatttaccatcacttgaaaaatatctaggaaattcctaggaaacaaagcttagggtgggatgaaaatggaaaaaaaaaattaaagagtttaaaattgtagtataacagcaaatactatgctcgtatagaactctgtgagtctgtttattacatttataacattggctttgcagcctctagtggaaagtgagagagtcaactatttacatgtcagctgtgcagttaacatattataatgttccagttctctctctctcaagaaaagtccctgctgggcgcagtggtgtgtgcctgtaatcccagctactagggaggctgaggcgggaagatccctgaagcccaggagtttgaggtcagcctaggccacctagtgagatgctgactcaaa

SEQ ID NO: 38375 - DNA, 343 bp, Homo sapiens
tgagacggagtctggctctgtcactcaggctggagtgcagtggcgctatcgcagctcactgcaacttctaccttccaggttcaagcaattctcttgcctcaatctcccgagtagctgggattataggtgcccaccagcacgctcagctaatttttgtatttttagtagagacggggtttcaccatgttggccaggttggtcccgaattcctgacgtcaggtgatccacccaaccaggcctcccaaagtgctgggattacaggcgtgagccaccacgcccggccagttttttctacaaaatgttttattctacaatatgttaaggtaataaagggtgctagttg

SEQ ID NO: 38376 - DNA, 458 bp, Homo sapiens
acctttctccctcccctcctctatgtctttctgaccaggtgcccccaggacgcctattgctgaatgggcataggcattccccagttccctccctggccccaagctccctggaggtgggaccacacatgacagagcgacaccccagcttgtcctctcttttgcaaagtgcaggatgagaattttgggttatcctggctcctcccatgttttttgcagctccagtgacagcaatgccaaatgatacccaaagataaaaatattgatccaagtgcagatgagctgaaaacattccttttctgatagaaaacacggtaaacagtctcacttccttcctcaaagattgtacctggaaagccatggctggttaattttttccctttagaatacataacattgtgaacttcagaaaataccataatcagggagttccatgacagagttaagtctccacactccaa

SEQ ID NO: 38377 - DNA, 856 bp, Homo sapiens
ttcccatgaaattgcattaggcctctaagtggatttcccataccttggttgtcctggtagaaggaaacttgacctaagtcagggttgttccagacttagcttagggaactgtatcttccctcgtcacctttgcactagatatcattccctttcctcttctggaacatcagggcatcaattactctgacccctctgtttattgcttcagtttctctttaaatgcttgatctttctactcaacatgtaaacataaatgagtctcatagaaaaagggaaagtaaccaatacctctcttcaggtgaaagcttctatgccatttctacctctctccctgtccactctcccattgggatactttcctcctatccctgccattctgtggagcatagcagtagagtgacctaaggacattttctcttcttgggctattgcccatgtatgtggcacttgctgtcaccaagaattccgtgctttttaaaaactttttggccttctgttttcagatgggcagtttgctgaaattaagtgcttctaatgaacaattgctttataaataattagaaaaaatcaattttaaaaataggtagatttgggctgggcgcggtggctcacgcctgtaatcccagcactttgggaggccaaggcgggtggatcacgaggtcaggagatcgagaccatcctagctaacatggtgaaaccccgtctctactaaaaatacaaaaaattagctgggtgtggtggcgggcacctgtattcccagccactcaggaggctgaggcaggagaatggcgtgaatccgggaggtggagcttgcagtgagccgagattgtgccactgcactctggcctgggcgaca

SEQ ID NO: 38378 - DNA, 1810 bp, Homo sapiens
ggcacgagcgcgtgtggttgaggatgggctggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagaaaatgaaacagctcgacaagaacaaactacaggcggttgccaaccagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 38379 - DNA, 1005 bp, Homo sapiens
  misc_feature (872)..(872): n is a, c, g, or t
  misc_feature (874)..(874): n is a, c, g, or t
  misc_feature (883)..(883): n is a, c, g, or t
  misc_feature (887)..(887): n is a, c, g, or t
  misc_feature (889)..(889): n is a, c, g, or t
  misc_feature (892)..(892): n is a, c, g, or t
  misc_feature (905)..(905): n is a, c, g, or t
ggcacgagcgcgtgtggttgaggatgggctggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttccggaggtatgngntggaatganagtnanaanattagggtgcacnattttaaacacacgttttgagaagtagaagttgactggcggagggtcggcaatggggtaggaataaagagggcggaaacagggtagggcaccgctggaac

SEQ ID NO: 38380 - DNA, 558 bp, Homo sapiens
tagaaactgcatagaggagatggaggcactggcagaggtgccatagaagcagtgaactgggaagtctggttgggtatcttggggctaaggcagcagctgcagagaaggttcttaaatgtctaattagactggggcagtggagtccatcagagaggtcaggacccgaggccttcatgaatcaacatggaggtcccctcccattgactccttcctgtgttctgctcagaatacctggagttgtcttggctaccatttccttggggtggggctgggaatggaattggagacaaagcattttctgtcatgcaaggggtagctggctgtcctgacaggagacagggaatctcctgctaccaggttgagttggctagcctgtgacatcagcccagagggagtaggaagaagagtatcttttgccaagacttaaatagcaccaggaaatacctcggtacaggcttctcttaatcagttgcagtatacaatactaagggcaaagctcaaatccctctgcctgcccttactacactcatgctacaggcttgtatctttacagacatg

SEQ ID NO: 38381 - DNA, 1778 bp, Homo sapiens
tacaaccccacattcggctaagtacgaggccccgtgttaatcggccgagggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 38382 - DNA, 1756 bp, Homo sapiens
ggcacgagcgcgtgtggttgaggatgggctggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagaaaatgaaacagctcgacaagaacaaactacaggcggttgccaaccagacttatcaccagaccccaccacccaccttctcctttcgagaaaggatgactcacaagagtcttgtctacctctggttcctgtgcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 38383 - DNA, 1858 bp, Homo sapiens
ggcacgagcgcgtgtggttgaggatgggctggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagcggatcagcgctgatccgcttaaggtagcaggtgaagctgcaatagcaacctggggatgtatcatgggtacgataggaggggccattcctggcaatacacctggaagtggaattggcatgccaggaagggg

SEQ ID NO: 38384 - DNA, 1783 bp, Homo sapiens
ggcacgagcgcgtgtggttgaggatgggctggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagtcttcgcccctcttttcttagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 38385 - DNA, 1645 bp, Homo sapiens
ggcacgagcgcgtgtggttgaggatgggctggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacagctatggaagttgggaccttttccgggaggcttatgctgccattgagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 38386 - DNA, 2006 bp, Homo sapiens
tacaaccccacattcggctaagtacgaggccccgtgttaatcggccgagggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggtcttttgtggggatgagccagggtgcaaggagagtacaatactccagttaccgaattgaaaccatccctgcagtggagcagcctcctccagtttctgttgggttttgagctacctgttaaataagtcagtgggattgtcaaggacaaagccctccctggctgcctcagggcaaaatcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagaaaatgaaacagctcgacaagaacaaactacaggcggttgccaaccagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 38387 - DNA, 1804 bp, Homo sapiens
tacaaccccacattcggctaagtacgaggccccgtgttaatcggccgagggcgggtccgggtccgctgcctggcgctgcgggcggcgggccatggtggtttggattgagccgggcccggccggggcgccgagtcggagggggtggcagtgagcggcggcagaggctacggggctcggtttggctgagaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagaaaatgaaacagctcgacaagaacaaactacaggcggttgccaaccagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 38388 - DNA, 1600 bp, Homo sapiens
ggcacgagcgcgtgtggttgaggatgggctggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgccacatacttcctccagccctctctaaactacccaccagtcttcgcccctcttttcttagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 38389 - DNA, 1424 bp, Homo sapiens
ccgctagtaggggccgggtggtgaatcggacgatgcgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 38390 - DNA, 1427 bp, Homo sapiens
gtatcgctaggtcgaggccggttttatcggccgagggaggctcggggctcggttggctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 38391 - DNA, 1567 bp, Homo sapiens
ggcacgagcgcgtgtggttgaggatgggctggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggtaatgtaagacacacagactaatgctgtccaacagaacactgtgatgagaaagatgttctatgcctgtgagcacttggaatatggctagtggctactgtgttagcacagttctagactctaggaatagagatcattgtccatttgaaccagaaaggcttgaggccaatactgtgtggttttaagtaacagatgaggcttcaacgtgactacagtggaatcctaggaaagctgtgctcaggaaggggcctctgggtgtaggatatggtggccaccagtcacctctcacttggagagcagtgtctagagttcaagccaataatttgtgagattaaaataatctacttgtcatagaggccctaagacagtaactggagctagctctctcagcccaagacaa

SEQ ID NO: 38392 - DNA, 696 bp, Homo sapiens
ggcaagatgaagtgaaaggtaaaccgcagttgaaagacgtgcgtctttcaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 38393 - DNA, 656 bp, Homo sapiens
  misc_feature (16)..(16): n is a, c, g, or t
  misc_feature (19)..(19): n is a, c, g, or t
aatatgtcggtcccangantgctgagacactggaccgtattcgtgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 38394 - DNA, 649 bp, Homo sapiens
agcacagaggaggtggacagcacaggtaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 38395 - DNA, 1783 bp, Homo sapiens
tacaaccccacattcggctaagtacgaggccccgtgttaatcggccgagggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggtaagggcgaagcctcggcccttgctccccatcctagtccctttttctgggtagggcactgccctggggccttgtcttgagtgcgggttcctgctctctcctcgccccgccctgcggggccgtgccctcctcagcccgagcgcaccttccgagcaatcgttacgctcagagcaggagggaaggaggtcaagcgacccaactcgtctgtttcacagatatggaacctcagattcagagacagggtttgacttgtccaaaatgatcaagatagttaagatagagcccaaactggaacccacggtttttgacttccagtccatcgcagtttcacctcgcggctgtcattgagaaataaaaccttttcccggttttttgttttgtttttgaggagtctcgctctgtcgccaggctggagtgcagtggagcgatctctgttcactgcaacctccgcctcccggcatcaagcgattctcctgcctcagcctcccgcgcggctgggacttacaggcgcgcgccaccacgcccagctaatttttgtagttttagtagtgacggggtttcaccatgttagccaggatggtcttgatctcttgatccgcccgcctcggccttccaaagtgcagggagtacaggcatgagccactgcctccggccttttcccggttttttaaactgcagcttccagtcctgcggtccgatcctcttcgcggcccctcatccccacttcagtaagctttctctggttgaaaaagccgaactctggttgtgtgggcccgtcatcaaaagataagcagccccaaaataaagttgttactctttttcttctcagcgtgttagcccagaagggaggtctgcacatgaataaaatgctactctttattgatgttgggtatctcctacttgagattgcaaacatcctgagagcagcgtctttgtccagatgacattcgccacgactttgatctcagttcacctgacttctgatggctttgccgtctgtccttccctgtcccctcagtcgactttcccattgggaaacagatgtgacttaaagccatgggaagaggggagtgttgtggccagcaatctcctccagtctggtggcagatgaccagtatggcctgtgactattactgaaggatcagagtactcgggcttgtgcttggggtggtagtaaagctgcgctttgctctgtttcctcccgttcactgagattagccccttctcccctacacacatctttttgaattttgctttacttctatttcttgagatgaaaagtctgggccaggtgcggtggctcacgcctgcaatcccagcactttgggaggctgaggcaagcacatcacctgaggtcgggagtttgagaccagcctgaccaacatggagaaacccggtctctactaaaaaaatacaaaattagccaggcgtggtggcacatgcctggaatcccagccactcaggaggctgaggcaggagaattgcttgaacccaggaggcggaggttgtggtgagcccagattgtgccattgcactccagcctgggcaacaagagtgaaactccatctcaaaaaa

SEQ ID NO: 38396 - DNA, 605 bp, Homo sapiens
aacagctcgacaagaacaaactacaggcggttgccaaccaggtgggctgtccccaccccactgcctcctgctgctcaggcctgggggtatagagttgctaaggcatctggggccgacctgcccatgtagttgtagaggctgccgagaggccactctagaccagatcaggagtgttcaggcaggctggctgtggtgggtagactaagtggcctacaggcaagctggaagtccctggtatgtgacagttttggctatctatcccgtcatcacctctctttgggtcgagcaagcaatctgccttggtgatggcctgagcagcaaggagtctatgttagtctgtgtaatggggttccaggggacagagatcaggcagagccagtctgatcatcccttgctcctggtccatctgcatctggatcatccctgcccccccagtaccttttaggactccctaatctgctgagcccatcttgattgtatttctgctgccctttcacagtccctagtggagctcacagtccctagtggttttccccactccagtcagtccattctgggtatggtctggtctcctctcttggggatgcagctgtgcagtgaaggag

SEQ ID NO: 38397 - DNA, 371 bp, Homo sapiens
gaatggaattggagacaaagcattttctgtcatgcaaggggtagctggctgtcctgacaggagacagggaatctcctgctaccaggttgagttggctagcctgtgacatcagcccagagggagtaggaagaagagtatcttttgccaagacttaaatagcaccaggaaatacctcggtacaggatccacattctgtgtactcattcctccattggctgttctttggtgaggaataatcatctgaaggtaggttgatgcactagggcagtcaggaagccctggcaatctctgctacagtggccatgcccagagacacagtggacagctttgtccatgttggccacactccacccaaaagtctgtctacacag

SEQ ID NO: 38398 - DNA, 364 bp, Homo sapiens
atggagtcttgctatgttgcccaggctagactcaaatgatcttcctatctcagtctcctgagttgctgggactactaggcatgagctaccatgcctggcttcacatcatttattcttaggccactttgatgctttttcattgatgctctttatagacatagtgaagtaaaagtttatctaggatatatggtgggaggtgaggaagacttaggtagagaggttccaaaccagttgttactgcttagctcaatttcagacatacttcctccagccctctctaaactacccaccagtcttcgcccctcttttcttagttctgtggcacttgccctgggtgccctaactgtatggcatgctgttctca

SEQ ID NO: 38399 - DNA, 327 bp, Homo sapiens
atgctctgaaaagctttgagcattttcacctcaaccttgggtgtgaacagtcttgtattttcttgcctttggaaagtagttcttagtgactggaagcctgaggcttgggtgatattgtcaggaaccagggatgaacctgaggggcctggacaccgcctgaaattgtgtttgattctagtccttaatcatttcccaaccagcctggctaaacaattgtgtgggccactataaccatcggtacttcttctctttctgctttttcatgactctgggctgtgtctactgcagctatggaagttgggaccttttccgggaggcttatgctgc

SEQ ID NO: 38400 - DNA, 1762 bp, Homo sapiens
ggcacgagcgcgtgtggttgaggatgggctggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 38401 - DNA, 2347 bp, Homo sapiens
  misc_feature (1776)..(1776): n is a, c, g, or t
ggcacgagcgcgtgtggttgaggatgggctggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagataaaaaaaaaaacaanaaaacataacagatgatacgaaaagatgatacataacagaaagggggagccgcctgccctgaaaattgtcaccctcgcaggggggcgccccataaatttctacgcgtatcgcaccagattgttgtgttgttcacactgtgttgtggcccccaaatatggagagagctgtcgattttctcagaaccaggcaaaagttggcactcagttctatttgaaccagaacatcttgtgcgtcactggtggaaacagctcgggcgttacacttccggcgaactcctttgtgctataggggacaccccattatacctgtgcgggggggggggagacaatactaaggtgtgggcgatacaacatcattacccactacaacataataattttctacacgcgccccctcaaggaggcacagcacatttaataccaactttcctagacagacggtgaatgaaacatgcctgtgaacaagacacacggcataataatatatcattcctctgctgttaaaacgattattggggttacacgggcagacactttgttgaccaagaaacatttttttcacaggaggcac

SEQ ID NO: 38402 - DNA, 1583 bp, Homo sapiens
tacaaccccacattcggctaagtacgaggccccgtgttaatcggccgagggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtgggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 38403 - DNA, 1708 bp, Homo sapiens
ggcacgagcgcgtgtggttgaggatgggctggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 38404 - DNA, 1826 bp, Homo sapiens
caacagatatgtagcagcgcggcacctgttgttatttcatgaccgtgacgggtcttagttcgtatatcattgtggcgtcggctgtacaaccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagaaaatgaaacagctcgacaagaacaaactacaggcggttgccaaccagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 38405 - DNA, 2136 bp, Homo sapiens
tagaaactgcatagaggagatggaggcactggcagaggtgccatagaagcagtgaactgggaagtctggttgggtatcttggggctaaggcagcagctgcagagaaggttcttaaatgtctaattagactggggcagtggagtccatcagagaggtcaggacccgaggccttcatgaatcaacatggaggtcccctcccattgactccttcctgtgttctgctcagaatacctggagttgtcttggctaccatttccttggggtggggctgggaatggaattggagacaaagcattttctgtcatgcaaggggtagctggctgtcctgacaggagacagggaatctcctgctaccaggttgagttggctagcctgtgacatcagcccagagggagtaggaagaagagtatcttttgccaagacttaaatagcaccaggaaatacctcggtacaggatccacattctgtgtactcattcctccattggctgttctttggtgaggaataatcatctgaaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagaaaatgaaacagctcgacaagaacaaactacaggcggttgccaaccagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 38406 - DNA, 1481 bp, Homo sapiens
gtatcgctaggtcgaggccggttttatcggccgagggaggctcggggctcggttggctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 38407 - DNA, 1701 bp, Homo sapiens
ggcacgagcgcgtgtggttgaggatgggctggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagacttatcaccagaccccaccacccaccttctcctttcgagaaaggatgactcacaagagtcttgtctacctctggttcctgtgcagttctgtggcacttgccctgggtgccctaactgtatggcatgctgttctcatcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttaccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 38408 - DNA, 1329 bp, Homo sapiens
tacaaccccacattcggctaagtacgaggccccgtgttaatcggccgagggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcagggcaggaatgatatcgccaccgtctccatctgtaagaagtgcatttaccccaagccagcccgaacacaccactgcagcatctgcaacaggtgtgtgctgaagatggatcaccactgcccctggctaaacaattgtgtgggccactataaccatcggtacttcttctctttctgctttttcatgactctgggctgtgtctactgcagctatggaagttgggaccttttccgggaggcttatgctgccattgagaaaatgaaacagctcgacaagaacaaactacaggcggttgccaaccagacttatcaccagaccccaccacccaccttctcctttcgagaaaggatgactcacaagagtcttgtctacctctggttcctgtgcagtcgaggtgagactagcatcgaaaggcacatcaacaagaaggagagacgtcggctacaggccaagggcagagtatttaggaatccttacaactacggctgcttggacaactggaaggtattcctgggtgtggatacaggaaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagata

SEQ ID NO: 38409 - DNA, 779 bp, Homo sapiens
  misc_feature (752)..(752): n is a, c, g, or t
ggcacgagcgcgtgtggttgaggatgggctggcggcgggtccgggtccgctgcctggcgctgcgggcggcgggccatggtggtttggattgagccgggcccggccggggcgccgagtcggagggggtggcagtgagcggcggcagaggctacggggctcggtttggctgactggggagtcggcaggcggcaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccagggcaggaatgatatcgccaccgtctccatctgtaagaagtgcatttaccccaagccagcccgaacacaccactgcagcatctgcaacagccaacttgcgaggcaattctggcaaacnagggtggtggtgtctagaaagaatggg

SEQ ID NO: 38410 - DNA, 780 bp, Homo sapiens
aaaacattgagttaaaaccccagtggaaatgttaaacagcaaatagcataaattctcaagagagaactatgggaactggaaaacagatctgcagaagttagttagaattctgcagagataaaagagatgcttgtgaggaagagacattacaaacatggatggtggtatgagggcccagtgggaaaaatagcatcctaaaggcagcttgagaagaaaggcagattactccccaggttcaacagtgaaactcaggaaatgccaagtagcaacagtagaggccataaggaagtaaaatcttcagtgtgctaaggaaaatcagttgttggcttagttttcagcaaccagcttaaattatcgttcaataatgggaacaaataaggacattttcacagaaaaaaaaaaaagttgtatttactaagagaccttcgctgtacttcgggaagaaggaagtaaggagaaaggagaaatgcggacagtaatggtatccagaggcgttgggaagtgcaggtaaatctgaataagcattcgcttctgaaagtgatcgtcactaatttggagaggattaaaaaccaaagtcccaacaaaaaatggaaatcagtgagggggtgatttgaatgaacacactcttaagttctttgaactgtttgggaagtgtaggagggatattgattgacttcaaactttctgagtcaagtagacatgttccaattttaagggtaaccaccaaaagaatagaaatagtgtttaaagctttcaaactcacagagggtaaaaatatgg

SEQ ID NO: 38411 - DNA, 336 bp, Homo sapiens
attaaacacccacagcccttttcaaatgggaaataaatagcaacatctgacaccttcttggggacccagaatcattgtaatatacttatggaagcagcatgtgctgttctcagcagtggcctagaacttagtttatagaaagtgttgcagccatctgcttgcctatttgactatttgcttcttttccataaagctagcattaaaaaggtatagttttcttacctttagagatgacactttataaaaaagcagtttctaaatgaaaggctttcctatcatctcgtagaactgggcttctcaaagctgccagcatcatcgcccaggagcttattagag

SEQ ID NO: 38412 - DNA, 502 bp, Homo sapiens
aacgaaaccttcttttgccccctccgcagcagtcgcctccgggctttattgcaagtttacggttccatacaagtaaatccgaaaaaaagtgtgtgtgggggggtccacaccactaattattatggcgaggaagataaagaagacatggacagaaggcggatggctctgcggcctggctcccgcagaccgaccgccttcttcttccattcgagatggctcgtaccgaacctccttgccttcttcctgggtctctcgggggctggaccaatacatctgccgatgccctggccgaatggcaggcgacatcgggtcctggacccccacacgcagctcagtacccacgaggccccaggccgctggaagcctgtagctccgcggaggatgaaagcctgcccgcaggttctcctggagtggtgagcctctgtcggaagggggcgcccacgtctttttaatggtcctaacacaccagtggaataaatctctaagattccaaaaaaaaaaa

SEQ ID NO: 38413 - DNA, 455 bp, Homo sapiens
acgaaattaaatattttttgcacaggttccatacaagtaaatccgaaaaaaagtgtgtgtgggggggtccacaccactaattattatggcgaggaagataaagaagacatggacagaaggcggatggctctgcggcctggctcccgcagaccgaccgccttcttcttccattcgagatggctcgtaccgaacctccttgccttcttcctgggtctctcgggggctggaccaatacatctgccgatgccctggccgaatggcaggcgacatcgggtcctggacccccacacgcagctcagtacccacgaggccccaggccgctggaagcctgtagctccgcggaggatgaaagcctgcccgcaggttctcctggagtggtgagcctctgtcggaagggggcgcccacgtctttttaatggtcctaacacaccagtggaataaatctctaagattcc

SEQ ID NO: 38414 - DNA, 362 bp, Homo sapiens
cagaattgaacttatttggaaatagggtcgttgcagatgtaattaaattaagatgaggtcatacttgagtagggtggatcctttatgctatgtgactggtgtccttataaaagagatggtcatgtgaagacaggcacacacacagaacaccatggaagatggaccagagattggagtgatgcctctacaagccaaggagtccctgtgactgctggccatgaccagaagctaaagagaggcatggaacagactctccctcggaggcctcagaaggaattcaccctgctgacacttggattttggacttctaggctttagaacaatcagagaatacatttctgtgattttaagctatccagttt

SEQ ID NO: 38415 - DNA, 287 bp, Homo sapiens
ttgctctaatattaatattttctcaggagcatattgtttaattttcacatatttgttaattttccatgttcttttttttccaagttcataatatattgtacaaattgaattatcacatgatgagttggcattagcttctccaggcatgggaacttaacagatgagattaagaactgtagacagtttaaaatccatttatgttgctttcatagctggagtttttttggaccttaacttgaaatataagacaatcaaagcaatgcttctgtatgtgaccagtacacaat

SEQ ID NO: 38416 - DNA, 267 bp, Homo sapiens
caatagtcactcagtgtttcctaagttaacagttaaaagggggttggaggataatgcttgacatgttattggtgaacttgagcaaccacagtgagctgtactggttggcagaagtagcggcgtagggaaattggagttgaaaggagtgtggccaataagcctgtgcccaaaacgtttgagttttatcctgatgtgaatctatgcagaactgaagggaaagcctgccttctgtttactggagttgtgcacagttttgaggaatttgaa

SEQ ID NO: 38417 - DNA, 366 bp, Homo sapiens
aaaaaaagtttacatatatatatatatatacacacacacacagccctactaacatagcctgttgcattaaaaagctcttagataaacttaaaaggtcaataaaaatattagcagggaacatcaaaaatgaaatcgttttgtggtacacttgtgtcattttggttcattgttccccatagaattgttttaagtcatgctttgtcaaaatatccaaaggatgatacgagtatcttactaggtttgtttttttcattagaatgtcattgtgttagaaaatttttgcaattcactaaggggaacaataactatgtaatttccaaataatcatatgaaaaggaacaaagtcattaaaagataataatgacc

SEQ ID NO: 38418 - DNA, 166 bp, Homo sapiens
gataacttgaacttcatcacaattaaaaacttttgtgcatcagacactatcaagaaagttgaatggcagcctatacaatgagagaaaatacttacaaatcatatacctgataaagggtctagtattgagatcatacaaaaactcttccaactctagaataaaaagc

SEQ ID NO: 38419 - DNA, 263 bp, Homo sapiens
tctgaccacaacccagacaggaagacaaagaagatatgacaattattatccctcttttacataagagcaagcaggttcaaggataagtcacctgtccaaggtcacaaagctagaaattcattaagtcagaatgcaagtcagaaaggcctttcatcacgaacgtagtgttccatctaccatatcatttgaagtctcattcagaaccgtgattagtgggttagaaaaacaggacatagtgagaaagacttgggaatgttattgtg

SEQ ID NO: 38420 - DNA, 374 bp, Homo sapiens
ggcagttgtaaaagtagaaaatgttttgcttggttaactattccctccccttattttaaaaaatataactacagaataataattaccaatgttttcaacttatggatttcctttataagtcatagactttaaattattccattctaaaacattctgggttccttttctctctgtttaggatattttttcattattaagaaataggaaagaacttataaactcaggaaaattaacatgggaagtgatttcctagtctatgcgctagaccttaatgggatatgtctttgtctcttcaaaatctgtaaaatcgtattcataaaatgcatgtataccttagtatgtagtttggcttgtgggttagagaatttgtttag

SEQ ID NO: 38421 - DNA, 500 bp, Homo sapiens
tctgttttgaaagcatataaaacaaatcatcactcctggtaaatggcctcaagatggttctgttggcacattacaaaacagaacccgaacccccatgctggtgaacgaacaatctagacaaggccaccctgcgtgtaattgaccaggctgtgcagtgaacgaggaccctggcctgggtggctgagctggggtgaacctcatcccttaggccaaggaaagggggtgtctttgtctgatctatgcaaaggctttgactgctggccaagcccagtgtagtggccatcccctttttctaactggcacaattaacagaaaggcaccgtgtgggctaaagaaagtcctccggccaggtttcaaactgaaggaaaaactacacaagaaatccgatttgaagtattacttgttcccacactataggcttacccgccaagttcagtaaaaacaggccaaagctgaacgtgtttctggaagctcatttacccacaagccctattcatttg

SEQ ID NO: 38422 - DNA, 211 bp, Homo sapiens
ctgattggagactgggatagtatcagttctcttccaagctgtttttgtggagtaatagaaggtttccattgtactgtgattatgattgagagggtgctgagtatgtggagattctgcatggtagattcttcttccaatgtatgtagatttatgtaaagaacagcagataaagcaatgaaaaatgaagtcagtgtttacttacacaaaaaga

SEQ ID NO: 38423 - DNA, 369 bp, Homo sapiens
ggactgactcagcactgtgggcagctgagaaggaaaaggccttgcaaatgctctctagaccttagttcaaaatccctccaccccagaggagccaggtatgggccaggcatggtaatagctgcaagcaagatgccaggaccatttaaggctgaggcatttaattaggtacaatgtattacttcctgaaagtgtatgaaagcttcatagtgtctgcttagacatttagtgatagcagctacctacccagattggaggggatttgggtggggggcggctctagaagcttagctgcacctttggtttgatccgtgtttgactcatgtttgtaaattgtccctacaattaaggctgagggataacttcagcccc

SEQ ID NO: 38424 - DNA, 560 bp, Homo sapiens
ctaatttaaaaaccgaagatctaacctgctttccttagtacaaataaagccaacttttagctccttttacagtattactttgccacttgagtagggctaaacaccttttggaccatattcattgttactatcaatacatagacacacattagaattaattgaaaggctggtgctatattttctactttattattaaatgataaaagtaacattcactgtagaagttttagaaaatgtagggaaattataaggataaaactaaaaataacctctacgtgggtgcagtggctcatgcctgtaatcccattactttgggaggctgaggcagatggatcgcttgagcccaggagttggagaccagcctgggcaatgtggtgaaaccctgtctctaccaaaaatacaaaaaattagcctgatgtggtggcgcatgcctgtagtcccagctactcaggaggctgaggtggaaggatggcttgagcccaagaggtcgaggctgcagtgagccaagattgcaccactggattcctgcctgggtaaccgagcaagaccttgtctcaata

SEQ ID NO: 38425 - DNA, 220 bp, Homo sapiens
agcaagtacccaaaagtgttcagtggagaagcctggaagagaccggaagcatggccgcggcctcttgtcatttagccctggggagagaaaggcatggagttgggtttagggtcacctggtatcagttgtgaaaagggtttttagtagaattgggtatttcagagtctcttgatgattgattctagccttttaaaatctttcttggtaatgacatttagct

SEQ ID NO: 38426 - DNA, 707 bp, Homo sapiens
agttttatgggggaaagagttcttggtgactgagcgagactccatctcaaaaaaaaaaaaaaaaaaaaaatgcaaattcttgggcctcacctaaaagccactgaatcagacatactggggaagggtccagcaatgtttcaacaagcccaccaagtgattctgatacaagttaaaatttaagaaccatttcattgtttgggtttgtttataaaagcagtgctaggtcaaagaatgactaggtaaaatgaggtaatgaaagacagctggggaatgggatgaagcacacctgtattcaatacccacctccgctcttgggtgatcttggatgcatcacttctcagccttgaaacttgggttccttagctccaggggtacagaaccaaatgatctctaagaccctgaccccatctgaacctctggttagtctatttttgaacttgcttctttcgttgtgttctaggactgtctcccaacacttacatctcaatacccccttccctctttgctttgtgttcctcaatacgaaagacctgtggttgctatctggatgtctcccatctccaaacatgttcccattggaaaaaaaacagtacacaatatgtgtttgctttactcacttatatattatatatgtgtgctgctatataaacatacgcaatatgtattcaaaatggaaattcaagctcagataataaaacagcgattct

SEQ ID NO: 38427 - DNA, 1001 bp, Homo sapiens
catggaaagagcattgctggggggtcaactggatggtggagacgttgctaagtgtcttactctgttctaaatctgccagaggaggtgtatggggaagctcctgggtgctaaaggatctatgagttggagaagctgccctctccatgaacctagcaggaggaagccgtattctgcaggagccaatcataataggagcctaatgtacaggaagtgagcctgtggaaaaccgccctgctggaactgaatgctggagacagcaggctctgtaggagctttgctagccagatgcactgaaactagggaaagaatcccccttcctcttccagtgttcctccaccattctgctgataaggtttaaccttgtgccagttagcaaaggagaaatatctacaaggcctagctccattatcacagaaggatggatttggaattgagaggcataactgtcacagtccctttaactacttttttccttttcctacagcctaggaagctaagaacctttaactttttcatgtgtacacagtgagaaaccacacacatataacttcttttgatgacttctctatattactgtgtatgttttcagaaattttgaaggactattaatgcatcatgtgacacaattaagaaatgagcatccacttcttaaatttataaataatcttttaaaaaatacctttggtggtgggggacctagaattaagatgtggagataattatctgacaaaaaatttggagaaaaattttaagacagatgggggcaaaagatcccatgtttagctggtccgaaagtagtgttttctcagttggctgttcacaatcagttacagatcaaacttcttgttctactatttccccccttgactagttgttaaaaaaaaaagacacccaggattaccaggtatcttagatttatatttatttccaggtttaacttactaggtcaagtctttttctaattattatttttgagacacggtctggtctgtcactctgtc

SEQ ID NO: 38428 - DNA, 632 bp, Homo sapiens
caagccatcctcttgaactcctgctctcaagcgatcctcttggcctcccaaagttttggaattacaggtgtgagccaccacacccagcctacagttctaagattctttaagacaatctcttggatatctgggtgttgctgaggctcaatgacactgattctgattcaccagactgcactgtggttgctggaaaaacttcatcaccctccaacacaacgggatgggtttggagaaaaacaagaaagacacatcctgtgtgatatgtatgtggtccccttaagcgaaggagactccctgctgcatgagttcccataggatgcttagtatccttcatctaactcagcccagatttccctgggcaccgcccccgaagctgtactattgtcccgtgctattctatggggacctattatctatttgacttccagtaggaagattccagaagcattttatagaagcattttcaaaacttatagaatatgttttacttctcatttgagaaatctgaagtaccagtggaatctggtcttttcatggacacagtgagtgtggatggtagcagagaagaagcaggaggaggcagggagaaccttcagaccatggcctaggtatgatggagagaaaagaaagga

SEQ ID NO: 38429 - DNA, 731 bp, Homo sapiens
aaggaattgtggactgaatcactagccttaggtctttcagcaaacagcctatcagggccatttatcatgtgtgagatttgcattttacttgctgactttgtgtaatagatcccattcatgtccccttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgttacatgtaatattttagttcagaacttgacctgaaggaagggaagaaaagtatgtgatttttaccttttttaacaaatgtgaaaaagtcagttttagaaatttcgtggtagtaagttcggcatttgttacatgtatagagagaagactaataatctctatttataactaaatcattgagatagaaaaagattcccattgactgtagacttcttcccattttgtcttcccttctgcctgtttccccttcaggcttggctctaggaaccaaagtgatttgttgttgttccaacctgggctttgtgactttggttagtgccactaccttcttccctcctttcccccttcaatttggaaataaatttctgtatatgttgca

SEQ ID NO: 38430 - DNA, 613 bp, Homo sapiens
aaggaattgtggactgaatcactagccttaggtctttcagcaaacagcctatcagggccatttatcatgtgtgagatttgcattttacttgctgactttgtgtaatagatcccattcatgtccccttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgttacatgtaatattttagttcagaacttgacctgaaggaagggaagaaaagtatgtgatttttaccttttttaacaaatgtgaaaaagtcagttttagaaatttcgtggtagtaagttcggcatttgttacatgtatagagagaagactaataatctctatttataactaaatcattgagatagaaaaagattcccattgactgtagacttcttcccattttgtcttcccttctgcctgtggtaagacgagatcctggag

SEQ ID NO: 38431 - DNA, 355 bp, Homo sapiens
ggggaaaaaaaaaaaaaaaaagggtcttcttttgccaagtgccacctgagttccaaattttaccattctttgtaaacagttggatggattatgataaagaagatgctaccaatgaaatagaaaaccaacgagatgagaagactgtgatcctcatgtactcagaggcacttccctcctaagtcaaagaccatcctcactgactatgtgccaacgcctcgtttcaggcttgtgactcaacaaagggcttttccattgatagaagcagtttgggatttgtagttgcgacttcttcgatagttacctgcacgtccattgctggcaactgacttgtcattaaaacctggctctttggtta

SEQ ID NO: 38432 - DNA, 4031 bp, Homo sapiens
aaggaattgtggactgaatcactagccttaggtctttcagcaaacagcctatcagggccatttatcatgtgtgagatttgcattttacttgctgactttgtgtaatagatcccattcatgtccccttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgttacatgtaatattttagttcagaacttgacctgaaggaagggaagaaaagtatgtgatttttaccttttttaacaaatgtgaaaaagtcagttttagaaatttcgtggtagtaagttcggcatttgttacatgtatagagagaagactaataatctctatttataactaaatcattgagatagaaaaagattcccattgactgtagacttcttcccattttgtcttcccttctgcctgtttccccttcaggcttggctctaggaaccaaagtgatttgttgttgttccaacctgggctttgtgactttggttagtgccactaccttcttccctcctttcccccttcaatttggaaataaatttctgtatatgttgcaattttaggtttaggtttgttctttttctttttcattaatcctctctcacctcacagataccccctcccatggcaaataatataataaccagtgaattttcaggaatttaaaaattagcttttttccacttaaaggagaaaaatatttgggactagcagcagaggcagtaagagatgtgaaccttggtgagctctgatacagtgagaagagattatactcatgaaagagaatgttagtgttacagagaagcagccgatagcaaatcgactgtagagacttggcggcggtggcattgccccaggtcgtcagcagtgtggtattatctatgagaacttgagcgacagagtatttcttgatgaatttatagatcatttgagatgttgagttactttagtttagttttgttttgttttttcaaataagtagagactattgtaaaaaacgagaaaggaaaatgaaatgtgcgtgttgatagcaataatttgtttcttttaaagattctaaaaggtctgagacctgtagcattaattatttgagtgccctcccttctcccctcccctcccttttctcttctcttttttcctctcctctccttctcctttattcattgttttgcttttggagtaggtgttgttcaagtatctgtggtttggttctggcattttgttcccaccatccccttcccccattaacttcccccctgcttgccatcctgcagtagtataaatcatgaataaaaaataattttgctgttgtagtatacattggagaaactggcaggttttatttccattattttatttccactatatctatgataagatgcaattataaggagagaagtgactgttttttattgataaggcaagattttcagaaaaatgagtaaaataattaatgaaacatatttagagcacttaatggtctctgttttcaatataattcttgatttcatttttctctggaatatattggccttctacagctattactgaattatagaaactggtttatttctggcagaaagctgcagtgccacctgagttccaaattttaccattctttgtaaacagttggatggattatgataaagaagatgctaccaatgaaatagaaaaccaacgagatgagaagactgtgatcctcatgtactcagaggcacttccctcctaagtcaaagaccatcctcactgactatgtgccaacgcctcgtttcaggcttgtgactcaacaaagggcttttccattgatagaagcagtttgggatttgtagttgcgacttcttcgatagttacctgcacgtccattgctggcaactgacttgtcattaaaacctggctctttggttaagggagctacgctgtggtttattcttaagttacgtggataaactaacctctaacagaaatatactttggttaattttgaaatgtgtcatttttaaacaatcttaaaagtaatacagaattgtgatttattaattttaaaacattcagaacttgttgaaagaaaaattatatctgaatcaagattcatgttttttatttttattttttttgatacagagtctcactctgtcactcaggctggagtgcagtgacatgatctcagctcactgcaacctccgcttcctgggttcaagcaattctcatgcctcagcctcctgagtagctgagaccacaggcacccgccaccacacccagctatttttttgtatttttagtagagacagagtctcaccacattgcccaggctggtctccaactcctgagctcaggcagtctgcccaccttggcctcccaaagtgctgcagttacaggcgtgagccactgcacctggcctcatgttttttaaataattgccttttatatttaccctttttgtcatcactttagaatgaaaattcccatttaaatctgaaagttaccttaatagtcctcttgtgttattaggacagtattattatagtacttatttattttattttagatttaaagttatcttctctttttcttttttcttctgctgcttttagggacaattaaaactgggaaactatgaaacatggaacattttatcctacctgaaagtaaacgagtaattgtgaagcataagacactgaggctaatacaactctgtcttcatgtgttgactgcctggcacatagtattcattctcttccctttaacatagaagtgtccagctgcgtacagtctagtaaccagcaactgtaaacgaacctgtgcctctaacaagcgattctaaaccacctatgagtatttcttttagggctcacttaaatacatgtttgtatatactgtattctagccagaataattttagatctgatcaggtagtagctaaaattagaaaaaaacaaaatagatgcttaaagaatttgcatccatttttgagtctaaatcttttaaaatatactgagatccacatctagtgaaatgtcagtgtcaaaatattatagattatagctaaaatccagattaatactcatttggggttttttatagtggaacttcatagtaatacaaaaagcagattgtcttcctgtctccgctgctcccacagtaggtattgaaactggtaaaatcagttttttgatagtgtgtgtatataagaaaaaatagatacacacattcttttttctcagtcaacacattgattgaacactctggcaaagatgctgtggtggatgaggttggagttcgaaagaagaagcaagcgctggcctggccttgaaagaaccgaagtctttcccattcacttctctagaaagctgccaagacagaggcagaaagaaatggatgatagttctgtcaagcacacttctgttctcttagaacttagaagtgtttctaagagaacagaagtaataagagaaacagttacgtgtggaattcaacatctttggttggaacgcattggctttttttttcttgttttgatagaaatggaattaagcaaaagtagtttttgtcttttctgttgtcttcaaattttatgccttttatttttaatttaatcccgttcaattatttaattgttatacattgacattaactgctgtattttgactttgttcaataattttgttctttcagggctagaaataaactttttaaaaaaagtgtgcatttttccctttcctaaacttttattctttcttttgatcagcgtaaaagaatattttaatgtcttttgatagcataaaagaatatttaaatgtcttaataggttttcaaagaacatttagtatttttagtgataaatgttttaaacctttta

SEQ ID NO: 38433 - DNA, 3839 bp, Homo sapiens
aaggaattgtggactgaatcactagccttaggtctttcagcaaacagcctatcagggccatttatcatgtgtgagatttgcattttacttgctgactttgtgtaatagatcccattcatgtccccttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgttacatgtaatattttagttcagaacttgacctgaaggaagggaagaaaagtatgtgatttttaccttttttaacaaatgtgaaaaagtcagttttagaaatttcgtggtagtaagttcggcatttgttacatgtatagagagaagactaataatctctatttataactaaatcattgagatagaaaaagattcccattgactgtagacttcttcccattttgtcttcccttctgcctgtttccccttcaggcttggctctaggaaccaaagtgatttgttgttgttccaacctgggctttgtgactttggttagtgccactaccttcttccctcctttcccccttcaatttggaaataaatttctgtatatgttgcaattttaggtttaggtttgttctttttctttttcattaatcctctctcacctcacagataccccctcccatggcaaataatataataaccagtgaattttcaggaatttaaaaattagcttttttccacttaaaggagaaaaatatttgggactagcagcagaggcagtaagagatgtgaaccttggtgagctctgatacagtgagaagagattatactcatgaaagagaatgttagtgttacagagaagcagccgatagcaaatcgactgtagagacttggcggcggtggcattgccccaggtcgtcagcagtgtggtattatctatgagaacttgagcgacagagtatttcttgatgaatttatagatcatttgagatgttgagttactttagtttagttttgttttgttttttcaaataagtagagactattgtaaaaaacgagaaaggaaaatgaaatgtgcgtgttgatagcaataatttgtttcttttaaagattctaaaaggtctgagacctgtagcattaattatttgagtgccctcccttctcccctcccctcccttttctcttctcttttttcctctcctctccttctcctttattcattgttttgcttttggagtaggtgttgttcaagtatctgtggtttggttctggcattttgttcccaccatccccttcccccattaacttcccccctgcttgccatcctgcagtagtataaatcatgaataaaaaataattttgctgttgtagtatacattggagaaactggcaggttttatttccattattttatttccactatatctatgataagatgcaattataaggagagaagtgactgttttttattgataaggcaagattttcagaaaaatgagtaaaataattaatgaaacatatttagagcacttaatggtctctgttttcaatataattcttgatttcatttttctctggaatatattggccttctacagctattactgaattatagaaactggtttatttctggcagaaagctgcagtgccacctgagttccaaattttaccattctttgtaaacagttggatggattatgataaagaagatgctaccaatgaaatagaaaaccaacgagatgagaagactgtgatcctcatgtactcagaggcacttccctcctaagtcaaagaccatcctcactgactatgtgccaacgcctcgtttcaggcttgtgactcaacaaagggcttttccattgatagaagcagtttgggatttgtagttgcgacttcttcgatagttacctgcacgtccattgctggcaactgacttgtcattaaaacctggctctttggttaagggagctacgctgtggtttattcttaagttacgtggataaactaacctctaacagaaatatactttggttaattttgaaatgtgtcatttttaaacaatcttaaaagtaatacagaattgtgatttattaattttaaaacattcagaacttgttgaaagaaaaattatatctgaatcaagattcatgttttttatttttattttttttgatacagagtctcactctgtcactcaggctggagtgcagtgacatgatctcagctcactgcaacctccgcttcctgggttcaagcaattctcatgcctcagcctcctgagtagctgagaccacaggcacccgccaccacacccagctatttttttgtatttttagtagagacagagtctcaccacattgcccaggctggtctccaactcctgagctcaggcagtctgcccaccttggcctcccaaagtgctgcagttacaggcgtgagccactgcacctggcctcatgttttttaaataattgccttttatatttaccctttttgtcatcactttagaatgaaaattcccatttaaatctgaaagttaccttaatagtcctcttgtgttattaggacagtattattatagtacttatttattttattttagatttaaagttatcttctctttttcttttttcttctgctgcttttagggacaattaaaactgggaaactatgaaacatggaacattttatcctacctgaaagtaaacgagtaattgtgaagcataagacactgaggctaatacaactctgtcttcatgtgttgactgcctggcacatagtattcattctcttccctttaacatagaagtgtccagctgcgtacagtctagtaaccagcaactgtaaacgaacctgtgcctctaacaagcgattctaaaccacctatgagtatttcttttagggctcacttaaatacatgtttgtatatactgtattctagccagaataattttagatctgatcaggtagtagctaaaattagaaaaaaacaaaatagatgcttaaagaatttgcatccatttttgagtctaaatcttttaaaatatactgagatccacatctagtgaaatgtcagtgtcaaaatattatagattatagctaaaatccagattaatactcatttggggttttttatagtggaacttcatagtaatacaaaaagcagattgtcttcctgtctccgctgctcccacagtaggtattgaaactggtaaaatcagttttttgatagtgtgtgtatataagaaaaaatagatacacacattcttttttctcagtcaacacattgattgaacactctggcaaagatgctgtggtggatgaggttggagttcgaaagaagaagcaagcgctggcctggccttgaaagaaccgaagtctttcccattcacttctctagaaagctgccaagacagaggcagaaagaaatggatgatagttctgtcaagcacacttctgttctcttagaacttagaagtgtttctaagagaacagaagtaataagagaaacagttacgtgtggaattcaacatctttggttggaacgcattggctttttttttcttgttttgatagaaatggaattaagcaaaagtagtttttgtcttttctgttgtcttcaaattttatgccttgaaattaaaatgaaatcccctaaaattttatagggttaaacctggttttacaggggggtatttacatatggggccaaatctatggt

SEQ ID NO: 38434 - DNA, 2306 bp, Homo sapiens
ggggaaaaaaaaaaaaaaaaagggtcttcttttgccaagtgccacctgagttccaaattttaccattctttgtaaacagttggatggattatgataaagaagatgctaccaatgaaatagaaaaccaacgagatgagaagactgtgatcctcatgtactcagaggcacttccctcctaagtcaaagaccatcctcactgactatgtgccaacgcctcgtttcaggcttgtgactcaacaaagggcttttccattgatagaagcagtttgggatttgtagttgcgacttcttcgatagttacctgcacgtccattgctggcaactgacttgtcattaaaacctggctctttggttaagggagctacgctgtggtttattcttaagttacgtggataaactaacctctaacagaaatatactttggttaattttgaaatgtgtcatttttaaacaatcttaaaagtaatacagaattgtgatttattaattttaaaacattcagaacttgttgaaagaaaaattatatctgaatcaagattcatgttttttatttttattttttttgatacagagtctcactctgtcactcaggctggagtgcagtgacatgatctcagctcactgcaacctccgcttcctgggttcaagcaattctcatgcctcagcctcctgagtagctgagaccacaggcacccgccaccacacccagctatttttttgtatttttagtagagacagagtctcaccacattgcccaggctggtctccaactcctgagctcaggcagtctgcccaccttggcctcccaaagtgctgcagttacaggcgtgagccactgcacctggcctcatgttttttaaataattgccttttatatttaccctttttgtcatcactttagaatgaaaattcccatttaaatctgaaagttaccttaatagtcctcttgtgttattaggacagtattattatagtacttatttattttattttagatttaaagttatcttctctttttcttttttcttctgctgcttttagggacaattaaaactgggaaactatgaaacatggaacattttatcctacctgaaagtaaacgagtaattgtgaagcataagacactgaggctaatacaactctgtcttcatgtgttgactgcctggcacatagtattcattctcttccctttaacatagaagtgtccagctgcgtacagtctagtaaccagcaactgtaaacgaacctgtgcctctaacaagcgattctaaaccacctatgagtatttcttttagggctcacttaaatacatgtttgtatatactgtattctagccagaataattttagatctgatcaggtagtagctaaaattagaaaaaaacaaaatagatgcttaaagaatttgcatccatttttgagtctaaatcttttaaaatatactgagatccacatctagtgaaatgtcagtgtcaaaatattatagattatagctaaaatccagattaatactcatttggggttttttatagtggaacttcatagtaatacaaaaagcagattgtcttcctgtctccgctgctcccacagtaggtattgaaactggtaaaatcagttttttgatagtgtgtgtatataagaaaaaatagatacacacattcttttttctcagtcaacacattgattgaacactctggcaaagatgctgtggtggatgaggttggagttcgaaagaagaagcaagcgctggcctggccttgaaagaaccgaagtctttcccattcacttctctagaaagctgccaagacagaggcagaaagaaatggatgatagttctgtcaagcacacttctgttctcttagaacttagaagtgtttctaagagaacagaagtaataagagaaacagttacgtgtggaattcaacatctttggttggaacgcattggctttttttttcttgttttgatagaaatggaattaagcaaaagtagtttttgtcttttctgttgtcttcaaattttatgccttttatttttaatttaatcccgttcaattatttaattgttatacattgacattaactgctgtattttgactttgttcaataattttgttctttcagggctagaaataaactttttaaaaaaagtgtgcatttttccctttcctaaacttttattctttcttttgatcagcgtaaaagaatattttaatgtcttttgatagcataaaagaatatttaaatgtcttaataggttttcaaagaacatttagtatttttagtgataaatgttttaaacctttta

SEQ ID NO: 38435 - DNA, 2402 bp, Homo sapiens
cgttaacatcactgctgtggcctcatactcttttttccattttctacaagaagccttttagtatatgaaaattattactctttttggggtttaaagaaatggtctgcataacctgaatgaaagaagcaaatgactattctctgaagacaaccaagagaaaattgcaaaaagacaattggatggattatgataaagaagatgctaccaatgaaatagaaaaccaacgagatgagaagactgtgatcctcatgtactcagaggcacttccctcctaagtcaaagaccatcctcactgactatgtgccaacgcctcgtttcaggcttgtgactcaacaaagggcttttccattgatagaagcagtttgggatttgtagttgcgacttcttcgatagttacctgcacgtccattgctggcaactgacttgtcattaaaacctggctctttggttaagggagctacgctgtggtttattcttaagttacgtggataaactaacctctaacagaaatatactttggttaattttgaaatgtgtcatttttaaacaatcttaaaagtaatacagaattgtgatttattaattttaaaacattcagaacttgttgaaagaaaaattatatctgaatcaagattcatgttttttatttttattttttttgatacagagtctcactctgtcactcaggctggagtgcagtgacatgatctcagctcactgcaacctccgcttcctgggttcaagcaattctcatgcctcagcctcctgagtagctgagaccacaggcacccgccaccacacccagctatttttttgtatttttagtagagacagagtctcaccacattgcccaggctggtctccaactcctgagctcaggcagtctgcccaccttggcctcccaaagtgctgcagttacaggcgtgagccactgcacctggcctcatgttttttaaataattgccttttatatttaccctttttgtcatcactttagaatgaaaattcccatttaaatctgaaagttaccttaatagtcctcttgtgttattaggacagtattattatagtacttatttattttattttagatttaaagttatcttctctttttcttttttcttctgctgcttttagggacaattaaaactgggaaactatgaaacatggaacattttatcctacctgaaagtaaacgagtaattgtgaagcataagacactgaggctaatacaactctgtcttcatgtgttgactgcctggcacatagtattcattctcttccctttaacatagaagtgtccagctgcgtacagtctagtaaccagcaactgtaaacgaacctgtgcctctaacaagcgattctaaaccacctatgagtatttcttttagggctcacttaaatacatgtttgtatatactgtattctagccagaataattttagatctgatcaggtagtagctaaaattagaaaaaaacaaaatagatgcttaaagaatttgcatccatttttgagtctaaatcttttaaaatatactgagatccacatctagtgaaatgtcagtgtcaaaatattatagattatagctaaaatccagattaatactcatttggggttttttatagtggaacttcatagtaatacaaaaagcagattgtcttcctgtctccgctgctcccacagtaggtattgaaactggtaaaatcagttttttgatagtgtgtgtatataagaaaaaatagatacacacattcttttttctcagtcaacacattgattgaacactctggcaaagatgctgtggtggatgaggttggagttcgaaagaagaagcaagcgctggcctggccttgaaagaaccgaagtctttcccattcacttctctagaaagctgccaagacagaggcagaaagaaatggatgatagttctgtcaagcacacttctgttctcttagaacttagaagtgtttctaagagaacagaagtaataagagaaacagttacgtgtggaattcaacatctttggttggaacgcattggctttttttttcttgttttgatagaaatggaattaagcaaaagtagtttttgtcttttctgttgtcttcaaattttatgccttttatttttaatttaatcccgttcaattatttaattgttatacattgacattaactgctgtattttgactttgttcaataattttgttctttcagggctagaaataaactttttaaaaaaagtgtgcatttttccctttcctaaacttttattctttcttttgatcagcgtaaaagaatattttaatgtcttttgatagcataaaagaatatttaaatgtcttaataggttttcaaagaacatttagtatttttagtgataaatgttttaaacctttta

SEQ ID NO: 38436 - DNA, 2605 bp, Homo sapiens
aaggaattgtggactgaatcactagccttaggtctttcagcaaacagcctatcagggccatttatcatgtgtgagatttgcattttacttgctgactttgtgtaatagatcccattcatgtccccttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgttacatgtaatattttagttcagaacttgacctgaaggaagggaagaaaagtatgtgatttttaccttttttaacaaatgtgaaaaagtcagttttagaaatttcgtggtagtaagttcggcatttgttacatgtatagagagaagactaataatctctatttataactaaatcattgagatagaaaaagattcccattgactgtagacttcttcccattttgtcttcccttctgcctgtttccccttcaggcttggctctaggaaccaaagtgatttgttgttgttccaacctgggctttgtgactttggttagtgccactaccttcttccctcctttcccccttcaatttggaaataaatttctgtatatgttgcaattttaggtttaggtttgttctttttctttttcattaatcctctctcacctcacagataccccctcccatggcaaataatataataaccagtgaattttcaggaatttaaaaattagcttttttccacttaaaggagaaaaatatttgggactagcagcagaggcagtaagagatgtgaaccttggtgagctctgatacagtgagaagagattatactcatgaaagagaatgttagtgttacagagaagcagccgatagcaaatcgactgtagagacttggcggcggtggcattgccccaggtcgtcagcagtgtggtattatctatgagaacttgagcgacagagtatttcttgatgaatttatagatcatttgagatgttgagttactttagtttagttttgttttgttttttcaaataagtagagactattgtaaaaaacgagaaaggaaaatgaaatgtgcgtgttgatagcaataatttgtttcttttaaagattctaaaaggtctgagacctgtagcattaattatttgagtgccctcccttctcccctcccctcccttttctcttctcttttttcctctcctctccttctcctttattcattgttttgcttttggagtaggtgttgttcaagtatctgtggtttggttctggcattttgttcccaccatccccttcccccattaacttcccccctgcttgccatcctgcagtagtataaatcatgaataaaaaataattttgctgttgtagtatacattggagaaactggcaggttttatttccattattttatttccactatatctatgataagatgcaattataaggagagaagtgactgttttttattgataaggcaagattttcagaaaaatgagtaaaataattaatgaaacatatttagagcacttaatggtctctgttttcaatataattcttgatttcatttttctctggaatatattggccttctacagctattactgaattatagaaactggtttatttctggcagaaagctgcagtgccacctgagttccaaattttaccattctttgtaaacagttggatggattatgataaagaagatgctaccaatgaaatagaaaaccaacgagatgagaagactgtgatcctcatgtactcagaggcacttccctcctaagtcaaagaccatcctcactgactatgtgccaacgcctcgtttcaggcttgtgactcaacaaagggcttttccattgatagaagcagtttgggatttgtagttgcgacttcttcgatagttacctgcacgtccattgctggcaactgacttgtcattaaaacctggctctttggttaagggagctacgctgtggtttattcttaagttacgtggataaactaacctctaacagaaatatactttggttaattttgaaatgtgtcatttttaaacaatcttaaaagtaatacagaattgtgatttattaattttaaaacattcagaacttgttgaaagaaaaattatatctgaatcaagattcatgttttttatttttattttttttgatacagagtctcactctgtcactcaggctgagattgaaccgtggcactccagcctggtgtgacagagcgagactttatctcaataaaaaacaaaaagaccaaaaacagtaaatcaccgtgataggcaaaaggcattcctttattatttttggcatcttttaaactattgtggactctgggtccaatttgaaagtgattaagctaaacatatttgacctttgaactagtcccatttaagaccattacggaactggttcctctttgatctccccatgtctgaatggctaataatacacattgagagggcaccaacgg

SEQ ID NO: 38437 - DNA, 2080 bp, Homo sapiens
aaggaattgtggactgaatcactagccttaggtctttcagcaaacagcctatcagggccatttatcatgtgtgagatttgcattttacttgctgactttgtgtaatagatcccattcatgtccccttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgttacatgtaatattttagttcagaacttgacctgaaggaagggaagaaaagtatgtgatttttaccttttttaacaaatgtgaaaaagtcagttttagaaatttcgtggtagtaagttcggcatttgttacatgtatagagagaagactaataatctctatttataactaaatcattgagatagaaaaagattcccattgactgtagacttcttcccattttgtcttcccttctgcctgtttccccttcaggcttggctctaggaaccaaagtgatttgttgttgttccaacctgggctttgtgactttggttagtgccactaccttcttccctcctttcccccttcaatttggaaataaatttctgtatatgttgcaattttaggtttaggtttgttctttttctttttcattaatcctctctcacctcacagataccccctcccatggcaaataatataataaccagtgaattttcaggaatttaaaaattagcttttttccacttaaaggagaaaaatatttgggactagcagcagaggcagtaagagatgtgaaccttggtgagctctgatacagtgagaagagattatactcatgaaagagaatgttagtgttacagagaagcagccgatagcaaatcgactgtagagacttggcggcggtggcattgccccaggtcgtcagcagtgtggtattatctatgagaacttgagcgacagagtatttcttgatgaatttatagatcatttgagatgttgagttactttagtttagttttgttttgttttttcaaataagtagagactattgtaaaaaacgagaaaggaaaatgaaatgtgcgtgttgatagcaataatttgtttcttttaaagattctaaaaggtctgagacctgtagcattaattatttgagtgccctcccttctcccctcccctcccttttctcttctcttttttcctctcctctccttctcctttattcattgttttgcttttggagtaggtgttgttcaagtatctgtggtttggttctggcattttgttcccaccatccccttcccccattaacttcccccctgcttgccatcctgcagtagtataaatcatgaataaaaaataattttgctgttgtagtatacattggagaaactggcaggttttatttccattattttatttccactatatctatgataagatgcaattataaggagagaagtgactgttttttattgataaggcaagattttcagaaaaatgagtaaaataattaatgaaacatatttagagcacttaatggtctctgttttcaatataattcttgatttcatttttctctggaatatattggccttctacagctattactgaattatagaaactggtttatttctggcagaaagctgcagtgccacctgagttccaaattttaccattctttgtaaacagttggatggattatgataaagaagatgctaccaatgaaatagaaaaccaacgagatgagaagactgtgatcctcatgtactcagaggcacttccctcctaagtcaaagaccatcctcactgactatgtgccaacgcctcgtttcaggcttgtgactcaacaaagggcttttccattgatagaagcagtttgggatttgtagttgcgacttcttcgatagttacctgcacgtccattgctggcaactgacttgtcattaaaacctggctctttggtta

SEQ ID NO: 38438 - DNA, 1163 bp, Homo sapiens
  misc_feature (65)..(65): n is a, c, g, or t
tgtgaagcataagaactgagtatcgtcttgtgctggcacatagtattcattctcttcccttatanactgcgtacagtctagtaaccagcaactgtaaacgaacctgtgcctctaacaagcgattctaaaccacctatgagtatttcttttagggctcacttaaatacatgtttgtatatactgtattctagccagaataattttagatctgatcaggtagtagctaaaattagaaaaaaacaaaatagatgcttaaagaatttgcatccatttttgagtctaaatcttttaaaatatactgagatccacatctagtgaaatgtcagtgtcaaaatattatagattatagctaaaatccagattaatactcatttggggttttttatagtggaacttcatagtaatacaaaaagcagattgtcttcctgtctccgctgctcccacagtaggtattgaaactggtaaaatcagttttttgatagtgtgtgtatataagaaaaaatagatacacacattcttttttctcagtcaacacattgattgaacactctggcaaagatgctgtggtggatgaggttggagttcgaaagaagaagcaagcgctggcctggccttgaaagaaccgaagtctttcccattcacttctctagaaagctgccaagacagaggcagaaagaaatggatgatagttctgtcaagcacacttctgttctcttagaacttagaagtgtttctaagagaacagaagtaataagagaaacagttacgtgtggaattcaacatctttggttggaacgcattggctttttttttcttgttttgatagaaatggaattaagcaaaagtagtttttgtcttttctgttgtcttcaaattttatgccttttatttttaatttaatcccgttcaattatttaattgttatacattgacattaactgctgtattttgactttgttcaataattttgttctttcagggctagaaataaactttttaaaaaaagtgtgcatttttccctttcctaaacttttattctttcttttgatcagcgtaaaagaatattttaatgtcttttgatagcataaaagaatatttaaatgtcttaataggttttcaaagaacatttagtatttttagtgataaatgttttaaacctttta

SEQ ID NO: 38439 - DNA, 1406 bp, Homo sapiens
aaggaattgtggactgaatcactagccttaggtctttcagcaaacagcctatcagggccatttatcatgtgtgagatttgcattttacttgctgactttgtgtaatagatcccattcatgtccccttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgttacatgtaatattttagttcagaacttgacctgaaggaagggaagaaaagtatgtgatttttaccttttttaacaaatgtgaaaaagtcagttttagaaatttcgtggtagtaagttcggcatttgttacatgtatagagagaagactaataatctctatttataactaaatcattgagatagaaaaagattcccattgactgtagacttcttcccattttgtcttcccttctgcctgtttccccttcaggcttggctctaggaaccaaagtgatttgttgttgttccaacctgggctttgtgactttggttagtgccactaccttcttccctcctttcccccttcaatttggaaataaatttctgtatatgttgcaattttaggtttaggtttgttctttttctttttcattaatcctctctcacctcacagataccccctcccatggcaaataatataataaccagtgaattttcaggaatttaaaaattagcttttttccacttaaaggagaaaaatatttgggactagcagcagaggcagtaagagatgtgaaccttggtgagctctgatacagtgagaagagattatactcatgaaagagaatgttagtgttacagagaagcagccgatagcaaatcgactgtagagacttggcggcggtggcattgccccaggtcgtcagcagtgtggtattatctatgagaacttgagcgacagagtatttcttgatgaatttatagatcatttgagatgttgagttactttagtttagttttgttttgttttttcaaataagtagagactattgtaaaaaacgagaaaggaaaatgaaatgtgcgtgttgatagcaataatttgtttcttttaaagattctaaaaggtctgagacctgtcgctcaagttctcatagataataccacactgctgacgacctggggcaatgccaccgccgccaagtctctacagtcgatttgctatcggctgcttctctgtaacactaacattctctttcttgagtataatctcttctcactgtatcaggtcgagc

SEQ ID NO: 38440 - DNA, 1175 bp, Homo sapiens
aaggaattgtggactgaatcactagccttaggtctttcagcaaacagcctatcagggccatttatcatgtgtgagatttgcattttacttgctgactttgtgtaatagatcccattcatgtccccttggggtatttccaatacttgaatggcagattggagtttttcagagtatgtgtttcatctgctagtctttctctccttcatagcttttcttttcctggacttgctccttttgagttgcttttgcgtttctcatgcctaggcaagtgtaatagaaattatgtagctccttatgttggcaaaggagctctatatagtttcactttgtataaaagttaggaccagctgttgttacatgtaatattttagttcagaacttgacctgaaggaagggaagaaaagtatgtgatttttaccttttttaacaaatgtgaaaaagtcagttttagaaatttcgtggtagtaagttcggcatttgttacatgtatagagagaagactaataatctctatttataactaaatcattgagatagaaaaagattcccattgactgtagacttcttcccattttgtcttcccttctgcctgtttccccttcaggcttggctctaggaaccaaagtgatttgttgttgttccaacctgggctttgtgactttggttagtgccactaccttcttccctcctttcccccttcaatttggaaataaatttctgtatatgttgcaattttaggtttaggtttgttctttttctttttcattaatcctctctcacctcacagataccccctcccatggcaaataatataataaccagtgaattttcaggaatttaaaaattagcttttttccacttaaaggagaaaaatatttgggactagcagcagaggcagtaagagatgtgaaccttggtgagctctgatacagtgagaagagattatactcatgaaagagaatgttagtgttacagagaagcagccgatagcaaatcgactgtagagacttggcggcggtggcattgccccaggtcgtcagcagtgtggtattatctatgagaacttgagcgacaggtctcagaccttttagaatctttaaaagaaacaaattattgctatcaacacgcacatttgattttcctttctcgctttttacaatagtctctacttattt

SEQ ID NO: 38441 - DNA, 1037 bp, Homo sapiens
gataccctatttatttatttatttatttttaaagaaaaaaaatagccaggcatggtggctcttgcctgtcacccttgctacttgggaggctgaggtgggaggatcgcttgagctcaggagttggaggttgcagtgagttatgatcacaccactgcgctacagcctaggagacagagtaagactctgtctctgaaaaaaataaacaaacaaaaaagggcatatttcacactgttagatttgtcattgcagtggctgcacatgtacgcgcgcgtgtgtgtgtgtgtaattgacactagaaaggttccctttgcagtatgcaggaggcctagaatagaaaaaagaaatatagaacagcttggtcttctcagcctgctccccttttttggattttatacaaggaggtgcctgcagaatgcagcagtggttccagtttattttatgttaaggctcacacacaaatttctgttttttttttttttgtcaaaaaatttttttgtctctggatctctttacactcttaaaaatgattgaggctggacactgtggctcacacctgtaatcccagcactttgggaggctgagacaggtggatcacttgaggtcaggagtttgagaccagcctgaccaacttggagaaaccccgtctctactaaaaatgaaaaattagctgggcatggtggcgcatgcctgtaatcccagctacttgggaggctgaggcaggagaatcacttgaacccaggaggcagagattgcggtgagccgagatcgtaccattgcattctagcctgggcaacaagcgaaactctgtctcaaaaaaaaaaaaaaagattgagaatatcacagagatttggtttatatggattatatctatcaatatttactgtattagaaattaaaactggctggatgtggtggctcatgcctgtagtcccaacactttgggaggtcaaggtaggaggatcacttgagcccaggatcttgctatgttgaccaatctgggcaacatagcaacatcccatctctacaaaaaaaaaaaa

SEQ ID NO: 38442 - DNA, 414 bp, Homo sapiens
tttttctgtttgtttttctgcacttagaatatgaattatcctagataactctgggaaagttagatttgaaaagcaatctctttcacaaaaatccatggagaatcacttgaacccaggaggcagagattgcggtgagccgagatcgtaccattgcattctagcctgggcaacaagcgaaactctgtctcaaaaaaaaaaaaaaagattgagaatatcacagagatttggtttatatggattatatctatcaatatttactgtattagaaattaaaactggctggatgtggtggctcatgcctgtagtcccaacactttgggaggtcaaggtaggaggatcacttgagcccaggatcttgctatgttgaccaatctgggcaacatagcaacatcccatctctacaaaaaaaaaaaa

SEQ ID NO: 38443 - DNA, 433 bp, Homo sapiens
cacctccaaaaattttatgtgggttttacacattaagcaagcataggtgaggtgcagtgaaggggaagtgatggctgtcagtcgtttggccaggttcctttgcatacaggggagctagtgggtgtataccagctgagacagctgaaggaggagaacatgaagaatagttggaaactattgaacctccaagatttttctgtctttgttaacaactagcagttacatgctagcattatttatttatttagttagttagttagttagttcttgagatggagtctcactctgtcacccacgctggagtgcagtggcatgatctcagctcactacaacctctgcctcctgggttcaggtgattttcctgcttcagcctcctgagtagctgggattacaggggcccgctaccacgcccagctaatttttgtattttgag

SEQ ID NO: 38444 - DNA, 5786 bp, Homo sapiens
  misc_feature (25)..(25): n is a, c, g, or t
  misc_feature (33)..(33): n is a, c, g, or t
  misc_feature (44)..(44): n is a, c, g, or t
  misc_feature (72)..(72): n is a, c, g, or t
  misc_feature (75)..(75): n is a, c, g, or t
  misc_feature (90)..(90): n is a, c, g, or t
  misc_feature (2000)..(2000): n is a, c, g, or t
  misc_feature (2072)..(2072): n is a, c, g, or t
aatggcctgtgagtcagaggggcantggagtcngcggcgcgganccggggcggccccggggagggaccgtcncanggaggggcgcggcancggctggggggctgcgggcgccagggcccgctagtgttgcacacgaagctgaacagcgaagagcctagcagagcagggctcagcctgagccaccctttgtctgggttgggggcccgtggcagggaggaccggggaaccaaggggagggaccgggacgggacgggacggaagggcccggagcagcggccacctccgcggagccaatttgggagcggggtgagtgtgctagagggaaagagcaaatctccgaagctccagtatagtatggggcctgtcccaggctgtggggaggagaggagtgagaagggacctgggaggctgggcagggggtaagggatcgtccagaagaaggagtccaggagtcaggtgagtctgcctggcttagtttagagagtctgctaaggtctgctctctcccctctgaagatagagggctctaggctgggggccgaggggttggtaagagagaagaagtcgaccttcctacccacagtggtggtccgtgggaacagcccccctagcttgtgtggatgtatgtagggacaaaatagagagcagctggcagcagttctctttgcataggatgagggtggaaagcacatggataggaattcatcctgtcactctccttgatcatggtagaaatggaaatctttaatactgaagggaaggggagaatgagccttgaagctgatacctataccaatacccacctcacccacctcccaggcctcaaaagtgtctaaaggtacagacgtattctgggacttgttgtttttgctggccttgctccctcagcatgttgggagctgtagtccttgccagccacagcctggcacagctgtttgatgccagctgctgcccaccccctgaacgaagagtgaggcttggcctactctgccctgcccccctcccctgcagtcctgccccatgagtcagcttgaagccatggtctagagccagactggctgggtggcaggggagtgaatatagagcgtcttgttgacagggtgggaactgagagggctctggggttaataagcagatgccaggtatgctggggtcaagtagggcatcatgtcatcccctggcttccccagggcaaggggtcaagagggcaactgggatgacctggaagtggtggtgctagggaaaaggcccctcctgaatctgtatggcttgggtggaggaaagaagggtagaaattagtgcaggttgtaccttctgacaaggttggttgcaggtaggatagtgcaggttgcgattggtgttctgccctttccagccatcccgcccaccacagggaaccaggattttcttagggatcccaattcttaggagaatttggtgaaatgggatagtggggtacaatgatgggaacttggtgtaggagagcttttcagtccctgggtacaaatctctcctttctgcctgctccccacccccacctctgttcctgattttcccttgtacaattaatctctctgcttctctcatctgggaaatttttctctccactctcaggactgctgctcagatgtctgggacttgcattctactttttttgagccctgctgtgtgcttacccctgtacttggggttggatggaggggtgggacacagatctgtcctcaggaactctatggtcggtctagaagatgccttacccacaggagtgagcagaactgttagtgagcttacaggaagtagtaacactgccataggtgaggtctcagagaagggagagatgcttatggtctggggtggacagagcagactttctggaggagatggcatttgacctatccaaggaggaaaagtcttgggtaggcattcaaagggcacttcttgaaggggaaagagcaccgtgaatgtcagacagcaaaagagaaggctgaccctgggggcagntggctttcaacttgacattcccctcaccctagtatgggctggaatagttagtgaagaccatcttatgcaccngtggtttggggttttggtgttgggtgtgtgagcactgggggaggggcgtggagaggtactccctagttgcttccagctgactgactgctgcggccttatctctagtttgcagggccttgcgggagggccctggaaagtgccttctggcagtgaccccttccccttccccttcttgtttttggtcggatttgttgcctcttgttaaagagacaggctgctggaggcaatttggagttcagggctgaaaggccagctctgagctgacttgaaatttgtacctctgaggaccgctgatggggtataactgtgtgggagacctctgcccttagtgccctaggatggcacttgtccctttggagatagacatataagaaggagttgtgcaatttggtggctttgagtaagaaagctgaattcttcccctggccgcctctcagctgacacggtctcttggatcttgggggtctctcatcccttcctccatgtagggcaggagtcctcaaatggtggccctgacaagtagttattctacctcaactcacttgtcacatccttattatactgagccaagacctgcctctttgactccttaggtagcccaactctgccatctgtgccctggaccccaagcctaccctttctgttcctgaagagcctctcacatgggagaaggatgtcctggagtgtactattagcctataattggtgacaggccttaccgctggctccagtgatcctggcttacgtctgttcttctctcctcagggtcctgctgagctcaggagctgcacggaatggtggcagtcaccttgccagtgcagcaggcatggatcagactgcaagctaggggcacgaggcatcagttgggaagaggggacgcacagctaggcttgaggcctcttcatcgggatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggtatccatcttttcccctccggctggtacctctgagcctcatagggccctgaaacgacaagccccatccactgagggtccccgggagctgaagagaggccctgggctgggggccagagagggactaccccctgaagaaccatctactgtggggctcttaggcccagagggaccggggctgggactaggtgtggccagccagcatttctcccaccgtggcctctgtgttgtggaacagagaagtagtgtcacctcatcttggacttcaggggcctggagtcccccctgccccccatcaaatgcttcctgcaatactttgcacaccagagactgggcctccccagatccagggggacaggggtccctgggggagtccccagggccagcccctccaggccagctgcacacacttgacactgatttgcacagtcttgcacaaatagggggtaagagcccagtggctggggtgggcaatgggggtagcctctggcctagggagtcccctggcactgccaatgggcacagtcccgagcacacaccccctggccctggacccccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctctgctacttgctgcacctcaggttccggagctcccgctcaggccgcttaagcctgcatggagatatccgcctgcttttttcccgccggagcctggagctggacacagggctcccctacgaactgcaggctgtgaccgaggcccctcataatccacgttattcacctttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccatgtgcctgtcccctcccttgggtttcccaggccagcttaggtagtagggaggaactggagctaccctgagattttctcaagttcccaggcaagttatgccagcgttgcctccctgtcctgggcaggggccacttgttattttatttatttttaatttataatttattcaaattggattgccttggtaacctcccacacctgataattggcatcactcctccccgcttcccactctcagatattgctccaacctcaggagttgaagaggcttatgcggtgggggcaggaggagaactgctttccctcagctgagggaagaggggctattccagagggactgagtcagtagccaaagactcagcttcccctgtccttccccagtcccttcacttcccctaccctctgacctatctctgaaagccaagttatgcgtatgtgtgtgtgcacaagcttgtctttgtgtggtatgtgtgtgtgagtgtgcatgtatgcacacacacaggggttaaccacccctcacctagggctccagactccagttgtccctctcctcctacctgtgtctccttgttttggggtcctgactgaagaaggtgtccagggggcagagtcagggccaagcactggggtgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataaattcttgtttggaaacttgaactaagctctaaat

SEQ ID NO: 38445 - DNA, 3057 bp, Homo sapiens
cagactgaaggggcgaggtttgcaggcggaggctacagctagggctgctcagtaactgccccaaccactaccacgtccccaagtgcaacgggacccacggaactacagggtcctgctgagctcaggagctgcacggaatggtggcagtcaccttgccagtgcagcaggcatggatcagactgcaagctaggggcacgaggcatcagttgggaagaggggacgcacagctaggcttgaggcctcttcatcgggatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggtatccatcttttcccctccggctggtacctctgagcctcatagggccctgaaacgacaagccccatccactgagggtccccgggagctgaagagaggccctgggctgggggccagagagggactaccccctgaagaaccatctactgtggggctcttaggcccagagggaccggggctgggactaggtgtggccagccagcatttctcccaccgtggcctctgtgttgtggaacagagaagtagtgtcacctcatcttggacttcaggggcctggagtcccccctgccccccatcaaatgcttcctgcaatactttgcacaccagagactgggcctccccagatccagggggacaggggtccctgggggagtccccagggccagcccctccaggccagctgcacacacttgacactgatttgcacagtcttgcacaaatagggggtaagagcccagtggctggggtgggcaatgggggtagcctctggcctagggagtcccctggcactgccaatgggcacagtcccgagcacacaccccctggccctggacccccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctctgctacttgctgcacctcaggttccggagctcccgctcaggccgcttaagcctgcatggagatatccgcctgcttttttcccgccggagcctggagctggacacagggctcccctacgaactgcaggctgtgaccgaggcccctcataatccacgttattcacctttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccatgtgcctgtcccctcccttgggtttcccaggccagcttaggtagtagggaggaactggagctaccctgagattttctcaagttcccaggcaagttatgccagcgttgcctccctgtcctgggcaggggccacttgttattttatttatttttaatttataatttattcaaattggattgccttggtaacctcccacacctgataattggcatcactcctccccgcttcccactctcagatattgctccaacctcaggagttgaagaggcttatgcggtgggggcaggaggagaactgctttccctcagctgagggaagaggggctattccagagggactgagtcagtagccaaagactcagcttcccctgtccttccccagtcccttcacttcccctaccctctgacctatctctgaaagccaagttatgcgtatgtgtgtgtgcacaagcttgtctttgtgtggtatgtgtgtgtgagtgtgcatgtatgcacacacacaggggttaaccacccctcacctagggctccagactccagttgtccctctcctcctacctgtgtctccttgttttggggtcctgactgaagaaggtgtccagggggcagagtcagggccaagcactggggtgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataaattcttgtttggaaacttgaactaagctctaaat

SEQ ID NO: 38446 - DNA, 367 bp, Homo sapiens
tccttgaggacaagggaccctttttacccagagcaggctgcataaaatggattttaagcaatatttactgggtggaaccgaattaaattagtaggatgtgcagacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataaattcttgtttggaaacttgaactaagctctaaat

SEQ ID NO: 38447 - DNA, 3255 bp, Homo sapiens
  misc_feature (25)..(25): n is a, c, g, or t
  misc_feature (33)..(33): n is a, c, g, or t
  misc_feature (44)..(44): n is a, c, g, or t
  misc_feature (72)..(72): n is a, c, g, or t
  misc_feature (75)..(75): n is a, c, g, or t
  misc_feature (90)..(90): n is a, c, g, or t
aatggcctgtgagtcagaggggcantggagtcngcggcgcgganccggggcggccccggggagggaccgtcncanggaggggcgcggcancggctggggggctgcgggcgccagggcccgctagtgttgcacacgaagctgaacagcgaagagcctagcagagcagggctcagcctgagccaccctttgtctgggttgggggcccgtggcagggaggaccggggaaccaaggggagggaccgggacgggacgggacggaagggcccggagcagcggccacctccgcggagccaatttgggagcgggggtcctgctgagctcaggagctgcacggaatggtggcagtcaccttgccagtgcagcaggcatggatcagactgcaagctaggggcacgaggcatcagttgggaagaggggacgcacagctaggcttgaggcctcttcatcgggatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggtatccatcttttcccctccggctggtacctctgagcctcatagggccctgaaacgacaagccccatccactgagggtccccgggagctgaagagaggccctgggctgggggccagagagggactaccccctgaagaaccatctactgtggggctcttaggcccagagggaccggggctgggactaggtgtggccagccagcatttctcccaccgtggcctctgtgttgtggaacagagaagtagtgtcacctcatcttggacttcaggggcctggagtcccccctgccccccatcaaatgcttcctgcaatactttgcacaccagagactgggcctccccagatccagggggacaggggtccctgggggagtccccagggccagcccctccaggccagctgcacacacttgacactgatttgcacagtcttgcacaaatagggggtaagagcccagtggctggggtgggcaatgggggtagcctctggcctagggagtcccctggcactgccaatgggcacagtcccgagcacacaccccctggccctggacccccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctctgctacttgctgcacctcaggttccggagctcccgctcaggccgcttaagcctgcatggagatatccgcctgcttttttcccgccggagcctggagctggacacagggctcccctacgaactgcaggctgtgaccgaggcccctcataatccacgttattcacctttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccatgtgcctgtcccctcccttgggtttcccaggccagcttaggtagtagggaggaactggagctaccctgagattttctcaagttcccaggcaagttatgccagcgttgcctccctgtcctgggcaggggccacttgttattttatttatttttaatttataatttattcaaattggattgccttggtaacctcccacacctgataattggcatcactcctccccgcttcccactctcagatattgctccaacctcaggagttgaagaggcttatgcggtgggggcaggaggagaactgctttccctcagctgagggaagaggggctattccagagggactgagtcagtagccaaagactcagcttcccctgtccttccccagtcccttcacttcccctaccctctgacctatctctgaaagccaagttatgcgtatgtgtgtgtgcacaagcttgtctttgtgtggtatgtgtgtgtgagtgtgcatgtatgcacacacacaggggttaaccacccctcacctagggctccagactccagttgtccctctcctcctacctgtgtctccttgttttggggtcctgactgaagaaggtgtccagggggcagagtcagggccaagcactggggtgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataaattcttgtttggaaacttgaactaagctctaaat

SEQ ID NO: 38448 - DNA, 2303 bp, Homo sapiens
cagactgaaggggcgaggtttgcaggcggaggctacagctagggctgctcagtaactgccccaaccactaccacgtccccaagtgcaacgggacccacggaactacaggtgtggggcagggtgagcgtggaagaagggacgcggatgggggtgcgctttgcagacgatctggagactgctgtgtgttgagggaagatacgaagtcgcgggagcagttggggactcaatgtgtgggcaacaagggtcctgctgagctcaggagctgcacggaatggtggcagtcaccttgccagtgcagcaggcatggatcagactgcaagctaggggcacgaggcatcagttgggaagaggggacgcacagctaggcttgaggcctcttcatcgggatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggtatccatcttttcccctccggctggtacctctgagcctcatagggccctgaaacgacaagccccatccactgagggtccccgggagctgaagagaggccctgggctgggggccagagagggactaccccctgaagaaccatctactgtggggctcttaggcccagagggaccggggctgggactaggtgtggccagccagcatttctcccaccgtggcctctgtgttgtggaacagagaagtagtgtcacctcatcttggacttcaggggcctggagtcccccctgccccccatcaaatgcttcctgcaatactttgcacaccagagactgggcctccccagatccagggggacaggggtccctgggggagtccccagggccagcccctccaggccagctgcacacacttgacactgatttgcacagtcttgcacaaatagggggtaagagcccagtggctggggtgggcaatgggggtagcctctggcctagggagtcccctggcactgccaatgggcacagtcccgagcacacaccccctggccctggacccccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgccctgtccttccccagtcccttcacttcccctaccctctgacctatctctgaaagccaagttatgcgtatgtgtgtgtgcacaagcttgtctttgtgtggtatgtgtgtgtgagtgtgcatgtatgcacacacacaggggttaaccacccctcacctagggctccagactccagttgtccctctcctcctacctgtgtctccttgttttggggtcctgactgaagaaggtgtccagggggcagagtcagggccaagcactggggtgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataaattcttgtttggaaacttgaactaagctctaaat

SEQ ID NO: 38449 - DNA, 2675 bp, Homo sapiens
agaagattagcaggcggtcaccgttttatttcagtcacagggcgtggattaaggttacttatacgtggccgttggctctgacaattacaccaacactaccacgtccccaagtgcaacgggacccacggaactacaggtgtggggcagggtgagcgtggaagaagggacgcggatgggggtgcgctttgcagacgatctggagactgctgtgtgttgagggaagatacgaagtcgcgggagcagttggggactcaatgtgtgggcaacaagggtcctgctgagctcaggagctgcacggaatggtggcagtcaccttgccagtgcagcaggcatggatcagactgcaagctaggggcacgaggcatcagttgggaagaggggacgcacagctaggcttgaggcctcttcatcgggatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggccctggacccccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctctgctacttgctgcacctcaggttccggagctcccgctcaggccgcttaagcctgcatggagatatccgcctgcttttttcccgccggagcctggagctggacacagggctcccctacgaactgcaggctgtgaccgaggcccctcataatccacgttattcacctttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccatgtgcctgtcccctcccttgggtttcccaggccagcttaggtagtagggaggaactggagctaccctgagattttctcaagttcccaggcaagttatgccagcgttgcctccctgtcctgggcaggggccacttgttattttatttatttttaatttataatttattcaaattggattgccttggtaacctcccacacctgataattggcatcactcctccccgcttcccactctcagatattgctccaacctcaggagttgaagaggcttatgcggtgggggcaggaggagaactgctttccctcagctgagggaagaggggctattccagagggactgagtcagtagccaaagactcagcttcccctgtccttccccagtcccttcacttcccctaccctctgacctatctctgaaagccaagttatgcgtatgtgtgtgtgcacaagcttgtctttgtgtggtatgtgtgtgtgagtgtgcatgtatgcacacacacaggggttaaccacccctcacctagggctccagactccagttgtccctctcctcctacctgtgtctccttgttttggggtcctgactgaagaaggtgtccagggggcagagtcagggccaagcactggggtgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataaattcttgtttggaaacttgaactaagctctaaat

SEQ ID NO: 38450 - DNA, 2993 bp, Homo sapiens
gagaaattaaacgaggaaagggacaagtccacagaaggtggaagggtcctgctgagctcaggagctgcacggaatggtggcagtcaccttgccagtgcagcaggcatggatcagactgcaagctaggggcacgaggcatcagttgggaagaggggacgcacagctaggcttgaggcctcttcatcgggatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggtatccatcttttcccctccggctggtacctctgagcctcatagggccctgaaacgacaagccccatccactgagggtccccgggagctgaagagaggccctgggctgggggccagagagggactaccccctgaagaaccatctactgtggggctcttaggcccagagggaccggggctgggactaggtgtggccagccagcatttctcccaccgtggcctctgtgttgtggaacagagaagtagtgtcacctcatcttggacttcaggggcctggagtcccccctgccccccatcaaatgcttcctgcaatactttgcacaccagagactgggcctccccagatccagggggacaggggtccctgggggagtccccagggccagcccctccaggccagctgcacacacttgacactgatttgcacagtcttgcacaaatagggggtaagagcccagtggctggggtgggcaatgggggtagcctctggcctagggagtcccctggcactgccaatgggcacagtcccgagcacacaccccctggccctggacccccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctctgctacttgctgcacctcaggttccggagctcccgctcaggccgcttaagcctgcatggagatatccgcctgcttttttcccgccggagcctggagctggacacagggctcccctacgaactgcaggctgtgaccgaggcccctcataatccacgttattcacctttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccatgtgcctgtcccctcccttgggtttcccaggccagcttaggtagtagggaggaactggagctaccctgagattttctcaagttcccaggcaagttatgccagcgttgcctccctgtcctgggcaggggccacttgttattttatttatttttaatttataatttattcaaattggattgccttggtaacctcccacacctgataattggcatcactcctccccgcttcccactctcagatattgctccaacctcaggagttgaagaggcttatgcggtgggggcaggaggagaactgctttccctcagctgagggaagaggggctattccagagggactgagtcagtagccaaagactcagcttcccctgtccttccccagtcccttcacttcccctaccctctgacctatctctgaaagccaagttatgcgtatgtgtgtgtgcacaagcttgtctttgtgtggtatgtgtgtgtgagtgtgcatgtatgcacacacacaggggttaaccacccctcacctagggctccagactccagttgtccctctcctcctacctgtgtctccttgttttggggtcctgactgaagaaggtgtccagggggcagagtcagggccaagcactggggtgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataaattcttgtttggaaacttgaactaagctctaaat

SEQ ID NO: 38451 - DNA, 3085 bp, Homo sapiens
agaagattagcaggcggtcaccgttttatttcagtcacagggcgtggattaaggttacttatacgtggccgttggctctgacaattacaccaacactaccacgtccccaagtgcaacgggacccacggaactacagggtcctgctgagctcaggagctgcacggaatggtggcagtcaccttgccagtgcagcaggcatggatcagactgcaagctaggggcacgaggcatcagttgggaagaggggacgcacagctaggcttgaggcctcttcatcgggatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggtatccatcttttcccctccggctggtacctctgagcctcatagggccctgaaacgacaagccccatccactgagggtccccgggagctgaagagaggccctgggctgggggccagagagggactaccccctgaagaaccatctactgtggggctcttaggcccagagggaccggggctgggactaggtgtggccagccagcatttctcccaccgtggcctctgtgttgtggaacagagaagtagtgtcacctcatcttggacttcaggggcctggagtcccccctgccccccatcaaatgcttcctgcaatactttgcacaccagagactgggcctccccagatccagggggacaggggtccctgggggagtccccagggccagcccctccaggccagctgcacacacttgacactgatttgcacagtcttgcacaaatagggggtaagagcccagtggctggggtgggcaatgggggtagcctctggcctagggagtcccctggcactgccaatgggcacagtcccgagcacacaccccctggccctggacccccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctctgctacttgctgcacctcaggttccggagctcccgctcaggccgcttaagcctgcatggagatatccgcctgcttttttcccgccggagcctggagctggacacagggctcccctacgaactgcaggctgtgaccgaggcccctcataatccacgttattcacctttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccatgtgcctgtcccctcccttgggtttcccaggccagcttaggtagtagggaggaactggagctaccctgagattttctcaagttcccaggcaagttatgccagcgttgcctccctgtcctgggcaggggccacttgttattttatttatttttaatttataatttattcaaattggattgccttggtaacctcccacacctgataattggcatcactcctccccgcttcccactctcagatattgctccaacctcaggagttgaagaggcttatgcggtgggggcaggaggagaactgctttccctcagctgagggaagaggggctattccagagggactgagtcagtagccaaagactcagcttcccctgtccttccccagtcccttcacttcccctaccctctgacctatctctgaaagccaagttatgcgtatgtgtgtgtgcacaagcttgtctttgtgtggtatgtgtgtgtgagtgtgcatgtatgcacacacacaggggttaaccacccctcacctagggctccagactccagttgtccctctcctcctacctgtgtctccttgttttggggtcctgactgaagaaggtgtccagggggcagagtcagggccaagcactggggtgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataaattcttgtttggaaacttgaactaagctctaaat

SEQ ID NO: 38452 - DNA, 1505 bp, Homo sapiens
gggagtggggagagaggaaagcagccctcaggccctaccaaccttgactgtcctgtccctagaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctctgctacttgctgcacctcaggttccggagctcccgctcaggccgcttaagcctgcatggagatatccgcctgcttttttcccgccggagcctggagctggacacagggctcccctacgaactgcaggctgtgaccgaggcccctcataatccacgttattcacctttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccatgtgcctgtcccctcccttgggtttcccaggccagcttaggtagtagggaggaactggagctaccctgagattttctcaagttcccaggcaagttatgccagcgttgcctccctgtcctgggcaggggccacttgttattttatttatttttaatttataatttattcaaattggattgccttggtaacctcccacacctgataattggcatcactcctccccgcttcccactctcagatattgctccaacctcaggagttgaagaggcttatgcggtgggggcaggaggagaactgctttccctcagctgagggaagaggggctattccagagggactgagtcagtagccaaagactcagcttcccctgtccttccccagtcccttcacttcccctaccctctgacctatctctgaaagccaagttatgcgtatgtgtgtgtgcacaagcttgtctttgtgtggtatgtgtgtgtgagtgtgcatgtatgcacacacacaggggttaaccacccctcacctagggctccagactccagttgtccctctcctcctacctgtgtctccttgttttggggtcctgactgaagaaggtgtccagggggcagagtcagggccaagcactggggtgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataaattcttgtttggaaacttgaactaagctctaaat

SEQ ID NO: 38453 - DNA, 1839 bp, Homo sapiens
agaagattagcaggcggtcaccgttttatttcagtcacagggcgtggattaaggttacttatacgtggccgttggctctgacaattacaccaacactaccacgtccccaagtgcaacgggacccacggaactacaggtgtggggcagggtgagcgtggaagaagggacgcggatgggggtgcgctttgcagacgatctggagactgctgtgtgttgagggaagatacgaagtcgcgggagcagttggggactcaatgtgtgggcaacaagggtcctgctgagctcaggagctgcacggaatggtggcagtcaccttgccagtgcagcaggcatggatcagactgcaagctaggggcacgaggcatcagttgggaagaggggacatcccccggggtctaccaggtatccatcttttcccctccggctggtacctctgagcctcatagggccctgaaacgacaagccccatccactgagggtccccgggagctgaagagaggccctgggctgggggccagagagggactaccccctgaagaaccatctactgtggggctcttaggcccagagggaccggggctgggactaggtgtggccagccagcatttctcccaccgtggcctctgtgttgtggaacagagaagtagtgtcacctcatcttggacttcaggggcctggagtcccccctgccccccatcaaatgcttcctgcaatactttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccatgtgcctgtcccctcccttgggtttcccaggccagcttaggtagtagggaggaactggagctaccctgagattttctcaagttcccaggcaagttatgccagcgttgcctccctgtcctgggcaggggccacttgttattttatttatttttaatttataatttattcaaattggattgccttggtaacctcccacacctgataattggcatcactcctccccgcttcccactctcagatattgctccaacctcaggagttgaagaggcttatgcggtgggggcaggaggagaactgctttccctcagctgagggaagaggggctattccagagggactgagtcagtagccaaagactcagcttcccctgtccttccccagtcccttcacttcccctaccctctgacctatctctgaaagccaagttatgcgtatgtgtgtgtgcacaagcttgtctttgtgtggtatgtgtgtgtgagtgtgcatgtatgcacacacacaggggttaaccacccctcacctagggctccagactccagttgtccctctcctcctacctgtgtctccttgttttggggtcctgactgaagaaggtgtccagggggcagagtcagggccaagcactggggtgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataaattcttgtttggaaacttgaactaagctctaaat

SEQ ID NO: 38454 - DNA, 2667 bp, Homo sapiens
cagactgaaggggcgaggtttgcaggcggaggctacagctagggctgctcagtaactgccccaaccactaccacgtccccaagtgcaacgggacccacggaactacaggtgtggggcagggtgagcgtggaagaagggacgcggatgggggtgcgctttgcagacgatctggagactgctgtgtgttgagggaagatacgaagtcgcgggagcagttggggactcaatgtgtgggcaacaagggtcctgctgagctcaggagctgcacggaatggtggcagtcaccttgccagtgcagcaggcatggatcagactgcaagctaggggcacgaggcatcagttgggaagaggggacgcacagctaggcttgaggcctcttcatcgggatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggtatccatcttttcccctccggctggtacctctgagcctcatagggccctgaaacgacaagccccatccactgagggtccccgggagctgaagagaggccctgggctgggggccagagagggactaccccctgaagaaccatctactgtggggctcttaggcccagagggaccggggctgggactaggtgtggccagccagcatttctcccaccgtggcctctgtgttgtggaacagagaagtagtgtcacctcatcttggacttcaggggcctggagtcccccctgccccccatcaaatgcttcctgcaatactttgcacaccagagactgggcctccccagatccagggggacaggggtccctgggggagtccccagggccagcccctccaggccagctgcacacacttgacactgatttgcacagtcttgcacaaatagggggtaagagcccagtggctggggtgggcaatgggggtagcctctggcctagggagtcccctggcactgccaatgggcacagtcccgagcacacaccccctggccctggacccccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctctgctacttgctgcacctcaggttccggagctcccgctcaggccgcttaagcctgcatggagatatccgcctgcttttttcccgccggagcctggagctggacacagggctcccctacgaactgcaggctgtgaccgaggcccctcataatccacgttattcacctttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccatgtgcctgtcccctcccttgggtttcccaggccagcttaggtagtagggaggaactggagctaccctgagattttctcaagttcccaggcaagttatgccagcgttgcctcctctcacctggccagactctgacccacctacctcagctggggtgaggggcacccctcaaactcagtcatgtggttccaaactaccccattccccactccagactctgacccagcctcagtcctaactcctggggctgggctgaggggaacaagcatttgctgaaacttgaaaaaacaaagcaaatcaaaaacaggaaaaaattgtacctggtacttttttttagaaaaaaagattaaaaaagaaagaataaattcttgtttggaaacttgaactaagctctaaat

SEQ ID NO: 38455 - DNA, 2537 bp, Homo sapiens
cagactgaaggggcgaggtttgcaggcggaggctacagctagggctgctcagtaactgccccaaccactaccacgtccccaagtgcaacgggacccacggaactacaggtgtggggcagggtgagcgtggaagaagggacgcggatgggggtgcgctttgcagacgatctggagactgctgtgtgttgagggaagatacgaagtcgcgggagcagttggggactcaatgtgtgggcaacaagggtcctgctgagctcaggagctgcacggaatggtggcagtcaccttgccagtgcagcaggcatggatcagactgcaagctaggggcacgaggcatcagttgggaagaggggacgcacagctaggcttgaggcctcttcatcgggatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggtatccatcttttcccctccggctggtacctctgagcctcatagggccctgaaacgacaagccccatccactgagggtccccgggagctgaagagaggccctgggctgggggccagagagggactaccccctgaagaaccatctactgtggggctcttaggcccagagggaccggggctgggactaggtgtggccagccagcatttctcccaccgtggcctctgtgttgtggaacagagaagtagtgtcacctcatcttggacttcaggggcctggagtcccccctgccccccatcaaatgcttcctgcaatactttgcacaccagagactgggcctccccagatccagggggacaggggtccctgggggagtccccagggccagcccctccaggccagctgcacacacttgacactgatttgcacagtcttgcacaaatagggggtaagagcccagtggctggggtgggcaatgggggtagcctctggcctagggagtcccctggcactgccaatgggcacagtcccgagcacacaccccctggccctggacccccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctctgctacttgctgcacctcaggttccggagctcccgctcaggccgcttaagcctgcatggagatatccgcctgcttttttcccgccggagcctggagctggacacagggctcccctacgaactgcaggctgtgaccgaggcccctcataatccacgttattcacctttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccatgtgcctgtcccctcccttgggtttcccaggccagcttaggtagtagggaggaactggagctaccctgagattttctcaagttcccaggcaagttatgccagcgttgcctccctgtcctgggcaggggccacttgttattttatttatttttaatttataatttattcaaattggattgccttggtaacctacccctccccctagcattacttatatgatatgtttccatacccattacaatttccagcattccccctcaaaccta

SEQ ID NO: 38456 - DNA, 2366 bp, Homo sapiens
  misc_feature (2342)..(2342): n is a, c, g, or t
  misc_feature (2350)..(2350): n is a, c, g, or t
cagactgaaggggcgaggtttgcaggcggaggctacagctagggctgctcagtaactgccccaaccactaccacgtccccaagtgcaacgggacccacggaactacaggtgtggggcagggtgagcgtggaagaagggacgcggatgggggtgcgctttgcagacgatctggagactgctgtgtgttgagggaagatacgaagtcgcgggagcagttggggactcaatgtgtgggcaacaagggtcctgctgagctcaggagctgcacggaatggtggcagtcaccttgccagtgcagcaggcatggatcagactgcaagctaggggcacgaggcatcagttgggaagaggggacgcacagctaggcttgaggcctcttcatcgggatgtccccaggccccccagcccaggcccagcataaaggccgtgttggggggcccccctgacccaaggggggcttcatgcgccacgtgcaggcggagccgtctccatcctcagagccggaggctggcccttcacagcctccagtcaggcagggggccctccagggtggcctgctcatgggctacagcccagcagggggggcgacatcccccggggtctaccaggtatccatcttttcccctccggctggtacctctgagcctcatagggccctgaaacgacaagccccatccactgagggtccccgggagctgaagagaggccctgggctgggggccagagagggactaccccctgaagaaccatctactgtggggctcttaggcccagagggaccggggctgggactaggtgtggccagccagcatttctcccaccgtggcctctgtgttgtggaacagagaagtagtgtcacctcatcttggacttcaggggcctggagtcccccctgccccccatcaaatgcttcctgcaatactttgcacaccagagactgggcctccccagatccagggggacaggggtccctgggggagtccccagggccagcccctccaggccagctgcacacacttgacactgatttgcacagtcttgcacaaatagggggtaagagcccagtggctggggtgggcaatgggggtagcctctggcctagggagtcccctggcactgccaatgggcacagtcccgagcacacaccccctggccctggacccccaggcccctgccccaccaagcgaaggctgcttcctgctggagaagccccagatgtcagctctgaggaagaggggccagcccctcggaggcgccggggatccctgggccaccctactgctgccaacagttctgatgccaaagccacacccttctggagccacctgctgcctgggcccaaagagcctgttttggacccaacagactgcggtcccatggggcggaggctgaaaggagcccgtcgcctgaagctgagcccccttcgaagcctccggaaggggccaggcctgctgagcccccccagtgcctcccctgttcctacccctgctgtcagccgtaccctgctgggcaactttgaggaatcattgctgcgaggacgttttgcaccatctggccacattgagggcttcacagcagaaattggagctagtgggtcatactgcccccagcacgtcacgctgcctgtcactgtcacattctttgatgtttctgagcaaaatgccccggctcccttcctgggcatcgtggatctgaaccccttggggaggaagggttacagcgtgcccaaggtgggcaccgtccaagtgaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctctgctacttgctgcacctcaggttccggagctcccgctcaggccgcttaagcctgcatggagatatccgcctgcttttttcccgccggagcctggagctggacacagggctcccctacgaactgcaggctgtgaccgaggcccctcataatccacgttattcacctttgccctgattgccagcactctgaacccatgcgggctaatgacctgcccatcctgctccatcttagagaacatatatggagagacagcaagagacccttcaggcttgaattaaagccctcaccatgctcacgcccaaatggattatttgggtgtttaaagcttctgattcttactacaccctgccctacttcgggtactccagttcctccctactacctaagctggcctgggaaacccaagggaggggacaggcacatggagtacccgtcgancggccgcnaatttagtagtagtag

SEQ ID NO: 38457 - DNA, 417 bp, Homo sapiens
ctgtagggcaggggcaggttcagggtgagagcttgtggagagggacatgtgtttagggcccagggttttcctagtccccaccttgactgatggctccctggccttccagggcatcgtggatctgaaccccttggggaggaagggttacagcgtgcccaaggtgggcaccgtccaagtggtgagtttgccctgagggagtgggagtggggagagaggaaagcagccctcaggccctaccaaccttgactgtcctgtccctagaccttatttaaccccaaccagactgtggtaaagatgttccttgtgacctttgacttctcggacatgcctgctgcccacatgaccttcctgcgccatcgcctctttttggtgcctgtgggtgaggagggaaatgctaaccccacccaccgcctcctc

SEQ ID NO: 38458 - DNA, 449 bp, Homo sapiens
aggccaggccaggggtgactgtctctggtctttgtccctggttgctggcacatagcacccgaaacccttggaaaccgagtgatgagagagccttttgctcatgaggtgactgatgaccggggacaccaggtggcttcaggatggaagcagatggccagaaagaccaaggcctgatgacgggttgggatggaaaaggggtgaggggctggagattgagtgaatcaccagtggcttagtcaaccatgcctgcacaatggaaccccgtaagaacccacagggatcagagggcttcccgccgggttgtggaacacaccaaggcactggagggtggtgcgagcagagagcacagcatcactgcccccacctcacaccaggccctacgcatctcttccatacggctgtctgagttttatcctttgtaataaaccagcaactgtaagaaacgcact

SEQ ID NO: 38459 - DNA, 875 bp, Homo sapiens
agcggatattaataccaccgctaataatgacagtagcagtcgagggaggagcaagcatgctaatattagccacacctgttgagggcccggcacacgccaggcccttacatatgtgatgatgtcagtcctcgtgatgagctgcactcagcatctccacgttgactgcgagggaccgctggatcccagagccaggacagaactcaaggctattttggttgggaagaaaagaggtgttcagctgacctcaagtacgggagggttgagtgaaacgagcatcattgtgggaacctgggtgaatcaaagcagtgggttgcagacagagctgggactgcagtgtggagctccagggagccagaggcaccctgtgcatctgccacaagtccctgaagctgcagtcctggcatcatccccaggtacctccgtctccgctgcttctctgcttcttcctgttgcacgccgtctcctgcattcatttcttcctgtgtatctggcctggacctcagcccctgctccttatagacgtggctgctctgcggccctaactcctccctggcttccctccaggcctccttacaggccctctccctcggctgcctgcccagttcaccgtgcatagccctgttgctcccctcaatccctgccgattcccacaccaccgtttgcctctggattggttgcccactagtcaggtcccgcccttcatccaatcagctgtggtgggcgggacacttcctccagccgtcctcaagcctggcctcaggaccctgtcacattctgaaaagttgttgacgacccgaaagagctttggtttaggcaaaatattgttaaatatctctggatatttaccacattaaaaattaaaactgagaaattac

SEQ ID NO: 38460 - DNA, 799 bp, Homo sapiens
gagtattggaatcacgaggagcttttaaaaaaacatatattcctggattcctaaagttttgattcagtggtgtaaagccaggtatctgaaattttaagttctacaggaaattcagacataacacagttgaaaattattggtcttgtcaaggcttactggctttggcaatctttattaagtagtaaactcatttaaaaatacaagttctttggttgttataagcaaatgatgtagaattctatttagttccattttattaatatataacaaaaggccatttatcaggcactgtgattaaggacaatacaaattcaaatgtttgggtatttagtgggacttctggattctacccatgaaggattaactgctatagaaatagccatttcactgtttaaaactaggacataggtgaaacaactcaagacattgaacaacatgcagttgaacagagaaaagggaaacaaatgagttcagctctataattaccccctgcttactgcctagaggtagtttctgggttgcagtgcaggcagtgggagcccaaacaaagcctagtagtgtcactgagttctggagactgaaactggagttcagggaggcctagatggctaaaatttgcaggacagaatactagaaagaaaactgtacagggaaaaagttctggaaattgacagaagggttccttggaatttttggctaaattgtgatttgtgcatgtgaggggtgaacccacacaagtttggggttagttgggaaagatgggaagcatcactggaaaacaaaaggtaaaacaattctc

SEQ ID NO: 38461 - DNA, 292 bp, Homo sapiens
tttgggaattgtataaactctttttttttttaatcatttacaatggttcctgttgttgtaaattagagacatgtggcagactggttaggtacatggattctggaggctgactccttaggttcaaatctcagccctgctacttacttgctgtgtgatttggggtaagttattgaacctctctggccctcaagtttttcatgtgataagggtccaggatgtacttaaacatagggctgttgtgaggattaaatgaggccacaggtgtgatactcagagtacctggcagcagacc

SEQ ID NO: 38462 - DNA, 3717 bp, Homo sapiens
catctttcatatcttgatatgcagctgcatcagatggaaaaaaatttactaaagcaccctgttaaagagctggtgtgctccagtgaggccctctccttttctcagcacagtgtggcagtggtaatctattcaaattttgcctgttacacaaaataatccacttatatatacagtcagccttccgtacttgtgggttctgcatctgtggattccaccaactgtagatggaaaatactcaaaaagaaagttgtgtctgtactgaatatgtacagactttttccttgtcattattccctaaacaatacagcgtaacaactatttaaataggatttacattgttttaggtattataaattacctagagatgatttaaagtatatgggaggatgtgcataggttatatgcaatttctgcaccattttatgtcaaggattttgaacatcctcagattttggtgttcgagggcatcctggaatcaattccccatgataccgagggatgactggatattaatcgatttccctcaagcctgcccttgctgtgaactagtgctacaagcacgggaaatccatctgctctctggcttaaaatatgtatctcatctaaaattgttcgttaaagtgtgaataaattgctaagtggttgttgcttagcaataatttttgcctgaccatcagcagagcttttatttacctttgtaattaaaatccaacatagcatgggctcttgggcaaaatatttcactgactattaagcatgtagaacaggaaaatgaaatacactatttgtgcccttgacctagaaccagaaccactaattatgagaactttgttttatgtaccaaattcacattgaccattttctgagctctagactgatcgtagtaagttttgtgacttaacaatgaaagaaagtagaaagatgctttgggttttcaaaatgttgttttttaaaattgttctttgggtgaatttactcagtgctgctttgagttgtatacagaaacaaatgttgggaattgctcctcagaaatgtgttcctaagttgtgttttcaactttacatcatgaggtgaagcattagggaaagagattctttcgatttgtttaataatctaattatacagaccaaagtgctttacgtttctgctctatgttaatgttttagaatggtgattttgctgattaatttagacctggaattgaaataatgtgctcagaataataacatggttatagttcttgtatgataaagtattcaatttcagaatagtgttggaatcctgagtttgaataatgtgttgtatttagaaacatagccctatctgttttaaacaaataatttgttggccgattgtccatggttgagcatgacaaaaatacctcgtcgaaaggcaagcttaggtaactgctggcaaaacactgggtgcactatttttctggataaaatttatagttattttctatattacccttcaaaagggatctcttcaggttaaaaatcacgcttatgctgaagtctttatctggtgttaactaaaaatctcatatgggttcataaccgaggtcactaataattcatttttatcacttgtaaaaatttgctcaaaattccaaaaaaatattgatttgttttttagtgattttgcaggctgacccccaacctaagttttgataacatctggtaagtcagtatagttctgtgacttcatgttttaactaagaaggaaaattcatagatattcctattagattttataaaccttcaaaagtctgaaacttaattttgagtctaaattttctgacactggccccttttaatattgtaagtttttgttcactttcttaagtaaaaaaaacatttaattactagttagcccttaactgggaaactcaggtaatgaactgctgacttttctaaagttctttaactgatcaattctgtatagagggatatttatctaaccactttccgtattttacaagtgctctttctaaaaaggaataactattatagctctatttccccaatctctataggactcatgagagattgcttgtgtaaatataaaagcaccatatgtgttcttaactcctatggctgcttgaagctcatgatgaaaaagtctttttgtcagttttaattgttaagtacagaacaaacaattgtttggtgatggcctggttgaaagagagcatataaatatatcccagtggaactcaccaaagaagaccacacctcagaaattattgcattttctcattatgtgttgggtttgatttgcttttgtttttaatgcagctcttttaatataaagattcttgatacagtgaaatctcttatttcaagtgtaagttattcttcacccaccccttcccctgccattgtatttcccatctgtttcaaggagtttcaacaatttacattgcatcgtatgcagtaggtactgctttttcagaaagacctggaaaacatacctgctatgaatattttgttcagatgtagccatttacctggctctcaagttgtctttgtggagagggtcttagacaaaaatcttccttgtatttacttgggttaagtgaagtccaaattcttacagtatgctatttcaggatttctgatattaaaaaagaaaaaacaaaatctttatatctcttattaacacttcccccaagaagggttgtgctgttatttattttctattataagaaaagttcattctttaagtagtttcttttacctctaatctaatttcataccaaatacctgatcaatagaaatgatatatttaagcagcaaagattcctaatccatcattatgaaaagtgtcagcatacttagtagtgaacagataaagtcaatttgaatataattccactttgtttttagagactaaattaagattcaattaacattatcctatgaattctgaatgtgataatgtgattcaaacagtcaaattttattaagctcttagtaactcaggatagcattccatactaacctcaagttagcaaaacaaattagttaaacagcttggttcttagcagactgcttaaaagatcaagaaaattttctcatcttttctttctacttagaaacattgcaagaaaccttggacagtcttcaccagacctgccatgattttataagatttaggcctcagtgacatgctcctgaaagtttcctgccagccatccaaactaagcatccactcattccatcttcccaaagtcactcaccgataaaggtagcatccttaagttcatttttgaaaggtggaggaggatctccccctgcccaaaggaatttttttatcagaataccttgaaaggggggtatataaatttggaaaacttaatttcttggctgtgtttgataacagttcctatgcatggtttttaatgtgaggtaaatttgtttctttcttcagaatacctctctccaccccccaccttattcttcctctttaatgaatatttttattggagctcaaactccatgacttacgtgctcactaagttttcttttttccccttgtttactctgtctgtatgtatgtcaaaagctggcaaaacctctaaaactgtcaagaaaatgcttgaaagttgatttgtcatagtgcaaattcatgataaaatgtcttaatgttatttggatatgtagtacatagaaacagaaaaataaagtcatttttataactttaaaaaaaaaa

SEQ ID NO: 38463 - DNA, 408 bp, Homo sapiens
acattctgaggtcctgcagttcagtgttaacatgtgaattttggggatacacaactgaaccataacacaaactgtgaattcttagcaccttaagaataagttgtagaagagaacagagccactcctccagccattgctccaatggctctggttaagttgtagctcagtagagagcatgaatgctctcaaaaaagcactacagttgtcctcggtatccacagggggttgcttcctggatcccctcagacaccaaaatgcacagacattcaagtccctggtaaaaaatggtgtagcatttatgtataacatatgcacatcctcccgtgtactttacatcatctctacattacttgtaatacctaataaagtgtagatgctatggagatagttgatatactgtattgtttt

SEQ ID NO: 38464 - DNA, 407 bp, Homo sapiens
tccttaataatattcacataattacatctaatggcctattccccatcctcagatctatcgacagcatttaattcaatagatgctttcttttcctggaaacatttccttcatttggctttcaggacacttcactcaatggcatttcctccttcctttcttggtggttcttttcaacctatgggatttccttcattcccagacccttcaatatcttggagttctccaagactgttcacaacgtcactagttcccttattaatttcatctaatctcattgtttaattttttatgtcctgacaattctccaaattttattccccctttacttgagaatcatacccaactgccttcttaacttctccacttgaatcttgtatcagtctgcataatgtaaatatgctgcaata

SEQ ID NO: 38465 - DNA, 266 bp, Homo sapiens
tctatcaaaaatagctgccaagaatggccaattgagaatatccaagctcaagggaaaagaatactatgatgaattattggtgtcataagggagaaaataaaaaatggtgacagaagtaccaagtccttgtcatacatgagattcatcaaactattagcagtagttatttatagaattaggaatgatggcaagaaggcttttattttcaacattatacacttctacattgtttgcgttttttaaagacaagcaagtattactttcaa

SEQ ID NO: 38466 - DNA, 557 bp, Homo sapiens
gtgtaccaagaagagggtcactttttccccttcatcctgcacctatcactctccactgctcataccgctaagctctttcatcatccgacattgacttgtaatttaacagaggccatgtgctaagcaggacattgcagtattggctggccagtttgactcagctgtcttcccactgcaagtcaattgtttttgcctaaaattatttcagcaagctttgtgctgtaatctgtgtcacacttttggccagtttgttaatgtaagtgctccttggtagtaggagtaagatcaattcctgctttacctacctatggcccttggacaataccctctacccagtgggtttcaccaacagacactttgtggtgggcatattggcaaaaatgtttgactcccaaccactacttcccaaggttttgccatgcatagagctctccttatttgcacactggggctttctgtaactgcaatgtccatccatgtctaaggatgcagccaaataaagaagctgcttcccttttattttattttattttattatttttttgagacagagtttt

SEQ ID NO: 38467 - DNA, 1088 bp, Homo sapiens
tttaactgtggcttcatttactatcggcagatcttgaaatttcaacccgctttatcctaaaaggaagttgagtccaaaaccatggaaaacaccaaaacattcctggcccaaatccaccacacatctcacatacctaatatgacatatttggtacagttcttcagagctggaatatttctagtttttcatcctcctgtcttcatcaccagcccttctctccacttccaaactcggtctcttccataggctttgacttgaactagcccttgacagctactctgctttcttaccctgtactatcacgagactgtgaattttttggcaatcctctagaataaacaaacgataccaatatttatctggaatagcaacagattctgtccttaacaaatgtaacagtattatttgattacaacaaagcaaaacatcaataaaacaccaggcagagatagcgcacgtctaaaaccattatagcagtgatggttggctcattgatgaggtcagcatgaaaggccactttataagaccctatatgctgtttataaaacaaacttttatattttattttattttagacaaagtctcgctttttctctcccagactggagtgcagtggcacaatctcggctcactgcaacctccgcctcccgggttcaggcgattctcctgcctcagcctcccaagtagctggggattacaggtgtctgccaccatgccccggctaatttttgtatttttagtagagacagggtttcaccatattggccaggctggtcttgaactcctgacttcaggtgatccacccaccttggcctcccaaagtgctgagattacagatgtgagccaccgcgcctggcctaaaatgaacttttagtactttggataatagcactcaaaatagaagcatctttaaaaatcatcttaaaagtatatatctgataagaacactttaacaatgcaattttaagttaataatcttatttttgtttcctaaactaatattagttaaggacttttttcaataactgcaggaagataatttaaatatatctgtttaatattagtagtttcctagcaagaattgatct

SEQ ID NO: 38468 - DNA, 593 bp, Homo sapiens
acaaaacgaacaaacaaacaaataaaccaaaagattgggctacatgactaataggatatggacaagagtaaataaattgttgcttctgctctctttgcttagattgctcacttaaggggaaactaactaccacgttatgcagctctactgtaaaaatgcacagggtgagaaaccaaggcctccttctgacaggagccacttgccggtcatgtgagtaagccatcatggagataggtccgtgtttataactggtgtcatatgcctgtcccactgctgtattttgaaagcaggaaactcatttcttgagtgttgcaggttcgcagaggaagaattgtgcccctggatgaattatacctacagcctcactcatatccaatttagataatgtaggtaagagttggaaattttgaactgatgagatcttggactttgagttgaggctgtaatggattgagacttttgggaaccctgaagtgcggtgaatgtattttgtgtgtaggacatatatgaatcattggggggttagaagtgtgctatgatagatacccccacatacacacacaagaggtccactttttactccctgaagcttg

SEQ ID NO: 38469 - DNA, 507 bp, Homo sapiens
agtgaataaaaacaccatggaaaaattaatttggtaatacgaagcatgggctacatttcctgatttcattttgtgatttgatgttagtcagtaaacctgtgattatatgctacccacagtgaaggtgaattccatatatccaatgaagtttttcagaaaacatcttagcttcttacagaagaagaagcatgaaatggcttttcacctccacctgtatgctgtttctaagctcatgaagctaggatttgccatggggaacctagagagcaagaggattgctcacttaaggggaaactaactaccacgttatgcagctctactgtaaaaatgcacagggtgagaaaccaaggcctccttctgacaggagccacttgccggtcatgctcttcgaaagactgaaaaaattgacaggaccagagagagtccatctagaagaatgtcaaacaaaccactgaagtaacgtgttgacaaaataacagctctaataaattgcaatttgactataaa

SEQ ID NO: 38470 - DNA, 650 bp, Homo sapiens
tggtgtggtcagaactccaggtcactggaagttagtggaatcatgtagttgaattctttacttcaagacattgtattctctccagctatcaaaacattaatgatcttttatgtcttttttttgttattgttatactttaagttctggggtacatgtgcggaacatgtaggtttgttacataggtatacatgtgccatggtggtttgctgcactcatcaacctgtcatctacattcttttatgtctgtctttcaaagcaacactctgttcttctgagtagtgaaatcaggtcaactttaccaccagcctccatttttaatatgcttcaccatcatccagcacctacttaagatttatctagggctctgtggtgatgttaggacccataaaagaaatttatgccttccatatgtttggttacagatgggaaatgggaatgttgaaggacatgaaagaaaggatgtttacacattaagcatcagttctgaagctagattgtctgagtttgaatcttagctcttccctttattagctctgtgacctcgagctagttacttaaatgctctgatcctctatttcctgatcagtgaaacctccctattcaaatgtgtgagagtttaataaattaggacacttaaaaatgttggagca

SEQ ID NO: 38471 - DNA, 640 bp, Homo sapiens
cccactaccctgcactgagctgtctctgggccagcagctgctgcgggccaccactgatgaggacctgcagacagccatcctgctgctggcacatggctcccgtgaggaggtgaacgagacctgtggggagggagacggctgcacggcactccatctggcctgccgcaaggggaatgtggtcctggagcagctcctgatctggtacggggtggacgtcatggcccgagatgcccacgggaacacagcgctgacctacgcccggcaggcctccagccaggagtgcatcaacgtgcttctgcagtacggctgccccgacgagtgcgtgtagtatctgttttatttgactgcagtctccttggtgcaaaaacaaaatgggaaaaataaggataactcagaatttcaaaaggaaatcacaaattcagctagtaatagcattttcagtacttttcgtaaactaagtaaatacacaaaatgttgatttttctgaccataagacatattttatgtccttttgccaaggtggatgtgttagtctcaggccctcctggccacattgcccaagtcacacaggcttctgtattatgtatttagataaaatgtgtgaaaatatatttgaaaaaaatttcataaaaaaaaaaaa

SEQ ID NO: 38472 - DNA, 460 bp, Homo sapiens
gggggcatcaaatccacaccttaccttaaggtgttgttgactgcgagacttgtgctaggaactctgaagggagggacagataacctctgtcctcaaggagcccacaaggtagccaggagggcagagtgacaagcattggagagtttacacatcactgaagcagacaagaaactctgattgcaaactcagaggtgaagagaatgtaactcgttttatttttctttattgcaacttagtttcttttgtgagctcctgttcctctagggacaaaacttaatcttagttccaggccccccctttctctgaagctgcactttcattccagagagattgcgtaatgccatgatcacaggagggggatccgtcagggtaggcgggcaaggctgcaataacaaacagcttccatccctctttggttttaaagaacaaacgtcattttcctatgcacgctacatgtcca

SEQ ID NO: 38473 - DNA, 387 bp, Homo sapiens
taattttgtgcatgaaacaaagttttgactgcattttgactgcaacccatcacatgaagtcaggtgtagacttctctacttgtggcatcatgtcagtgctccaaaagtttgggattttggagcatttcgggttttggattttcggattagggataatcaatctgtgactctacataagtgcataccaatataaataaatgactaaatttaaaaaatgaaaagttaaatctttcttacagaagaatttcaaataatatatgtaactactccccccactaaaaaaaggtgaaacttgacacccctctacacataccctgagagtagactaggcttaacgactccaccccaagcaatagaatagggaaagggaaaaatagtaactttaca

SEQ ID NO: 38474 - DNA, 478 bp, Homo sapiens
gaaagaagaaacccattaagaggttaagagcaagggcaggcttgggcctaaaggggcacagccctaccagtcctgtgccttttccgctacaccacattcccctggacaaactccctccaccactcctacccccagcaccctcctcagtatcctgcccccagcttccacacggtgcatcattgcctataatcatgattgtcaagctcaaatgcacatcagcagccctcggagagtgtacaaaattcagactgctgggaccgccctcagggtttctgatccaagaggcctgggggcggggcctgagactctgcattcctagtaagttccctggtgatgctgacgctgctggcccagggccacactttgagaactgctgatttatagtaatttaaagtgttcacctaacagctggggaatggttaaatgcggttcatctacttgataaaatatgtgtaattatgaaagccacatataagaa

SEQ ID NO: 38475 - DNA, 992 bp, Homo sapiens
cattatatgttagcatcacctgaaattgggatggatgcagtacgatagtctaatctggaatgaatctgaagaatattggtgaaagaaaatcctctcagtggcagaatttcaagtggtacatttagttgtccactgtacctgctgtaaagaattggcaagaactatggatatatattgattcatggttatttgctgacacttggctggatggtctgggacacgaaaagaacagagttggaagattggtgacatgacagtctgggatagaggtacatgattagacagacttctccaaatgagcagtgagtaggaggtatctgtccctagtgaatgtcaccaaagagcatccttagcaaaagagggtctttataataaggtagaaaagatgataagataataaggtctataaatgtcagacagtatctttccccaggcatccctgtctttgcccagtgggcttttgcgcaacgtagtcatgtgggcagggatggaggatattcatggactcagaaacatggatttccattgaccaaaaccacagcaatgtgcctgagctaccaagagcagacaccagtaatgaacccctgatttagcaccattccagggagggcaagccaatcctggtagtaggttcattacattaaatcacgtcattcaaaggctaaactttgttctcattggaatcaactattactttggaaatgtactcacattccctgcctgcaatgtttctgccaaaaccaccacaatccatggatttatagaatgcctaaatcataatatcccaaagaatattgcttccaaccaaggaattcattttataacaaacgaggtatgatgatatacttatcctcatagaacttgctggttttactgtgttccccattacctgaaatagctgtcctcatgcaatggtagaataatattttcctgtatactaagttacctttcagaggaaataaaatattttacttgcatttaaaaaaaaaaaa

SEQ ID NO: 38476 - DNA, 890 bp, Homo sapiens
gaaagaaaagaaacagaaataaacttaggacacagcagacggcccatcctgagggtaccacatagcagatgctgggaccttttttcaggcccaagcccccaaagcccggtcattcccagcaccatcttcacgggtttctgcccaggtctttctgctgcatctcttcctcccccgattccttaatcattttttttaaaatcagttcatgtctttgtaaaccaaattatttctaaaaggcaaatttatattactgccggagagtgagaccaacacagagcagcagagacagagacagactggctcccgagcgttcagccccagtgccggaagccagctagagccctggccttttcagtgacatgagccaatgacaactcccagttctctccctccggtcaatctgaagccgggtttttgcctcttacaactgaaagagtcctggtggtcacaggcatggctgattaaagatgcccaccaggtctttgttacaccctcatatacttggggccttgaatgtgggtgtgctctgagatgacttgaccaggagaatacggtagcagtgacactgcagtttccagcccaggcctgaagagatgattagcgcccactccttgcttcttgaaagtctctccttgggagtcctgggctgctatgttaaaaatccaactgccctgaggccaccatgatgtgaggaggctggagccaggtggagaggccatggtggcgaaagagctgccggaccagttcccattgccccagcccccagccatctgagtcatccccactgaggacacagatatcacagagcagatacgagctatccctgcaccgcccatccagattctttacccagtttgtgagatataataataatgaactgttttaggcca

SEQ ID NO: 38477 - DNA, 1249 bp, Homo sapiens
gaaagaaaagaaacagaaataaacttaggacacagcagacggcccatcctgagggtaccacatagcagatgctgggaccttttttcaggtggacgccacatgacctttcctttgcaggcatccatgctgatgttcacaaggcacacagcatttcagctgaagaaagaactggcaggattttcatcacgaaagggcactgtctatcgtttatgaaaatgaagcatatgaagtaaaagtttggaaacagatggaattaaatcttctgacagattttaaaataagatctaaaaaagagcaagacatgctcttggatggggaaacttaatatcagaaaaatgtcaattttcccattttttccatataaatttaatgtaattcaaattccattaccaacagggtgattttttaaaaaactagataaaatgatctgaaagattatgcagcagaataaatgcccaagaattaccagggaagactggaaaaaagactgctgtgggggttttgccttcctggaaataagaccatactgcaaagtcactgtaatcagatcaatatggcattggcagaggactagacaatggaaaggaatggagaatacaaaaataagtttcaggatatatgagaatgagatatatgccaaaggtagtattttgattcggtgggagaagggcagactgtgaagtaagtggtaccagccacaactgaatatccatctgggataaaataaaattgcactcgtcttagagatccaaatcaacttcagatggattaaaactttgaatgtaaaaaacataaatgactaacagtcctgcaaaatatcttggagacaacctgtgccatctggagagtgggaagagcacatgcaaaggccaaggggtggagcagcccagcatgttctggaaaaggtagggctccccaaggctgggatgatggtggagacctgggtgtgtgggagcacaggggtgggggcccgtgggccaggaatgcacagagaggggctggtgctctgccgcaggcccaagcccccaaagcccggtcattcccagcaccatcttcacgggtttctgcccaggtctttctgctgcatctcttcctcccccgattccttaatcattttttttaaaatcagttcatgtctttgtaaaccaaattatttctaaaaggcaaatttatattactgccgaaatcaagggtcagtgagctagttgtgtatgttctgaatcacatggaaataaatgcatcgaacatt

SEQ ID NO: 38478 - DNA, 1817 bp, Homo sapiens
gaaagaaaagaaacagaaataaacttaggacacagcagacggcccatcctgagggtaccacatagcagatgctgggaccttttttcaggtggacgccacatgacctttcctttgcaggcatccatgctgatgttcacaaggcacacagcatttcagctgaagaaagaactggcaggattttcatcacgaaagggcactgtctatcgtttatgaaaatgaagcatatgaagtaaaagtttggaaacagatggaattaaatcttctgacagattttaaaataagatctaaaaaagagcaagacatgctcttggatggggaaacttaatatcagaaaaatgtcaattttcccattttttccatataaatttaatgtaattcaaattccattaccaacagggtgattttttaaaaaactagataaaatgatctgaaagattatgcagcagaataaatgcccaagaattaccagggaagactggaaaaaagactgctgtgggggttttgccttcctggaaataagaccatactgcaaagtcactgtaatcagatcaatatggcattggcagaggactagacaatggaaaggaatggagaatacaaaaataagtttcaggatatatgagaatgagatatatgccaaaggtagtattttgattcggtgggagaagggcagactgtgaagtaagtggtaccagccacaactgaatatccatctgggataaaataaaattgcactcgtcttagagatccaaatcaacttcagatggattaaaactttgaatgtaaaaaacataaatgactaacagtcctgcaaaatatcttggagacaacctgtgccatctggagagtgggaagagcacatgcaaaggccaaggggtggagcagcccagcatgttctggaaaaggtagggctccccaaggctgggatgatggtggagacctgggtgtgtgggagcacaggggtgggggcccgtgggccaggaatgcacagagaggggctggtgctctgccgcaggcccaagcccccaaagcccggtcattcccagcaccatcttcacgggtttctgcccaggtctttctgctgcatctcttcctcccccgattccttaatcattttttttaaaatcagttcatgtctttgtaaaccaaattatttctaaaaggcaaatttatattactgccggagagtgagaccaacacagagcagcagagacagagacagactggctcccgagcgttcagccccagtgccggaagccagctagagccctggccttttcagtgacatgagccaatgacaactcccagttctctccctccggtcaatctgaagccgggtttttgcctcttacaactgaaagagtcctggtggtcacaggcatggctgattaaagatgcccaccaggtctttgttacaccctcatatacttggggccttgaatgtgggtgtgctctgagatgacttgaccaggagaatacggtagcagtgacactgcagtttccagcccaggcctgaagagatgattagcgcccactccttgcttcttgaaagtctctccttgggagtcctgggctgctatgttaaaaatccaactgccctgaggccaccatgatgtgaggaggctggagccaggtggagaggccatggtggcgaaagagctgccggaccagttcccattgccccagcccccagccatctgagtcatccccactgaggacacagatatcacagagcagatacgagctatccctgcaccgcccatccagattctttacccagtttgtgagatataataataatgaactgttttaggcca

SEQ ID NO: 38479 - DNA, 999 bp, Homo sapiens
  misc_feature (932)..(932): n is a, c, g, or t
  misc_feature (999)..(999): n is a, c, g, or t
gaaagaaaagaaacagaaataaacttaggacacagcagacggcccatcctgagggtaccacatagcagatgctgggaccttttttcaggtggacgccacatgacctttcctttgcaggcatccatgctgatgttcacaaggcacacagcatttcagctgaagaaagaactggcaggattttcatcacgaaagggcactgtctatcgtttatgaaaatgaagcatatgaagtaaaagtttggaaacagatggaattaaatcttctgacagattttaaaataagatctaaaaaagagcaagacatgctcttggatggggaaacttaatatcagaaaaatgtcaattttcccattttttccatataaatttaatgtaattcaaattccattaccaacagggtgattttttaaaaaactagataaaatgatctgaaagattatgcagcagaataaatgcccaagaattaccagggaagactggaaaaaagactgctgtgggggttttgccttcctggaaataagaccatactgcaaagtcactgtaatcagatcaatatggcattggcagaggactagacaatggaaaggaatggagaatacaaaaataagtttcaggatatatgagaatgagatatatgccaaaggtagtattttgattcggtgggagaagggcagactgtgaagtaagtggtaccagccacaactgaatatccatctgggataaaataaaattgcactcgtcttagagatccaaatcaacttcagatggattaaaactttgaatgtaaaaaacataaatgactaacagtcctgcaaaatatcttggagacaacctgtgccatctggagagtgggaagagcacatgcaaaggccaaggggtggagcagcccagcatgttctggaaaagtgaacagatgaattgaacagccacttnttaaaagaagatgtatgaatgcccagtaagaacatgaaaaaaactcaactaactttatttaaggaan

SEQ ID NO: 38480 - DNA, 746 bp, Homo sapiens
gagagtcaacctggaaacttggcaagaatctccgggactgccctcctgctggggtcatgtggcactgggagctgcggtggccatctttactgccacccaggagagcctgccggagagtgagaccaacacagagcagcagagacagagacagactggctcccgagcgttcagccccagtgccggaagccagctagagccctggccttttcagtgacatgagccaatgacaactcccagttctctccctccggtcaatctgaagccgggtttttgcctcttacaactgaaagagtcctggtggtcacaggcatggctgattaaagatgcccaccaggtctttgttacaccctcatatacttggggccttgaatgtgggtgtgctctgagatgacttgaccaggagaatacggtagcagtgacactgcagtttccagcccaggcctgaagagatgattagcgcccactccttgcttcttgaaagtctctccttgggagtcctgggctgctatgttaaaaatccaactgccctgaggccaccatgatgtgaggaggctggagccaggtggagaggccatggtggcgaaagagctgccggaccagttcccattgccccagcccccagccatctgagtcatccccactgaggacacagatatcacagagcagatacgagctatccctgcaccgcccatccagattctttacccagtttgtgagatataataataatgaactgttttaggcca

SEQ ID NO: 38481 - DNA, 378 bp, Homo sapiens
catcttgagtttttttctcattcataaatgagccatgatgtatgtttacattgagaaattaaatacagtggtaggtttagtaataaaatagaggccaaaatctttgaacttgaggaactgtagtttttcctgactggctgaagatccaccagcacagttgcctttcttagcatacatttttattatactttttcagtttactttcttcagtaaaacatttgaagttgactttggggctattttgactattaagaaatatcaaattttaggagtattttgaagtagtaagagaaaattcttttgaatcctttagtattatgtcaaaagaaggactgttttatgttcaagtgaacataaattctcagttcttattttgtt

SEQ ID NO: 38482 - DNA, 2770 bp, Homo sapiens
gtttgaagtgtgggtaaaggttggggttaagaaatcacagctttgctagctaaaagtggcataatcagttaataatgaaaaactcacagctttgctactttgagtttgaagtttgctagtttgaggccaccatccagaaatttaacaaggagatcctagaaatgagagacctatagagggctaacatggctccccaaccatctgtagcagacagctaaactttgcatgcccaggggatactcagtagagcccagcaaaaagtgaaagccagaagagacttgagatctgggtacaactttgaatgctaccttccatgcagactgttccatctgcagatgttggaagccttactggtgcaaggtggctgggcttaatctctgcccaaatccactggctgaccactaaactaagcagccactcactcattagggaaatgcaaattaaagccataacaacaaccaccagaatggctaaaattaaaaagactgacaatccaagtgttgacaaggatatgcggaaaccagaatcctctcaaattgctggtgggaatataaaacagtatggccatgatggaaaacagtttggcagtttcttaaaaagttcaatatacacttaatgtgtaactcagcaattctatttccaaggtatgctgtcaggaaaaatgacagcatgtgtccaggcaaagttggtatatgatgttcatagtgtcacccagcaagcaatcaatgggcctgcttcccaaggcacatggaggccaataccatggcgctggcttttgaggaaaaataagctttatcatgactggactggcaaggagccaggaagaagcacccaaatctgcctcctggagctggtagttgggtagagttttataagcatagggtaatagggtgtgatccaattggatcttgtgatgaagtgatgctggggggtgttttctgactggctcctgacatggggctatgccagagctcaatctggttggattctggatcctgttatgccatatccacttttttttttttttttttttttttttgagatagagtctcactcttgtcacccaggctggagtgcagtggtgcaatctcagctcactgcaacctccgcctcctgggttcaagtgattctcctgcctcagcctcccaagtagctgggattacaggcgcctaccaccatgcccagtatttgtatttttagtaaagatggggttttgccatgttggccaggctggtctcaaactcctgacctcaggtgatctgcccgcctcggcctcccagagttctgggattacaggcatgagccaccacacccggcttccacttcttagttcagtcccctctccttggttggaacatttaggttgcccctatagttgcatgcttggttcatctggacatgctcagcttacatgatgttcaacctgggggcccatggcaactgaaaaacaactcacaactttgttacagaagagatgaaccagattggtctgacgtggttaaaacagcagctttagctgtgattgaaaactggaactaatttatgtgtctgtcagcagatgaatggataagcaaattgtggtatatctatagaatggaataatactcagtaatgaaaaggaatggactattgatacatacagtgacatgtatgcattgcaaaataataacatgctgtgtgaaagaagccagacaccttttcctacaaaacagaatactgattccatttaggtgaaattctagaaaatgcaagctaatctgtagtgacagtagatcagtgcctgcagatcagaggatggcttgggagaggagggagaaagggattccaaaggaaagagcacaatgaaacgtttgggggtgatgtatatattcattatttgattatgtctaatgatttcatgggtgtatacatatgtcaaaactcattgtatatttaaatatgtgcaatttattgtatatcaagagtaactcagtaaagttataaaaactaaaactatgcccattcaaaaagcaaacagatgttcatagtaccattattcacagtagacaaaaactggaaacaatccaaatccatcaaccggtgaatagataaacaaaatttggtatgtccatatcagccatgaaaaggaataaaattctgattcatgccacgggtacatactacaatatggttgaacctcagaaacattatgccaagtgaaagggctctgtattgtatgataccatgatatgaaacttttagaacaggcaaaaccttagatcagatcagtactttgcctgggtgtagggtggcagcatggagattggttttaaacaggcacagcggaacagtttgggtgatggaaatgttcctggtgatagttgtgtataaattgtatgaaaacgtgtgcaattgtgtacttaaaatggataattttcatgacatgcaaattatacctcaagaaagccactaaacgtgggtggccactcaaaatttcaaattctctttaagatgaccattcaggtcaggcatggtggctcactcctgtaatcccagcactttgggaggccaaggcaggcagagcacgaggtcaggagatcgagaccatcttggctgacacggtgaaaccccatctctactaaaagtacaaaacgttagatgggcgtggtggcgggcacggtggtgggcgcctgtagaggcaggagagaatggcgtgaacccgggaggcagagcttgcagtgagccaagatcacgccactgcactgtagcctgggtgacagagcaagactcc

SEQ ID NO: 38483 - DNA, 1045 bp, Homo sapiens
tgggaaacacttcaggttggcatggttacagagggctttgctggggtggtgatgcctgcagatcagaggatggcttgggagaggagggagaaagggattccaaaggaaagagcacaatgaaacgtttgggggtgatgtatatattcattatttgattatgtctaatgatttcatgggtgtatacatatgtcaaaactcattgtatatttaaatatgtgcaatttattgtatatcaagagtaactcagtaaagttataaaaactaaaactatgcccattcaaaaagcaaacagatgttcatagtaccattattcacagtagacaaaaactggaaacaatccaaatccatcaaccggtgaatagataaacaaaatttggtatgtccatatcagccatgaaaaggaataaaattctgattcatgccacgggtacatactacaatatggttgaacctcagaaacattatgccaagtgaaagggctctgtattgtatgataccatgatatgaaacttttagaacaggcaaaaccttagatcagatcagtactttgcctgggtgtagggtggcagcatggagattggttttaaacaggcacagcggaacagtttgggtgatggaaatgttcctggtgatagttgtgtataaattgtatgaaaacgtgtgcaattgtgtacttaaaatggataattttcatgacatgcaaattatacctcaagaaagccactaaacgtgggtggccactcaaaatttcaaattctctttaagatgaccattcaggtcaggcatggtggctcactcctgtaatcccagcactttgggaggccaaggcaggcagagcacgaggtcaggagatcgagaccatcttggctgacacggtgaaaccccatctctactaaaagtacaaaacgttagatgggcgtggtggcgggcacggtggtgggcgcctgtagaggcaggagagaatggcgtgaacccgggaggcagagcttgcagtgagccaagatcacgccactgcactgtagcctgggtgacagagcaagactcc

SEQ ID NO: 38484 - DNA, 415 bp, Homo sapiens
aagtacttccacagacagtccactaggggggcagcactgtgtatgtggaagctttgcgtgtttgtgttccgggcacatgctttaagaaatctgtcagccccttgtgtgtaaatcttcatgcttatagagataacattctactgcctcttttatgaaggattggggagggaaaaatatttattttttggcatttagtagacgttatgtattttagtccttatgacaacactgtaaggaggcaaactcctcttagcttaaatgaataagaaaactgaagctctgccatgtaggaaaagttgtctcaggtctcaccaaagctcataagcaactaaactaagatttggagtcagatcttcctcaatccagagcacatgctccatcagtaacaccaggcaccatccacatagccatgagg

SEQ ID NO: 38485 - DNA, 512 bp, Homo sapiens
gtgatttctttccagattatcgagactcaagactttccagaacgtggcaaagagccctggaagaaatgtcccaggaacgccgcggtcaggaccgaggctccccggggccaggttcagggttcgaggtcccagcctcgcaactgctggcgtctggagggcgggagagtggccgggcccgaagctgcggctccgacgtacagttgcgagtctggggcggtgggccccgcagagctccgggggaagggagccgccgccgctgcggggaattggcttgggcaacgccgctgagtgttcaaacgtcgctgctcccgggccttgggcagcctctcctacctgacccaaattctgggctgcaaagcccgggcgaagttgtcgctttcactccgaatacgcccagtcgcaccgtcaacttcataggctgggcccggcagaggcctttcgcctccgcccagcggtctccgctgcggcccctcagcctctggagagccggggggcggccctcgccccggcag

SEQ ID NO: 38486 - DNA, 171 bp, Homo sapiens
tgtgcgtggttacacttgtagtcagcatgtctcagaacatgagccccacagcatactacctgggtattgctgctggttagtcagggcccaagggctcattagtcagcagatgatgaatcctacaacgacttggtttttccttcaaggcagtgggctcccttttgggcaagg

SEQ ID NO: 38487 - DNA, 481 bp, Homo sapiens
ttctactgatttttctgtgccacaggtcttgactcctgtaggctaaaattctcaagcctcttctgcctcaactgataatatgggaaaggtttggcccaaaggtgggtgaactggtggggagaaggatgagggaattcaggggattgctgagcccattctcctagacagtgctgctggcactggctctgtcttctccgtttccatctcgcatcagacggttcttccctctatgggcctagtcctacctagacacttttcagttggattccagttctggggatgctccgtcctgcagggatctaagtccttcccattgtcttcggctcctgggctcagctagaaccatcttttcccattgtccctgtggtgctagggctttcagtggttattaacgtctgtgttgtatcatcttgcctgaatttcagctctctgtaaccagttccccaaataaaattccccccatttacctacattctgtgag

SEQ ID NO: 38488 - DNA, 426 bp, Homo sapiens
tttttagcatgaagggctgttgaattttgttgaaggccttttctgcatctattgagataatcatgtggtttttgtctttggttctgtttatatgatggattacatttattgatttgcatatgttgaaccagccttgcatccaagggatgaagcccacttgattgtagtggataagctttttgatgtgctgctggattcggtttgccagtatttcactgaggatttttgcatcgatgttcatcagggatattggtctaatatcccttagactatgtgtattcttaaagctacagtgagtcttttgtagacagcatgctgttgggtcttgttttttaaatcaacttacatttgaagtaattattaataagtaaggacttactgttgtcattttgttaattattttctgactatttggtagtttattcc

SEQ ID NO: 38489 - DNA, 436 bp, Homo sapiens
tcatttgacatgcctctcagcgttaggaaagagatattaaaatgcagcgaataaacagccaacaggacagctgttattgcaaaaagaaccctggggtcctccaggtacacattttatttgctgtagtagaaaaattcccgttccttttcctagctaattgcttgcattagtgcctcctggttcttcccttgaatttactagaaatggaaattaagaaacgagtccagtcattgatcattggcctgtcaactttgtggacactcacccaggtgaatgaaaaacatcttgataagaacaacaaagtcaacagcaccaaaggcggtgcttttaaagcagttgttcttgtgatggtctttaagcagctgagaccagtagccctgtcgtctaattgtcgcatactttgtaaataaaacgattgcattcccattttgatttt

SEQ ID NO: 38490 - DNA, 886 bp, Homo sapiens
gtttcatttgtgtttttctcattcttacttgtttatattcttactgtatttgtacttgtagatacacacttttactatatatttttaatatttaaatagtggaaatatattaatgaatatgtgtatataatataaaggcaaatgaataagtgtaactaaatgaataaatattttcaaactttatgtaagttgtaagaggtattggtcatgctttttcattcattatgtttgtgagattcattcatgttgatgtgtgcagctgtagttcatctatttttactgctgtatgattgaacactattaatatgccaacgttatcactccatcttcctgatgatggatatttagattgttcctaattttttgaaccttcctgtctgtgtcttccagggtacatacataggaatggagtttctaggtattgggaatgcatatcttcaattttactagatcttgcttaattgctctccaaagttgccttccattgagagtatatccctttaagaactgtggcttcatggggcagtgtcagatcctccctgcctcctgcctggatctaaggccatgtctcctgcccaagacaattttggctttaaagttcacatactcttctatttctagtcactaacaattgtcttattttcttgcaagctcagttacgaacttgaagggagttttgttgtggtttatcttgcgtttctatatgtttttaaaaaggcaagttttggatttttgtgattgctttccctccctctcttcatctagtttgaggtggcacacacctataatcccagcactttgggaggccaaggcgggaggatcacttgatgtcaggagtttgagaccagcctggtcacaatagtgacataccatctctacaaaacca

SEQ ID NO: 38491 - DNA, 253 bp, Homo sapiens
tttacgactttctcgcttcctttctctccgttgcatcttggatgctgagaaagtaaaaattagttcagacaagaaaagtaaaatacctgcctggctactcatcacgctgggatagctgaaacagataaggcctgctgccatgttaacagcaacatacgttcttcccaaggacactctgccactgtagtgtcataacaacccacttttttgaaggggtctttcttttactcattcactgaaaaaccttgttttc

SEQ ID NO: 38492 - DNA, 350 bp, Homo sapiens
atcaagacatgctaaagattcccaaatttctttctccagcccaccctttctgaactgcagatgaggccaactgcctcctggacatcatcttgctgtcccatggcatcgcaaagttaagaaaccttaaacttaacccatgatcttggccatcagatctgtgactctatgtatattccttctttgttgaactgcaccttgtctcccaaactccaaattcagaattcccttttgccgttctctctctcataatcttcatggacaatcaatgaccaagctctattcattctacctcagttttttttcgataatcaaaatgaaaatacaaccacattagaatatttatgagaatc

SEQ ID NO: 38493 - DNA, 391 bp, Homo sapiens
ttttttttttttttggtagagaaagattttcaccatgttgcccaggctggtctcaagctcctggactcaagcagtctaccctccttggcctcccaaagtgtttagatcacaggcatgagccaccatgcctggccccaagtattactttcactgtaaacttttctccagtcattccctgcacccttgatctgggcaaaattaatgattatctgtttagtgctctttatacatctctcattataacttattatgctgtaatgtaattatttgtgtgtctctttccaaacaaaccatgagattcttatcaggacatatacctaccccacccctgcccagtgcctgttattattcctagtacaccgcaggagtaatgtatataaaattgctctac

SEQ ID NO: 38494 - DNA, 403 bp, Homo sapiens
ttttttttttttttggtagagaaagattttcaccatgttgcccaggctggtctcaagctcctggactcaagcagtctaccctccttggcctcccaaagtgtttagatcacaggcatgagccaccatgcctggccccaagtattactttcactgtaaacttttctccagtcattccctgcacccttgatctgggcaaaattaatgattatctgtttagtgctctttatacatctctcattataacttattatgctgtaatgtaattatttgtgtgtctctttccaaacaaaccatgagattcttatcaggacatatacctaccccacccctgcccagtgcctgttattattccgtcgacccggccgcgaatttagtaattgtagtcgacccgggaattccggac

SEQ ID NO: 38495 - DNA, 977 bp, Homo sapiens
ccctgtctcttaaaaaaaaaaggttcaaagagtgtcactgtcaatctgggcacctcccactagctcacctctcctgcaaagtcactgggctagcaaaagtccccactggaagcagatatgaaacatatcttacatgtgcagagctcactgtccttcccaagagctttcccttctgttatcccagggaaaccctcgtggtgaccttgcaggcacctggggcagagagccctccttcccttcactgctgagcagggttgccagatttagcagaaaaaaatctatttgttttctagctgaaactcaaatttaactgggtgttctagatttcatctgataactccactgttaaggaaacagaagcaaagttatctggggtcacaaaatctaggagagcctgatgtgagtttaagattctttatgcctggtctgggctttgtatcttgtaaggccacaggtttacatgtttcatgatagcatgtacctggcatgattgcagcacctgagcctgcaaacgtctttgtttaattccctgcagcaccaccttgcatgtaatcagctccatctgcaaagtatttggcaaaatcaacattcttctccttctgactttttccacattgtgcccagagccactaggagccttgtattagattgaactacatgaaatcaccatttgggggagataaaaaatagtcaaaagtcagcgcattttgtgtgtgtgtgattcaacctaaatgattgcccttgcttaggatttatttaaaaagtttgtcaaaagtgaacacaagccaggtacagtggcatgcacctgtacacctagctactcaggaggctgaggcagaaggatcacttgagcccagcggtatgagtccagcctggagaatatagtgagatctcatctcttaaaatgaaaagaagaaaacaaaaagtgagcacagtacgtgcttttgtgtctagatattttaaatctctttctgctg

SEQ ID NO: 38496 - DNA, 381 bp, Homo sapiens
tgaaagtgaaaactgtacagtcacaggcagcatagcagtgtttcactcagcaggggaccgtggatgtgatggtgatcctataagattatatcatattttgccaggcactgtggctcacgctgtaatcccagtactttgggaggccgaggcaggcggatcatgaggtcaggagttcgagaccagcctggccagcgtggtgaaatcctgtctctactaaaagtacaaaaattagctgggcgtggtggcgagcgtctgtaatcccagctactcgggagactgaggcaggagaatctcctgaacccagaaggcggaggttgcagtgagccgggatcgcgtcggctcactgcaacccagcctgggcaacaagcaaaaatctgtctt

SEQ ID NO: 38497 - DNA, 99 bp, Homo sapiens
taataatttatctttgagaacaagaagtttatttttcatttatcaagagcttaacatttccctcttaggaaaaatgctttgagggatacactatactca

SEQ ID NO: 38498 - DNA, 422 bp, Homo sapiens
gggtagaagagataatagtttattgacatcagcagatcataggattgtagctgggctgatgagaaatggtatagcaacgatagttgcaagtggccagagagaatgtgggttgcactgaagtacagtacagcacttgatcattgggcagtaggggatgggggaaggaaaactttggagaaacaaacagataatgcctgtcaggcaaaattaacatgtcatactttaaggtttgagtctgatcaagggagagtcaattctttttttttaaagatagaattatagaaatattggccagccatgtaatcccagctcacgcctgtaatcccagcaatttgggaggccgaggtgggaggattgcttgagcccaggagttcaagaccagcctgggtaatactagcaagatatcattgctagtagggaaa

SEQ ID NO: 38499 - DNA, 716 bp, Homo sapiens
gtttaccattaaccagaactctggaaatagatatttaatccccaaacagaggtgatggtgtgtctagaagcaatttaaagcctccatagcttgactagtcactttatcctgggcaactttttggattgtttggtaatctagaaacgagagagaacgctaattgcttcaacattaaagaaacccaccttctagactcactcgttcccccacccctcctttatgttttctttcttgttcctctaagaaatgaaatatagaagacgaaaatataaactggactacagcagggtgcagtggtgcatgcctgtaatcccagcactttgggaaggaggattgcctgaggccaggagtttgagaactggcctgggccacatagacctccttcctacaaaaaatttaaaaagtatatttaaaccagactagaaactttcaaccacaaaaatccatggggtcattgaggtgcaaatggaaagaccaggagcaaaagtagagggagcaaaagtagagggtggggacagtgtggaggtgaggacagtatggaggtggggacagggtatggaggtggagacaatgtatggaggtggaggcggtggctgagcagagcaggaaagctgctgggggctgtgaggagctaggtttggctgggtgacagcaagggctggacagaaagtgctttcagaaaagcccaaggataaagtccaaagagattaaaggtt

SEQ ID NO: 38500 - DNA, 476 bp, Homo sapiens
ctggagcagtgatagggtgactctttaccagcaatatgaggatcccatttgtttggatcatttgtaaaggtaacttttcccatttgtaactaaaaagttatctgtggagggatcctttgcagtcactcacaaagtgtgaataaaatatcctgttcccaataatctttaaaaaaatttaaaaagtatatttaaaccagactagaaactttcaaccacaaaaatccatggggtcattgaggtgcaaatggaaagaccaggagcaaaagtagagggagcaaaagtagagggtggggacagtgtggaggtgaggacagtatggaggtggagacaatgtatggaggtggaggcggtggctgagcagagcaggaaagctgctgggggctgtgaggagctaggtttggctgggtgacagcaagggctggacagaaagtgctttcagaaaagcccaaggataaagtccaaagagattaaaggtt

SEQ ID NO: 38501 - DNA, 5431 bp, Homo sapiens
atggagcaggcgggcaccagacctgcggcgacagagcatccacggctccggcggcccatgccctggctgctgctactgcctctcctgctgctgttgctgctgctgctacctggcccagcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcctggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcattccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgagccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 38502 - DNA, 2633 bp, Homo sapiens
caatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccaatactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcaccgccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttggtggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatggtaagcaaattttatggaatttga

SEQ ID NO: 38503 - DNA, 5475 bp, Homo sapiens
caatgccggcgttcgggaggcgcaacgtcggcggtcgctgagtatccagcccgcagcagtgacggccggcaggagcgtgctcttccccgcggctcgtgctctccaggagtccggagcatggtcctgggtcaccgttggtgtagcgtgttggtggaacgtggacgcctagagggaggatggtgggctgtggggtggcagttttatgtttgtgggtttcctgcggcgctgcagcgggacagctcgagtactcagtgccggaggagacggagcggggcgtagccgtaggcaatctctccgcggacttgaggctgccagcggccgctatgtcctcgcggaactttcgcttcctttccagccaccgcgagctctacttcggggtggatctacccagcggcaatttggtggtcagagagccggcggaccgcgaacagctgtgcagggccaaagctgcctgcgtcttgacctacgacctggtgctcgaggacccgctggagctgcacaagattcggattcacgtcctggacaccaatgacaactcacctctctttcctgccggcgacgtgcagctgcacatccccgagttcctgacgcccggagcccgctttactctcccgaatgcccaagatgacgacgagggaagcaatgggatactaagctacagcctaagccccagtcagcactttcgcctggacatgggatcgcgggttgacggcagcgaatacccggagttggtgttggagaaagcactggatcgcgaacagcgcgccacccacctgctggtgcttacagctcgggacggcgggctacctgcccgctcaggagacgcacaagtcaccatcattgtggtggacacaaatgacaacgcgcctgtatttgagcgctccgtataccgcaccaaggttccagagactgcacccaatgggactgtgttattccgagttcaagccttggatccagatgaagggtccaatggggaagtccaatactccctaagcaacagcacgcaagcagagctgcgacaccgctttcacgtgcaccctaaaagtggggaggtgcaagtagctgcttcactaggtccgcctgaaacgctcttggaggcatacattgaggcgagggacgaaggtgtctttggtttagctagcaccgctaaactgctggtggaggtgactgacgtgaacgatcatgcccccgaactggacttcctgactctttcgaacccagtacctgaggacgctgcccctggcacagtgattgctctctttagtgtaaaggatgaagacctcgattctaatggtagggtcatttgtggcatgtctagtgcaggcccttttcagctgacggcttcctttgacaactactacagcctgctgattgatgggcccctggaccgggagcagatcagtgaataccaagtcctgatcacggcctcagatagtggctcaccgccacttagcacccgaaggacaatcactgtgtcagttgctgatgtgaatgacaatacaccaaactttcctcaaccccagcaggaacttttcgttgctgaaaacaatggccctggggcctctctaggccgagtgtttgcccaggaccccgacctggggaagaatggccttgtctcttatgagctgttggatgttatctctgaagggccatcagcctctagcttggtggcagtggaatcatccagtggggccatcactgccaaaacttcctttgactttgagcagctcagggggtttcatttccaagtagaaggccgggatggtggcattcctcccagaagtgcaacagtgactataaacttgtttgtggtagataggaatgacaattatccggttatcttgtttcccttgcccagaaatggttctgtcccagtggaaattgtgccccgctctgccaggactggacacttggtcacaaaagtggtagcagaggatgctgacagtggttctaatgcctggctttcctaccacatctcccgggcgtctgactctagtctctttagaatttcagccaatataggtgagctccgtactgctcgcttagttcttcccactgatgcagttaagcagagggtggtggtagtggttcgggaccatggagacccaccactttcctcctctgtcactctgggtgtgctgttgagcaactctgtccctcagttacttccagactttgaagatgtctgggaaccaggagggcagctttctgcccagaacttgtatttagtaattgccttggcttgtatttcctttttatttctggggtgcttacttttcttcgtgtgtaccaagttgcaccagagcccaggctgttgcgctcagagctgctgtcgctctacagaggatctgaggtatggaagtaagatggtttcaaatccttgcatgacatcagccaccatagatgtcactacagttgagagactttctcagacttatctctatcgggcctctctgggacttggttctgataataacagtttgctgttgcgtggggagtacaatgctgccgacctgcgaaatcttgccactggggtaggactgaatttgccaatatcctgtattcagattcggaataggaaaggggatcacgctaatgtcaatgccatgccacgacagcccaaccctgactggcgttactctgcctccctgagagcaggcatgcacagctctgtgcacctagaggaggctggcattctacgggctggtccaggagggcctgatcagcagtggccaacagtatccagtgcaacaccagaaccagaggcaggagaagtgtcccctccagtcggtgcgggtgtcaacagcaacagctggacctttaaatacggaccaggcaaccccaaacaatccggtcccggtgagttgcccgacaaattcattatcccaggatctcctgcaatcatctccatccggcaggagcctactaacagccaaattgacaaaagtgacttcataaccttcggcaaaaaggaggagaccaagaaaaagaagaaaaagaagaagggtaacaagacccaggagaaaaaagagaaagggaacagcacgactgacaacagtgaccagtgaggtcctcaaatggaaacaagccacttagccagtttttgtaataatggcaaatctctcccatgtagcaattccctgctcctttttcctatctacatgagccctcttagagacctcagaaatctgcagaaagttccctgtgtctgtctagaacgcatttaacaggttttgtcgtaaaagctttactaagtctggtgttaactctttctctccactctggcttgttttcagaacctaaaaagcagacccaagtttcctttctcctccgccgcaaaggagaggcttcccagccccgccagtgagaggttggactctctgccctgtgctccggggatcctgtcttgatgacacttgcagggcaggctgaaaagttttgagattgagcagcttgggagtttgtggccactgggtatgtgtggctaccgcgggtatgcgagtgccagatattggctgagacgagccagcttagactaattggtacaaggaaggcaagaaaacaaagacaaataaacagcggaagttatcagtatggaggggaagtgtaaacttaaagggaccagactttctaaatcttacaactcaagaggtggcagccaccctctaggagacaaaactacccccactgacaaggctttaggagaccctaaagtctgttggctgtgacgtcattatacctaaaatctgcatcatacctgcaagccaacagttcagtgttttaacagagaaccaccctgggaaacagaagcagatctgatgtgtttcctatacatgtcctgtgctcactttattaaaaattcttttgcacacaatgtttatgaaaaggccagatccttttccaatacttatgcaaaagcaaaagaaaaccccgacacctcacctttcgctgtttgttgtttcatagatttatttaaaaaaagagaaagtctatagctataaatctttaaagagaaatatgaatacaattcccctaaactctcctcaaaagagaattcagtctacagccatttaaatgatcattgctgctacagaagtgctttaagagaattgcctgaaacatctgtattatatcggccacctgccaatcacagctttactctttcaggtcactctggggctgcctcttgcatgtattactaaataaaatgatctctctttctctctctctctctcttttctaagaaacaattatgtgcactttgatacacaaccttctctaaccaactatatatcaagacccaaaaattgaagaaaaatattgttttctcatacagtgagcagatttttcaatctactaattctgtgacttgtcttggtgtgctagcctacaccttctctttggtttagttttccttttctataacactctgaattgctaatcttactaacacctatgatgttacctgaaatcaatctcccatatgtatgctgtatgctatgctaagactcctgaaatatacttactctgtgcttgtgtatgtgaatgttaatgcaactattacctagagtgaactttaagctttattgttgaatgtaattccattatatttccttttgtacacctgtgaaaaagtggagtagtgtttttttaaccattgttaatcagcttttgtgtatgaaagacacagtaaaatttctttcttaaatcaagatactggtgattcaaggaattttatttatggtccagccaagagccatctcgtgccaagacttctgctggcaagggaatggataaagctgttttgttctagtaacaattttggaatgaatactgacaatattccatgagggtgtgcaagcacaaattttaccaatctgacctctttgaagttgcagaatgctttgaaattctaatggtatctgaaatatcagctcatagaaagtaacaaaatttgctgtcaccttaaataagacattttaattttgttataatgtacaatttagaagtttgattaattatattatctatttaggcattaatataaaagaggtaggagtctgttatttaaaaaaagcattaaatttaaaaaaaaactgtcttgtctacttttagcttcattctcccatattttgaagggtgtgtaacttcagctctgcaggattgcatggggtaaaacttgttaccaacacatgtgaaccattgctacattgtaggttgtgatcattttgccccactgaagcccatgtatctgaccttacgtgccttttgaactaggagaatcgggctaatttattaatgatgataattataatgtatctgtacagcactttttacatttgcgaagtgctttccaatccatgttagttactagttattacagctgtaaggataaaacacgtcatgtggattcattttgaattggtgctattggtatttcctctgttattgctaataaatgaaaatggtggtatg

SEQ ID NO: 38504 - DNA, 2655 bp, Homo sapiens
atggagcaggcgggcaccagacctgcggcgacagagcatccacggctccggcggcccatgccctggctgctgctactgcctctcctgctgctgttgctgctgctgctacctggcccagcggcctcccagctgcgatactctgtgccagaggagcaggcacccggcgcgctcgtgggcaacgtggctcgcgcgctggggcttgagctgcggcgcttggggccgggttgcttgcgcatcaaccatctgggtgcgcccagtccgcgctacctggagctggacctgacgagtggagcgctcttcgtcaacgagcgcattgatcgggaggcgctgtgtgagcagcggcctcgctgcctgctcagcctggaagtgctggcgcacaaccccgtggcggtgagcgccgttgaggtggaaatattggacatcaacgacaactcaccgcgtttcccgcggcccaactaccagcttcaggtaagcgaatcggtggcgcctggagcgcgctttcacatagagagtgcgcaggaccccgacgtgggcgccaactcagtacagacctacgagctcagccccagcgagcacttcgagctggaccttaagcccctgcaggagaacagtaaagtgcttgagctggtgctgcgtaagggcctagaccgggagcaggcagccttgcaccacctggttctcacagccgtggatgggggcattccagcccgctcgggtacggcacagatctctgtgcgtgtcctggacactaacgacaactctcctgcctttgaccagtccacttatcgcgtccagctacgggaggactcacccccaggcacattggtggtgaagctgaatgcctcagacccggatgagggctccaatggtgagctcaggtactccttgagcagctacacgtcggaccgggagaggcagctcttcagcatagatgccagtaccggggaagtgcgagtaattggggggctggattatgaggaagcctcctcctaccagatctatgtgcaggcgactgaccggggtccagtgcccatggcaggtcactgcaaggtgctggtggacatcgtggacgtgaatgacaatgccccagaggtggtgctcacggacctgtatagcccagtgcctgagaatgctacacccaacaccattgtggccgttctcagtgtcaatgaccaagactcaggccccaaccggaaagtgagcctgggtctggaggccacactgcctttccgactgaatggctttggaaactcctatacactggtggtgagcggcccactggaccgagagcgggtggctgtctacaacatcacggtgacagccacagatgggggaataccgcagctcacatccctgcgtacactgaaggttgagatctctgacatcaatgacaatccaccaagcttcctggaggactcctattccatctacatacaggagaacaatttgccaggtgtgttgctctgtactgtgcaagccacagacccagatgaaaaggagaatgcagaggtgacctactcccttctggagagggagattcaagggctgccagtcacctcctatgtctccattaacagtgccagtggcagcctttatgctgtcaactcctttgactatgagaagtttcgggagttctttgtgactgtggaggctcaggacaaggggagcccaccactgagcagcactgtgactgccaacgtatatgtggtggacatgaatgaccatgcccctcacattctgtaccctacctcaaccaactcgtcagcagccttcgagatggtgcctcgaactgcccctgctggctacctggtcaccaaagtcatagctatggactcagactctgggcaaaatgcttggcttttttaccatctagcccagacttctgacctggacctctttaaggtagagctgcacacaggagaaattaggactaccaggaagatgggagatgagagtggtagcactttcaacctgaccgtggtggtccgagataatggagagccatcactatcagcctctgtggccattacagtagctgtggtggatagggtttccaaaatcctccctgacactcagaggcatgttaagagccctcggacatactctgaaattaccctttatctaataatagcattaagcacagtgtcttttatatttcttttgacaatcatcattttgagcatcatcaagtgctaccgctacactgcgtatggcactgcatgctgtggaggcttctgtggagtaagggaaaggtcccctgcagaactgtacaaacaagccaacaacaatattgatgccaggataccgcatggcctcaaagtgcagcctcacttcattgaagttcgagggaatggctccctcaccaagacctactgctacaaggcctgtctgacagcaggctcagggagtgacactttcatgttttacaatacaggggcccagacaggaccagggccttcgggagcccaagcagcagtgactgacagcaggaatctcacaggccaaagtggtcagaatgctgggaacctgattattctcaaaaatgaggctgtttctcaaaatgaggtgagacagtggtcagggggtcttctacaaactcatgcatttgttacacatcccccaatatcctgtgatttggctttattgagtcattaa

SEQ ID NO: 38505 - DNA, 1068 bp, Homo sapiens
ggcggtggtgagcgcgctggagcccgcgtggagaacatgcggcggggatgggagtgcgcctagtctcgaggcgggagagccagccgccctgcagccggccgtcggccccgcagccacagccgagccccgctgcggagctcccggcggcccagccccgaggctctgcggccgcgccgcgcgtccctaccaaccgacaccatgaacaccatcgtcttcaacaagctcagcggtgcggtgctgtttgaggacggaggcgcctcggagcgggagcggggtggccggccctacagcggtgtcctggacagtcctcacgcccgccccgaggtgggcattcccgacggcccgcccctcaaggacaacctcggcctgagacaccggaggaccggcgcccggcagaatggcgggaaggtgaggcacaagcggcaggccctgcaagacatggcgcgacccctcaagcagtggctttacaagcaccgtgacaacccgtaccccaccaagaccgagaagatactcttggccctcggctcgcagatgacgctagtgcaggtgtcaaattggtttgctaatgcaagacgtcggcttaagaataccgttcgacagccagatttaagctgggctttgagaataaagttatacaacaagtatgttcaaggcaatgctgaacggcttagcgtaagcagtgatgactcatgttctgaagatggagaaaatcctccaagaacccacatgaacgaagggggctataataccccagttcaccatcctgtgattaaaagtgagaattcggtcatcaaagcgggagtgaggccagagtcacgggccagtgaggactacgtggcaccccccaaatacaagagcagcttgttgaaccgttaccttaatgactctttgagacatgtcatggccacgaacactaccatgatgggaaaaacaaggcaaagaaaccactcgggatcttttagctccaatgaatttgaggaagaattagtgtctccatcgtcatcagaaactgaaggcaactttgtctatcgcacaggtaagtccgtgctttctgtagtaattcctgcg

SEQ ID NO: 38506 - DNA, 503 bp, Homo sapiens
ttttttaaaggcaaatgacagagaggaatcaactagccatggcaaacagaaatacagcaattctccatcatctccctgctccagtcagactgttctcacaatttatttcagacagatgaagatgtgcttctgtgtagctgggagcagtcaattaaagagattaaaggcagaaaggctgctacagcaaaagtatttaagttttagtttcttctgcagctgtgctttctccactttctcagcaatcagaatttccttaccctctgttctttgtctgttggaattcaacagaagctatttattttctcctataggttttttaaaaagagatcctagggccatagatttttattttcagtgtttatgccatgtatgccatctaagcataggagtgctatatttagtttaaactttagcatgcctaaagaactcattcctttatccccaattttaggacaggcaaatcaaagttaagagttcacgtaaaattaaacactgtaggttag

SEQ ID NO: 38507 - DNA, 371 bp, Homo sapiens
gtggggatgggcctccagcttgcctccagcctgaaaaaatagtagagggtgttgaggctgggaagggaggtggggctcatgttgtacagggcctgagccagggagcttgggcttcattctgagtactgtggcagccctgggaaggtttgtagcacagagggatattgtcatttttggaaagatccctttggctgcttaggtagagaagggcttcaagagggcaggaagggacaggactacagaaggggctgcttcagagtccagattaaggaaggagaggcctgggcagtcagaaaggaagagaagccggatgtggtggcttgtatcttcaatcccagcactttgagaggccaaggtgggaggatcacttg

SEQ ID NO: 38508 - DNA, 414 bp, Homo sapiens
gccacctgcaataaattgcagctggctgtttccacagcctctggaagggaagatggaaggacagaggagagtgaaaagaaagaaggctgtcatacagagaagagaggctacaacttgaaattttatactgaaagatgatctggtttatgaacatgatgatgatgtgtgtagtgaattttttctagtgtatatgccaaggcaatattattctcttgactatgggattcattaagtctgttgtatctgtcatccatgcttatccacatgtcaaggaagtgaattaatttcagcattcccaagatagaagtgatagtatatggtaatttacttacagcttataataatgagtgtcattatttgattaaatggatattactaattaatgggagttgccatgtcactattgtaatgtta

SEQ ID NO: 38509 - DNA, 585 bp, Homo sapiens
aattgaatatgtaatttatgtacatggttcaaaattcaaatgataacagagattcttggtgaaaagaaatcatgtgcaccctccgtgggaggaattgctgacaccagcttcttgtgtctttacagtctgtccatatatgagcttacacatgcatttgtttcccaaatgattacacggtatacactgtttgcaccttgctttttacactgaacagtgtatcttgatttatcgccgagtgttcacattagcacacataaaactgcctcgtccattttaatggttgcatgatattccattagatagctgtgtcatattctatttaaccagtgatttattaatacatatttaatttattttcaactgttatgtatgttttactgtacctataggataaattacaaaagtggagtttctagatctaaggctaggttactttttaatttgacagacatttccaaattgctcttcataaagggttgaagtcagtgcatacgtgaggactctgtgagtgtgcaggcggccctgtacctctgcaggttcttcacctgagtcaagcaactgtgggttgaaagtattcaaaaaaag

SEQ ID NO: 38510 - DNA, 307 bp, Homo sapiens
tcacaaaatttattaatttgattaatcttttcaaagttgggctgaaagaagatatcttgtcttgtttgttcattttctatgcattgaactataccataaattttgtcatatccttccttctgcttattttaggtttcatttgttcttctttttctcatttcttcaggtatatgcttaagtcattaattttagaactttcttcttttttaatataattattaaatgctataaatttccccctaagaactgctttagctatggttaatgaggttttgatgttttcattttcatttgattcaaaaaaaat

SEQ ID NO: 38511 - DNA, 2649 bp, Homo sapiens
  misc_feature (625)..(625): n is a, c, g, or t
aaggacaattagtcactagcgagacccagtaggaagagaggtttaaatcagagggattgaatgagggtgctttgtgccttccctgaagccatgccctccagcaactcccgcccccccgcgtgcctagccccgggggctctctacttggctctgttgctccatctctccctttcctcccaggctggagacaggagacccttgcctgtagacagagctgcaggtttgaaggaaaagaccctgattctacttgatgtgagcaccaagaacccagtcaggacagtcaatgagaacttcctctctctgcagctggatccgtccatcattcatgatggctggctcgatttcctaagctccaagcgcttggtgaccctggcccggggactttcgcccgcctttctgcgcttcgggggcaaaaggaccgacttcctgcagttccagaacctgaggaacccggcgaaaagccgcgggggcccgggcccggattactatctcaaaaactatgaggatgacattgttcgaagtgatgttgccttagataaacagaaaggctgcaagattgcccagcaccctgatgttatgctggagctccaaagggagaaggcagctcagatgcatctggttcttntaaaggagcaattctccaatacttacagtaatctcatattaacagagccaaataactatcggaccatgcatggccgggcagtaaatggcagccagttgggaaaggattacatccagctgaagagcctgttgcagcccatccggatttattccagagccagcttatatggccctaatattgggcggccgaggaagaatgtcatcgccctcctagatggattcatgaaggtggcaggaagtacagtagatgcagttacctggcaacattgctacattgatggccgggtggtcaaggtgatggacttcctgaaaactcgcctgttagacacactctctgaccagattaggaaaattcagaaagtggttaatacatacactccaggaaagaagatttggcttgaaggtgtggtgaccacctcagctggaggcacaaacaatctatccgattcctatgctgcaggattcttatggttgaacactttaggaatgctggccaatcagggcattgatgtcgtgatacggcactcattttttgaccatggatacaatcacctcgtggaccagaattttaacccattaccagactactggctctctctcctctacaagcgcctgatcggccccaaagtcttggctgtgcatgtggctgggctccagcggaagccacggcctggccgagtgatccgggacaaactaaggatttatgctcactgcacaaaccaccacaaccacaactacgttcgtgggtccattacactttttatcatcaacttgcatcgatcaagaaagaaaatcaagctggctgggactctcagagacaagctggttcaccagtacctgctgcagccctatgggcaggagggcctaaagtccaagtcagtgcaactgaatggccagcccttagtgatggtggacgacgggaccctcccagaattgaagccccgcccccttcgggccggccggacattggtcatccctccagtcaccatgggcttttttgtggtcaagaatgtcaatgctttggcctgccgctaccgataagctatcctcacactcatggctaccagtgggcctgctgggctgcttccactcctccactccagtagtatcctctgttttcagacatcctagcaaccagcccctgctgccccatcctgctggaatcaacacagacttgctctccaaagagactaaatgtcatagcgtgatcttagcctaggtaggccacatccatcccaaaggaaaatgtagacatcacctgtacctatataaggataaaggcatgtgtatagagcaaatgtttcccttcatgtgcactatgaaaacgagctgacagcacactcccaggagaaatgtttccagacaactccccatgatcctgtcacacagcattataaccacaaatccaaaccttagcctgctgctgctgctgccctcagaggaagatgaggaaggaaaaaaactgggtggacctacaaaaacccatcctctcccaactccttcttctctgcctctttcttgctgctgccctgagttttttgacacatctctttccataggggagtaatgggtgtgtcagccctggcctgctgggagagctgtttgtatgatttcccggctgatgtatgagcgtgcgcatctgggttcctgacagtggcatccatcactggcagttcttctgggaagcgggtgcttcaaaagtaaaattacaatcacactccagatttggtaagaaggttctattcctctgtgaatccagattcccccagagttgtaatgggagtcaagtaacaatattcattgagtggagagcagtttattaggcacaacaaaaagtagtcatcattcttcatgttgctatgagggagagtttgagtacaaagagaaagcatactgaaacatcaggtacacacacacaccccaactggacaaagcaaattagacctctccaaaattaagagaatattaggggctctatagggtaagcccttaattgtttggttaactcaaatcattatttttaaa

SEQ ID NO: 38512 - DNA, 2487 bp, Homo sapiens
aaggacaattagtcactagcgagacccagtaggaagagaggtttaaatcagagggattgaatgagggtgctttgtgccttccctgaagccatgccctccagcaactcccgcccccccgcgtgcctagccccgggggctctctacttggctctgttgctccatctctccctttcctcccaggctggagacaggagacccttgcctgtagacagagctgcaggtttgaaggaaaagaccctgattctacttgatgtgagcaccaagaacccagtcaggacagtcaatgagaacttcctctctctgcagctggatccgtccatcattcatgatggctggctcgatttcctaagctccaagcgcttggtgaccctggcccggggactttcgcccgcctttctgcgcttcgggggcaaaaggaccgacttcctgcagttccagaacctgaggaacccggcgaaaagccgcgggggcccgggcccggattactatctcaaaaactatgaggatgagccaaataactatcggaccatgcatggccgggcagtaaatggcagccagttgggaaaggattacatccagctgaagagcctgttgcagcccatccggatttattccagagccagcttatatggccctaatattgggcggccgaggaagaatgtcatcgccctcctagatggattcatgaaggtggcaggaagtacagtagatgcagttacctggcaacattgctacattgatggccgggtggtcaaggtgatggacttcctgaaaactcgcctgttagacacactctctgaccagattaggaaaattcagaaagtggttaatacatacactccaggaaagaagatttggcttgaaggtgtggtgaccacctcagctggaggcacaaacaatctatccgattcctatgctgcaggattcttatggttgaacactttaggaatgctggccaatcagggcattgatgtcgtgatacggcactcattttttgaccatggatacaatcacctcgtggaccagaattttaacccattaccagactactggctctctctcctctacaagcgcctgatcggccccaaagtcttggctgtgcatgtggctgggctccagcggaagccacggcctggccgagtgatccgggacaaactaaggatttatgctcactgcacaaaccaccacaaccacaactacgttcgtgggtccattacactttttatcatcaacttgcatcgatcaagaaagaaaatcaagctggctgggactctcagagacaagctggttcaccagtacctgctgcagccctatgggcaggagggcctaaagtccaagtcagtgcaactgaatggccagcccttagtgatggtggacgacgggaccctcccagaattgaagccccgcccccttcgggccggccggacattggtcatccctccagtcaccatgggcttttttgtggtcaagaatgtcaatgctttggcctgccgctaccgataagctatcctcacactcatggctaccagtgggcctgctgggctgcttccactcctccactccagtagtatcctctgttttcagacatcctagcaaccagcccctgctgccccatcctgctggaatcaacacagacttgctctccaaagagactaaatgtcatagcgtgatcttagcctaggtaggccacatccatcccaaaggaaaatgtagacatcacctgtacctatataaggataaaggcatgtgtatagagcaaatgtttcccttcatgtgcactatgaaaacgagctgacagcacactcccaggagaaatgtttccagacaactccccatgatcctgtcacacagcattataaccacaaatccaaaccttagcctgctgctgctgctgccctcagaggaagatgaggaaggaaaaaaactgggtggacctacaaaaacccatcctctcccaactccttcttctctgcctctttcttgctgctgccctgagttttttgacacatctctttccataggggagtaatgggtgtgtcagccctggcctgctgggagagctgtttgtatgatttcccggctgatgtatgagcgtgcgcatctgggttcctgacagtggcatccatcactggcagttcttctgggaagcgggtgcttcaaaagtaaaattacaatcacactccagatttggtaagaaggttctattcctctgtgaatccagattcccccagagttgtaatgggagtcaagtaacaatattcattgagtggagagcagtttattaggcacaacaaaaagtagtcatcattcttcatgttgctatgagggagagtttgagtacaaagagaaagcatactgaaacatcaggtacacacacacaccccaactggacaaagcaaattagacctctccaaaattaagagaatattaggggctctatagggtaagcccttaattgtttggttaactcaaatcattatttttaaa

SEQ ID NO: 38513 - DNA, 2823 bp, Homo sapiens
  misc_feature (625)..(625): n is a, c, g, or t
aaggacaattagtcactagcgagacccagtaggaagagaggtttaaatcagagggattgaatgagggtgctttgtgccttccctgaagccatgccctccagcaactcccgcccccccgcgtgcctagccccgggggctctctacttggctctgttgctccatctctccctttcctcccaggctggagacaggagacccttgcctgtagacagagctgcaggtttgaaggaaaagaccctgattctacttgatgtgagcaccaagaacccagtcaggacagtcaatgagaacttcctctctctgcagctggatccgtccatcattcatgatggctggctcgatttcctaagctccaagcgcttggtgaccctggcccggggactttcgcccgcctttctgcgcttcgggggcaaaaggaccgacttcctgcagttccagaacctgaggaacccggcgaaaagccgcgggggcccgggcccggattactatctcaaaaactatgaggatgacattgttcgaagtgatgttgccttagataaacagaaaggctgcaagattgcccagcaccctgatgttatgctggagctccaaagggagaaggcagctcagatgcatctggttcttntaaaggagcaattctccaatacttacagtaatctcatattaacagccaggtctctagacaaactttataactttgctgattgctctggactccacctgatatttgctctaaatgcactgcgtcgtaatcccaataactcctggaacagttctagtgccctgagtctgttgaagtacagcgccagcaaaaagtacaacatttcttgggaactgggtaatgagccaaataactatcggaccatgcatggccgggcagtaaatggcagccagttgggaaaggattacatccagctgaagagcctgttgcagcccatccggatttattccagagccagcttatatggccctaatattgggcggccgaggaagaatgtcatcgccctcctagatggattcatgaaggtggcaggaagtacagtagatgcagttacctggcaacattgctacattgatggccgggtggtcaaggtgatggacttcctgaaaactcgcctgttagacacactctctgaccagattaggaaaattcagaaagtggttaatacatacactccaggaaagaagatttggcttgaaggtgtggtgaccacctcagctggaggcacaaacaatctatccgattcctatgctgcaggattcttatggttgaacactttaggaatgctggccaatcagggcattgatgtcgtgatacggcactcattttttgaccatggatacaatcacctcgtggaccagaattttaacccattaccagactactggctctctctcctctacaagcgcctgatcggccccaaagtcttggctgtgcatgtggctgggctccagcggaagccacggcctggccgagtgatccgggacaaactaaggatttatgctcactgcacaaaccaccacaaccacaactacgttcgtgggtccattacactttttatcatcaacttgcatcgatcaagaaagaaaatcaagctggctgggactctcagagacaagctggttcaccagtacctgctgcagccctatgggcaggagggcctaaagtccaagtcagtgcaactgaatggccagcccttagtgatggtggacgacgggaccctcccagaattgaagccccgcccccttcgggccggccggacattggtcatccctccagtcaccatgggcttttttgtggtcaagaatgtcaatgctttggcctgccgctaccgataagctatcctcacactcatggctaccagtgggcctgctgggctgcttccactcctccactccagtagtatcctctgttttcagacatcctagcaaccagcccctgctgccccatcctgctggaatcaacacagacttgctctccaaagagactaaatgtcatagcgtgatcttagcctaggtaggccacatccatcccaaaggaaaatgtagacatcacctgtacctatataaggataaaggcatgtgtatagagcaaatgtttcccttcatgtgcactatgaaaacgagctgacagcacactcccaggagaaatgtttccagacaactccccatgatcctgtcacacagcattataaccacaaatccaaaccttagcctgctgctgctgctgccctcagaggaagatgaggaaggaaaaaaactgggtggacctacaaaaacccatcctctcccaactccttcttctctgcctctttcttgctgctgccctgagttttttgacacatctctttccataggggagtaatgggtgtgtcagccctggcctgctgggagagctgtttgtatgatttcccggctgatgtatgagcgtgcgcatctgggttcctgacagtggcatccatcactggcagttcttctgggaagcgggtgcttcaaaagtaaaattacaatcacactccagatttggtaagaaggttctattcctctgtgaatccagattcccccagagttgtaatgggagtcaagtaacaatattcattgagtggagagcagtttattaggcacaacaaaaagtagtcatcattcttcatgttgctatgagggagagtttgagtacaaagagaaagcatactgaaacatcaggtacacacacacaccccaactggacaaagcaaattagacctctccaaaattaagagaatattaggggctctatagggtaagcccttaattgtttggttaactcaaatcattatttttaaa

SEQ ID NO: 38514 - DNA, 377 bp, Homo sapiens
ctggtctttgaactcagactgaaacttacactattgggttctctcctacttggtaggtgatgattggactttataaatatcagtttttttcctttaaaaggtgctattaaaacattaaaattaaatccatagattaaaatactcagaatacctaggtcagacaaagtacttgcaactagaatatataaggaacacttaaaacttgataaaaagaataaaaaggacctccccaaaatggcaaaatatttcatatcatttttcagaagacataagtggccaataagcatgtacaaatatgttcaataaaattattcatcgggaaaagcaattaaaaccacaatgagattctgctacatctttactaagactaaatttgc

SEQ ID NO: 38515 - DNA, 435 bp, Homo sapiens
gagcattgcttgaacctgggaggcggaggttgcagtgagccaagactgtgccactgtactccagcctgggtgacagagcgagacgctgtctcaaaaaataaatgaaacaaacttaacattcatactttttatgtcaatagagttgaagttgcctttaactgtggtgaaataacataatatgaaatttacaattttaaccatttttaagtgtacaattcagtggcattaagtacattcatggtgttgtgtaaccatcatcactgtgtatttccagaactgttttattactccaaacagaaaccctgtacctattaaataataactcttcatttcccccttctccctactgctggtaacctcaattctattttctgtctctttgaatttgcctattctaggaacataaatatgtgtggaatcatgcaatctgtgttt

SEQ ID NO: 38516 - DNA, 598 bp, Homo sapiens
gatctgttatgggttgaattttctcctgcccaaattcttatgttgaagtccttacccctgatgggactagatttgtagacagggcctttaaggaggtgattagcgtagtgaggtcaccaggtgggccctgatgcaatctggcatcctcctaagaggacatgaggacacagacacatacagagggacgatcgtgtgaggacacagaggatggcatctgcacgccaaggagagaggcctcaggaggaaccagccctgcccacaccttgatctgggacttccagcctccagggttgtgagagagaaatgtctgttgtttaagccatgcagtctatggtgctttgttatggcagctccagcaagctaacctgggatctaaaatgatacttaaactggttcagtctgattcttaaactggttcagtggagctaggccaggctccctctgagcagatgttggtccctttgcaggcctgctgtgtgtgatgattgctaaccaggttatgacagtgatctttaagtaagtgggaatcttgtgagttttgaggttttgtttttttttttaatgaaatctacatgggatgtttcaaaaatagcagcct

SEQ ID NO: 38517 - DNA, 601 bp, Homo sapiens
atcctagcatctaggatcaggcctctcagcctcctccacacacagtggggctgattggcttagcctgggtttaaatccagctccttgtcacttcccaactagaaagacgcagtaacatgcaccccctcatgtggttgcctttagcatgtgataaatgaggaatgaaacgacaggacacgctgctccctgggcatcctgcctggcagagaacaaatgcttaataaatgccagccattacgactgccatcactagctacttcttctcttaaaagaaattcctgtgcaggcatggtggctcacacctgtaatctcagcactttgggaggccaaggtgggcggattgctttagcccaggagttcacaaccagcctggtcaacatagagaaaccctgcctctacaaaaaatacaaaattagctgggcctgctggtcccagctactgaggaggctgaggtgggagaattgcttgagcccaggaggtggaggttgcagtgagccaacatcatgccactgtattccagcctgggtgacagagagagaccctgtctcaaaaaaaaaaaaaaaaaaaaaaagaaagaaagaaagaaagaaagaaagaaaga

SEQ ID NO: 38518 - DNA, 378 bp, Homo sapiens
aaaaagtctgtacatgttcagtatatacctaaccatcatagacctaatcacatagtacatgatcagagggtggtcgaatctgaggatacagaaactccaagtatggagggctgactgtaatacatcattggatgatagataaagaaaatgtgtaatatccatccagtggaatataattctaccataaatacaaagtggggatgcgtgctacaacatggatgtgacttgagaaacctataatgaagccagtcacataccacatggcatgattctgattatatggaagtccataataggaaaatctatagagaccgaaagattgctgcttatcaagggctggggactggcagaagaagatgggaggataggagattgaca

SEQ ID NO: 38519 - DNA, 447 bp, Homo sapiens
gagccaaatggtgggggcaggggtagggggaagattcctttctccagcatgtaacagcattatgggagtgaattcagagcttctgtgtgttctgagccaagtgcctgctggaatgtggactgtaaatctctcatcgtcctcttcactgacccacaagcaacccctgctcctcccatctgcttcccgaccacctgcctttcagtttttctttatataaaaaacgttttccattctcctaccttcctctctgtctacctttgtatggtacatctcatccctcttctaaatatttccatctgaccacatttttccctaatgagacaggctcacaataggataaagtgtaacatttattcatttatctgctcagcaaatattattgagcacatactttgtcctaggcaccactttagttcttgagtggtcagcagtaaagaaaacagacaa

SEQ ID NO: 38520 - DNA, 288 bp, Homo sapiens
gtggatacatagtaggtatatatatatatttatgaggtatatgagatgttttgttacaatcatgtgatataaaataatcatcatggagaatgagttatccatcccctgaagcataaataaatgtaaattctgatgttgaatttatacaccaaattgttagattttagattttatcctcattttactttgcttattttcttatatactggtaagatcttatagatgctgtaatatagtaaaatgtagaatgtatgccataaaattaacctgaattagagtatttttgca

SEQ ID NO: 38521 - DNA, 366 bp, Homo sapiens
gttagtgtccacataagatccatcaaaaattaaatttaaatctaatagcctttggatttacgagagttgagatagcgtcttgctaaagaatagaacaagttatggattgaatgcttgaaattacagttcaggtaagctttacaagaatattatttattctgcactaactgcagcaagtagaagccttccacattagcataagataacatggtggctcccagaaagcatagtagtctgatcatactagttcaaactaaaagtctgaatgactttctggctgaaatttatcagctttcagagtagtacatgggatgcaagctattttttccctcccttctccaaagtcaccattgagtgaataatctg

SEQ ID NO: 38522 - DNA, 527 bp, Homo sapiens
atctattcctctgggcacactgacttccccatctttaatctaaatctttctcctaagctccagtcctacagctccacttgatagtcacttcaaactcaaaaacagcaacagtcctgccggcttctcaccctggctccagttcatagccatctgcctacttgacattgcttccaggacttttaatgggcatctcagacttatacccaaaatggaatttgctttgccctgtcttctgccactcacagtcagctcctcttctagtctccccagtttggggatgacactacaattcacccacttgctcaggccacaaactcaggagtcatccagtgctgctgcattcacttatgcaggttgagtccttcacaaggatgcctggccacagggccaacacgggttaccagcccacgctcttcccaccaaggtgtcctagcacccaggtacatgtgctgggaggaagggagcttctttacccagtggtgctgagaagtgcttctgcttctggccagagacagaattagcttttt

SEQ ID NO: 38523 - DNA, 644 bp, Homo sapiens
aactgacattaataccaatgttagaaaagaagaaaatttcaaacttgattaattaaatgtctgacttcagaagttaggaaaaaaaatacgaaatgatgctgaaaaaagtagaaggaaagaggaataaaggtaaaagccataattaatgaagtagagatccaagatacaaaagaaaggacaagccaaaattagttctttgaaaagcctaatgtaacatgtttagtggatatagattacaacaaaattaattatgtgcttatgtatcagcaaccaacaattagaaaatgtaattataaaaaagacagatacagagaaagatcaatgaaaccaaaagctatttccttgaaaagatcattaaaattgggccgggcgcggtggctcatgcctgtaatcgcagcactttaggaggccgaggcaggcacatcacaaggtcaggagatggataccatcctggctaacacggtgaaaccccgtctctactaaaaatacaaaaaattagctgggcgaggtggcgggcgcctgtagtcccagctactcaggaggctgaggcaggagaatggtgtgaacctgggaggcggagcttgcagtgagccaagatcgcaccactgcactccagcctgggtgacacagcaagactctgtttc

SEQ ID NO: 38524 - DNA, 285 bp, Homo sapiens
tttcttgaaagttttggtaaagtagatgatgattgtacatctgctgcaatgatggtggacctctgttagcagaaagatacagcgtctctcaatattctgccaaaagtttctatagcacttgtacctttcacacctacagcagctttatagaactgctgccattgggttcctgcaaagccttacattttcctattgtcttgaccctaaagaaatcaaatatgcagcatgggggaattttaggccttttccaaattgccatggtcagatcagatagcctttgacatt

SEQ ID NO: 38525 - DNA, 348 bp, Homo sapiens
ttttgagttccttcctctgtatagatgatgagatccaggccccgagtgtcttcataccttaagtcagattgccctgctagtgagcagtagagcgaggacccagcctaaggttacctaagtcccaagctagagtgttttctttaatatcaagccagccctgtccaaaattgcctttcatactgaactgaaattggaattgagtagttataagttccaagtctgcctcactgtggaattctaagagtaaaattcagataatttaattaacatttaatgcctgataattaccaggatctgtgttgagtgctggggatgcaggaatgaagacgacaacacattgtgccaaca

SEQ ID NO: 38526 - DNA, 918 bp, Homo sapiens
cggcaattacaggacgtatgattgttcagaagcactgcctgccggctgtttcctagcaccacatttcacgggagcaccaggttgagatgatggaattatttacttttaaatgtaacatctcgtacagtgctcaaatgcagacgtgaacgtggactgtaaccttaaaaacaaaggcagtacatgccacactactacccttcctgctcttgtgcgcacacctaccctgatgatgcagccttcactggatatcaaaccatttatgtcttttccagtggacagtagttctgctgttgggctctttccaaattttaacacaatggatcctgtgcaaaaagcggttattaaccatacatttggagtatccattcccccaaagaagaaacaagttatttcttgtaatgtctgtcagcttcgctttaactcagatagccaggccgaggcccactacaaaggaagtaaacatgccaagaaggtcaaagcactagacgcaacgaaaaataaacccaaaatggttccttccaaggacagcgcaaaggctaatcccagctgctccatcactccaatcacaggcaacaactctgacaaatcagaagataaagggaagttaaaagccagcagttccagtcagccatcaagctctgaaagtggctcatttctcctcaaatctggcacaacacccctgccacctggagcagccacttctccctccaagagcacaaattggcagcctccccggctacatgctgtggtagaaactccccaaagaaggaaaaaagcccaacaacactcactctactcggtccatatgacgaagtgggcttgggacaactccctggtcccaacatagcagggcccacaaccaaggcacaccagagcaccaaaaccacggcgcgaaacccggaaaagagggcccggcac

SEQ ID NO: 38527 - DNA, 760 bp, Homo sapiens
ttctagagagatcattcttgcaaagtatggcaaaggcttggcaaagtagactataagcttttggaaaacagggactatgtcttcttcaacaatgtgtacacaacaagtagcaggttgtttggcacatggcagatgctcgatacgttgatctggcagcggcatgggagatggatccaaagagattaaaactggagtgaaggagtccagtaatgatgtgaagagatgagggtctgaactaggacagaagtcagtcacagggatggatttgagacgttttggagggttacacatgcagtacatgccacactactacccttcctgctcttgtgcgcacacctaccctgatgatgcagccttcactggatatcaaaccatttatgtcttttccagtggacagtagttctgctgttgggctctttccaaattttaacacataaacttctgaccgtcctacctgggcttgcctctgttcatgctgtccggggaagcagaaaccagaataaaggggagaacaagatggatcctgtgcaaaaagcggttattaaccatacatttggagtatccattcccccaaagaagaaacaagttatttcttgtaatgtctgtcagcttcgctttaactcagatgggaaggaaggagccgcaagccaaggaatgtgggcaacctctagaagctggaaaagacaaagaaatggattttcccttaaagcctccagaaggaatgcagccctgctgacacctcgatgttagcccagtgaga

SEQ ID NO: 38528 - DNA, 2159 bp, Homo sapiens
ttctagagagatcattcttgcaaagtatggcaaaggcttggcaaagtagactataagcttttggaaaacagggactatgtcttcttcaacaatgtgtacacaacaagtagcaggttgtttggcacatggcagatgctcgatacgttgatctggcagcggcatgggagatggatccaaagagattaaaactggagtgaaggagtccagtaatgatgtgaagagatgagggtctgaactaggacagaagtcagtcacagggatggatttgagacgttttggagggttacacatgcagtacatgccacactactacccttcctgctcttgtgcgcacacctaccctgatgatgcagccttcactggatatcaaaccatttatgtcttttccagtggacagtagttctgctgttgggctctttccaaattttaacacaatggatcctgtgcaaaaagcggttattaaccatacatttggagtatccattcccccaaagaagaaacaagttatttcttgtaatgtctgtcagcttcgctttaactcagatagccaggccgaggcccactacaaaggaagtaaacatgccaagaaggtcaaagcactagacgcaacgaaaaataaacccaaaatggttccttccaaggacagcgcaaaggctaatcccagctgctccatcactccaatcacaggcaacaactctgacaaatcagaagataaagggaagttaaaagccagcagttccagtcagccatcaagctctgaaagtggctcatttctcctcaaatctggcacaacacccctgccacctggagcagccacttctccctccaagagcacaaatggagctcccggtactgttgttgaatcagaagaagaaaaagccaaaaaattactttattgttcactatgcaaagtggctgtgaactccctgtcacagctagaggcacacaacacaggatctaaacacaagaccatggttgaagctcgtaatggggctggtccaattaaatcctatcctagacctggatcaagattaaagatgcagaatggcagtaaggggtcaggactacagaacaagacatttcattgtgaaatctgtgatgttcatgttaattcagaaattcaactcaaacagcacatttctagccgaaggcataaagatcgagttgcagggaaaccactgaagccaaaatacagcccttacaacaaactccagcggagcccgagtattctagcagcaaaacttgcattccagaaagatatgatgaagcctttggccccagccttcctgtcctcacctctcgcagcggcggcagccgtgtcctcagcgctgtcactcccaccccggccctctgcctcgctcttccaggctccagccattcctccagctcttctgaggcctgggcatgggccaatccgcgccactcctgcctccatcctctttgctccgtactaacgtctgcaaaccccaagacgtttgaggccagtaggaagttgagaaagaaagccacaaggattcagcaatttaagcagtttgtgttgcagtaccccccattcacccacaaaatgcagcccaccacccagtcccccaattccagagagaaacacatcactagattgacgagggcttttagagactgctcctataattgaggaatcagcagcataggctttatctccctacttcctcccccaccctaccgcgttcaatttgtgtatctcagatatttgatttcttgagcatgtattggtcagaaagaaaaagaaagaaaaccattctctatttttccatgggtatgatctggcttaaaacaatatggaatattttcctgacagacttgaaaactaggatcttcctcagatgtctgtaaataactctggtatccaactgggtgtattctagtgtggaacaaaaaacagtgaacacaagtgcttacttgtggatactatcttaccaacggatcacaaagttctctttttggtgtactgttgttgacagggattgtgtactgtttcgacccaagtactgctgtatcctgtgtagtactagatctgtatctcttgtctgaattaaacatttttagttgctgtgtaaatgttaggaagcaaagtagctttggattttctctgtaagagaataaaagataaaataatgtatttt

SEQ ID NO: 38529 - DNA, 2105 bp, Homo sapiens
ttctagagagatcattcttgcaaagtatggcaaaggcttggcaaagtagactataagcttttggaaaacagggactatgtcttcttcaacaatgtgtacacaacaagtagcaggttgtttggcacatggcagatgctcgatacgttgatctggcagcggcatgggagatggatccaaagagattaaaactggagtgaaggagtccagtaatgatgtgaagagatgagggtctgaactaggacagaagtcagtcacagggatggatttgagacgttttggagggttacacatgcagtacatgccacactactacccttcctgctcttgtgcgcacacctaccctgatgatgcagccttcactggatatcaaaccatttatgtcttttccagtggacagtagttctgctgttgggctctttccaaattttaacacaatggatcctgtgcaaaaagcggttattaaccatacatttggagtatccattcccccaaagaagaaacaagttatttcttgtaatgtctgtcagcttcgctttaactcagatagccaggccgaggcccactacaaaggaagtaaacatgccaagaaggtcaaagcactagacgcaacgaaaaataaacccaaaatggttccttccaaggacagcgcaaaggctaatcccagctgctccatcactccaatcacaggcaacaactctgacaaatcagaagataaagggaagttaaaagccagcagttccagtcagccatcaagctctgaaagtggctcatttctcctcaaatctggcacaacacccctgccacctggagcagccacttctccctccaagagcacaaatggagctcccggtactgttgttgaatcagaagaagaaaaagccaaaaaattactttattgttcactatgcaaagtggctgtgaactccctgtcacagctagaggcacacaacacaggatctaaacacaagaccatggttgaagctcgtaatggggctggtccaattaaatcctatcctagacctggatcaagattaaagatgcagaatggcagtaaggggtcaggactacagaacaagacatttcattgtgaaatctgtgatgttcatgttaattcagaaattcaactcaaacagcacatttctagccgaaggcataaagatcgagttgcagggaaaccactgaagccaaaatacagcccttacaacaaactccagcggagcccgagtattctagcagcaaaacttgcattccagaaagatatgatgaagcctttggccccagccttcctgtcctcacctctcgcagcggcggcagccgtgtcctcagcgctgtcactcccaccccggccctctgcctcgctcttccaggctccagccattcctccagctcttctgaggcctgggcatgggccaatccgcgccactcctgcctccatcctctttgctccgtactaacgtctgcaaaccccaagacgtttgaggccagtaggaagttgagaaagaaagccacaaggattcagcaatttaagcagtttgtgttgcagtaccccccattcacccacaaaatgcagcccaccacccagtcccccaattccagagagaaacacatcactagattgacgagggcttttagagactgctcctataattgaggaatcagcagcataggctttatctccctacttcctcccccaccctaccgcgttcaatttgtgtatctcagatatttgatttcttgagcatgtattggtcagaaagaaaaagaaagaaaaccattctctatttttccatgggtatgatctggcttaaaacaatatggaatattttcctgacagacttgtattctagtgtggaacaaaaaacagtgaacacaagtgcttacttgtggatactatcttaccaacggatcacaaagttctctttttggtgtactgttgttgacagggattgtgtactgtttcgacccaagtactgctgtatcctgtgtagtactagatctgtatctcttgtctgaattaaacatttttagttgctgtgtaaatgttaggaagcaaagtagctttggattttctctgtaagagaataaaagataaaataatgtatttt

SEQ ID NO: 38530 - DNA, 2007 bp, Homo sapiens
ttctagagagatcattcttgcaaagtatggcaaaggcttggcaaagtagactataagcttttggaaaacagggactatgtcttcttcaacaatgtgtacacaacaagtagcaggttgtttggcacatggcagatgctcggcagtacatgccacactactacccttcctgctcttgtgcgcacacctaccctgatgatgcagccttcactggatatcaaaccatttatgtcttttccagtggacagtagttctgctgttgggctctttccaaattttaacacaatggatcctgtgcaaaaagcggttattaaccatacatttggagtatccattcccccaaagaagaaacaagttatttcttgtaatgtctgtcagcttcgctttaactcagatagccaggccgaggcccactacaaaggaagtaaacatgccaagaaggtcaaagcactagacgcaacgaaaaataaacccaaaatggttccttccaaggacagcgcaaaggctaatcccagctgctccatcactccaatcacaggcaacaactctgacaaatcagaagataaagggaagttaaaagccagcagttccagtcagccatcaagctctgaaagtggctcatttctcctcaaatctggcacaacacccctgccacctggagcagccacttctccctccaagagcacaaatggagctcccggtactgttgttgaatcagaagaagaaaaagccaaaaaattactttattgttcactatgcaaagtggctgtgaactccctgtcacagctagaggcacacaacacaggatctaaacacaagaccatggttgaagctcgtaatggggctggtccaattaaatcctatcctagacctggatcaagattaaagatgcagaatggcagtaaggggtcaggactacagaacaagacatttcattgtgaaatctgtgatgttcatgttaattcagaaattcaactcaaacagcacatttctagccgaaggcataaagatcgagttgcagggaaaccactgaagccaaaatacagcccttacaacaaactccagcggagcccgagtattctagcagcaaaacttgcattccagaaagatatgatgaagcctttggccccagccttcctgtcctcacctctcgcagcggcggcagccgtgtcctcagcgctgtcactcccaccccggccctctgcctcgctcttccaggctccagccattcctccagctcttctgaggcctgggcatgggccaatccgcgccactcctgcctccatcctctttgctccgtactaacgtctgcaaaccccaagacgtttgaggccagtaggaagttgagaaagaaagccacaaggattcagcaatttaagcagtttgtgttgcagtaccccccattcacccacaaaatgcagcccaccacccagtcccccaattccagagagaaacacatcactagattgacgagggcttttagagactgctcctataattgaggaatcagcagcataggctttatctccctacttcctcccccaccctaccgcgttcaatttgtgtatctcagatatttgatttcttgagcatgtattggtcagaaagaaaaagaaagaaaaccattctctatttttccatgggtatgatctggcttaaaacaatatggaatattttcctgacagacttgaaaactaggatcttcctcagatgtctgtaaataactctggtatccaactgggtgtattctagtgtggaacaaaaaacagtgaacacaagtgcttacttgtggatactatcttaccaacggatcacaaagttctctttttggtgtactgttgttgacagggattgtgtactgtttcgacccaagtactgctgtatcctgtgtagtactagatctgtatctcttgtctgaattaaacatttttagttgctgtgtaaatgttaggaagcaaagtagctttggattttctctgtaagagaataaaagataaaataatgtatttt

SEQ ID NO: 38531 - DNA, 2041 bp, Homo sapiens
cggcaattacaggacgtatgattgttcagaagcactgcctgccggctgtttcctagcaccacatttcacgggagcaccaggttgagatgatggaattatttacttttaaatgtaacatctcgtacagtgctcaaatgcagacgtgaacgtggactgtaaccttaaaaacaaaggcagtacatgccacactactacccttcctgctcttgtgcgcacacctaccctgatgatgcagccttcactggatatcaaaccatttatgtcttttccagtggacagtagttctgctgttgggctctttccaaattttaacacaatggatcctgtgcaaaaagcggttattaaccatacatttggagtatccattcccccaaagaagaaacaagttatttcttgtaatgtctgtcagcttcgctttaactcagatagccaggccgaggcccactacaaaggaagtaaacatgccaagaaggtcaaagcactagacgcaacgaaaaataaacccaaaatggttccttccaaggacagcgcaaaggctaatcccagctgctccatcactccaatcacaggcaacaactctgacaaatcagaagataaagggaagttaaaagccagcagttccagtcagccatcaagctctgaaagtggctcatttctcctcaaatctggcacaacacccctgccacctggagcagccacttctccctccaagagcacaaatggagctcccggtactgttgttgaatcagaagaagaaaaagccaaaaaattactttattgttcactatgcaaagtggctgtgaactccctgtcacagctagaggcacacaacacaggatctaaacacaagaccatggttgaagctcgtaatggggctggtccaattaaatcctatcctagacctggatcaagattaaagatgcagaatggcagtaaggggtcaggactacagaacaagacatttcattgtgaaatctgtgatgttcatgttaattcagaaattcaactcaaacagcacatttctagccgaaggcataaagatcgagttgcagggaaaccactgaagccaaaatacagcccttacaacaaactccagcggagcccgagtattctagcagcaaaacttgcattccagaaagatatgatgaagcctttggccccagccttcctgtcctcacctctcgcagcggcggcagccgtgtcctcagcgctgtcactcccaccccggccctctgcctcgctcttccaggctccagccattcctccagctcttctgaggcctgggcatgggccaatccgcgccactcctgcctccatcctctttgctccgtactaacgtctgcaaaccccaagacgtttgaggccagtaggaagttgagaaagaaagccacaaggattcagcaatttaagcagtttgtgttgcagtaccccccattcacccacaaaatgcagcccaccacccagtcccccaattccagagagaaacacatcactagattgacgagggcttttagagactgctcctataattgaggaatcagcagcataggctttatctccctacttcctcccccaccctaccgcgttcaatttgtgtatctcagatatttgatttcttgagcatgtattggtcagaaagaaaaagaaagaaaaccattctctatttttccatgggtatgatctggcttaaaacaatatggaatattttcctgacagacttgaaaactaggatcttcctcagatgtctgtaaataactctggtatccaactgggtgtattctagtgtggaacaaaaaacagtgaacacaagtgcttacttgtggatactatcttaccaacggatcacaaagttctctttttggtgtactgttgttgacagggattgtgtactgtttcgacccaagtactgctgtatcctgtgtagtactagatctgtatctcttgtctgaattaaacatttttagttgctgtgtaaatgttaggaagcaaagtagctttggattttctctgtaagagaataaaagataaaataatgtatttt

SEQ ID NO: 38532 - DNA, 1978 bp, Homo sapiens
tctgcaataaaaccggtggcaggttaatgtacctctcagctcctgatacatttattatacagaaattatagaccggctgacttaactattgctaagaaacatgcttcttggcagtacatgccacactactacccttcctgctcttgtgcgcacacctaccctgatgatgcagccttcactggatatcaaaccatttatgtcttttccagtggacagtagttctgctgttgggctctttccaaattttaacacaatggatcctgtgcaaaaagcggttattaaccatacatttggagtatccattcccccaaagaagaaacaagttatttcttgtaatgtctgtcagcttcgctttaactcagatagccaggccgaggcccactacaaaggaagtaaacatgccaagaaggtcaaagcactagacgcaacgaaaaataaacccaaaatggttccttccaaggacagcgcaaaggctaatcccagctgctccatcactccaatcacaggcaacaactctgacaaatcagaagataaagggaagttaaaagccagcagttccagtcagccatcaagctctgaaagtggctcatttctcctcaaatctggcacaacacccctgccacctggagcagccacttctccctccaagagcacaaatggagctcccggtactgttgttgaatcagaagaagaaaaagccaaaaaattactttattgttcactatgcaaagtggctgtgaactccctgtcacagctagaggcacacaacacaggatctaaacacaagaccatggttgaagctcgtaatggggctggtccaattaaatcctatcctagacctggatcaagattaaagatgcagaatggcagtaaggggtcaggactacagaacaagacatttcattgtgaaatctgtgatgttcatgttaattcagaaattcaactcaaacagcacatttctagccgaaggcataaagatcgagttgcagggaaaccactgaagccaaaatacagcccttacaacaaactccagcggagcccgagtattctagcagcaaaacttgcattccagaaagatatgatgaagcctttggccccagccttcctgtcctcacctctcgcagcggcggcagccgtgtcctcagcgctgtcactcccaccccggccctctgcctcgctcttccaggctccagccattcctccagctcttctgaggcctgggcatgggccaatccgcgccactcctgcctccatcctctttgctccgtactaacgtctgcaaaccccaagacgtttgaggccagtaggaagttgagaaagaaagccacaaggattcagcaatttaagcagtttgtgttgcagtaccccccattcacccacaaaatgcagcccaccacccagtcccccaattccagagagaaacacatcactagattgacgagggcttttagagactgctcctataattgaggaatcagcagcataggctttatctccctacttcctcccccaccctaccgcgttcaatttgtgtatctcagatatttgatttcttgagcatgtattggtcagaaagaaaaagaaagaaaaccattctctatttttccatgggtatgatctggcttaaaacaatatggaatattttcctgacagacttgaaaactaggatcttcctcagatgtctgtaaataactctggtatccaactgggtgtattctagtgtggaacaaaaaacagtgaacacaagtgcttacttgtggatactatcttaccaacggatcacaaagttctctttttggtgtactgttgttgacagggattgtgtactgtttcgacccaagtactgctgtatcctgtgtagtactagatctgtatctcttgtctgaattaaacatttttagttgctgtgtaaatgttaggaagcaaagtagctttggattttctctgtaagagaataaaagataaaataatgtatttt

SEQ ID NO: 38533 - DNA, 1982 bp, Homo sapiens
acaactagcagtgcctaccataagtacctagagtagtgccttacatggaataaatgctcaccaaatgacattctcattaaatcatctggaagataattagtgtgaaaggaataggcagtacatgccacactactacccttcctgctcttgtgcgcacacctaccctgatgatgcagccttcactggatatcaaaccatttatgtcttttccagtggacagtagttctgctgttgggctctttccaaattttaacacaatggatcctgtgcaaaaagcggttattaaccatacatttggagtatccattcccccaaagaagaaacaagttatttcttgtaatgtctgtcagcttcgctttaactcagatagccaggccgaggcccactacaaaggaagtaaacatgccaagaaggtcaaagcactagacgcaacgaaaaataaacccaaaatggttccttccaaggacagcgcaaaggctaatcccagctgctccatcactccaatcacaggcaacaactctgacaaatcagaagataaagggaagttaaaagccagcagttccagtcagccatcaagctctgaaagtggctcatttctcctcaaatctggcacaacacccctgccacctggagcagccacttctccctccaagagcacaaatggagctcccggtactgttgttgaatcagaagaagaaaaagccaaaaaattactttattgttcactatgcaaagtggctgtgaactccctgtcacagctagaggcacacaacacaggatctaaacacaagaccatggttgaagctcgtaatggggctggtccaattaaatcctatcctagacctggatcaagattaaagatgcagaatggcagtaaggggtcaggactacagaacaagacatttcattgtgaaatctgtgatgttcatgttaattcagaaattcaactcaaacagcacatttctagccgaaggcataaagatcgagttgcagggaaaccactgaagccaaaatacagcccttacaacaaactccagcggagcccgagtattctagcagcaaaacttgcattccagaaagatatgatgaagcctttggccccagccttcctgtcctcacctctcgcagcggcggcagccgtgtcctcagcgctgtcactcccaccccggccctctgcctcgctcttccaggctccagccattcctccagctcttctgaggcctgggcatgggccaatccgcgccactcctgcctccatcctctttgctccgtactaacgtctgcaaaccccaagacgtttgaggccagtaggaagttgagaaagaaagccacaaggattcagcaatttaagcagtttgtgttgcagtaccccccattcacccacaaaatgcagcccaccacccagtcccccaattccagagagaaacacatcactagattgacgagggcttttagagactgctcctataattgaggaatcagcagcataggctttatctccctacttcctcccccaccctaccgcgttcaatttgtgtatctcagatatttgatttcttgagcatgtattggtcagaaagaaaaagaaagaaaaccattctctatttttccatgggtatgatctggcttaaaacaatatggaatattttcctgacagacttgaaaactaggatcttcctcagatgtctgtaaataactctggtatccaactgggtgtattctagtgtggaacaaaaaacagtgaacacaagtgcttacttgtggatactatcttaccaacggatcacaaagttctctttttggtgtactgttgttgacagggattgtgtactgtttcgacccaagtactgctgtatcctgtgtagtactagatctgtatctcttgtctgaattaaacatttttagttgctgtgtaaatgttaggaagcaaagtagctttggattttctctgtaagagaataaaagataaaataatgtatttt

SEQ ID NO: 38534 - DNA, 1458 bp, Homo sapiens
  misc_feature (11)..(12): n is a, c, g, or t
  misc_feature (22)..(22): n is a, c, g, or t
  misc_feature (26)..(26): n is a, c, g, or t
  misc_feature (28)..(29): n is a, c, g, or t
  misc_feature (31)..(31): n is a, c, g, or t
ctcatagctgnntcctgagggnaaancnncntcagtgagagaggtgtgaactgactgtgttcttgactcttcaggaaccctaaagtcctgaactcattacctaacctcaatgcagcttatctaagagaagggaaggatcacacttattctcaaaacacaaaacaaaagtctctaggtctcgtcatggtttaagacaagcctgaattttgcattgaacttcatcatctaagctggaaacttctgggcatgttttttttcctggtgagcagcagcataaaatagctttagaatttattcagaggcctttccctgtgccctagcacacaggagcaaagaccaccaaataaaagaaagctatgccatgagccactgaaaccagcattgtgaaaataatcatttcttgacttctgagagtgaagattttcaaaatttaagacttcttaatgttggtgttttacttatgaaaagatgcctgtggtgctgttattcaaaaacaggatcgccaccccattcctggttttctccctcccttaggcaaaacttgcattccagaaagatatgatgaagcctttggccccagccttcctgtcctcacctctcgcagcggcggcagccgtgtcctcagcgctgtcactcccaccccggccctctgcctcgctcttccaggctccagccattcctccagctcttctgaggcctgggcatgggccaatccgcgccactcctgcctccatcctctttgctccgtactaacgtctgcaaaccccaagacgtttgaggccagtaggaagttgagaaagaaagccacaaggattcagcaatttaagcagtttgtgttgcagtaccccccattcacccacaaaatgcagcccaccacccagtcccccaattccagagagaaacacatcactagattgacgagggcttttagagactgctcctataattgaggaatcagcagcataggctttatctccctacttcctcccccaccctaccgcgttcaatttgtgtatctcagatatttgatttcttgagcatgtattggtcagaaagaaaaagaaagaaaaccattctctatttttccatgggtatgatctggcttaaaacaatatggaatattttcctgacagacttgaaaactaggatcttcctcagatgtctgtaaataactctggtatccaactgggtgtattctagtgtggaacaaaaaacagtgaacacaagtgcttacttgtggatactatcttaccaacggatcacaaagttctctttttggtgtactgttgttgacagggattgtgtactgtttcgacccaagtactgctgtatcctgtgtagtactagatctgtatctcttgtctgaattaaacatttttagttgctgtgtaaatgttaggaagcaaagtagctttggattttctctgtaagagaataaaagataaaataatgtatttt

SEQ ID NO: 38535 - DNA, 2080 bp, Homo sapiens
cggcaattacaggacgtatgattgttcagaagcactgcctgccggctgtttcctagcaccacatttcacgggagcaccaggttgagatgatggaattatttacttttaaatgtaacatctcgtacagtgctcaaatgcagacgtgaacgtggactgtaaccttaaaaacaaaggcagtacatgccacactactacccttcctgctcttgtgcgcacacctaccctgatgatgcagccttcactggatatcaaaccatttatgtcttttccagtggacagtagttctgctgttgggctctttccaaattttaacacaaaaagaagaggcttatttgagaccaataaattttgccagatggatcctgtgcaaaaagcggttattaaccatacatttggagtatccattcccccaaagaagaaacaagttatttcttgtaatgtctgtcagcttcgctttaactcagatagccaggccgaggcccactacaaaggaagtaaacatgccaagaaggtcaaagcactagacgcaacgaaaaataaacccaaaatggttccttccaaggacagcgcaaaggctaatcccagctgctccatcactccaatcacaggcaacaactctgacaaatcagaagataaagggaagttaaaagccagcagttccagtcagccatcaagctctgaaagtggctcatttctcctcaaatctggcacaacacccctgccacctggagcagccacttctccctccaagagcacaaatggagctcccggtactgttgttgaatcagaagaagaaaaagccaaaaaattactttattgttcactatgcaaagtggctgtgaactccctgtcacagctagaggcacacaacacaggatctaaacacaagaccatggttgaagctcgtaatggggctggtccaattaaatcctatcctagacctggatcaagattaaagatgcagaatggcagtaaggggtcaggactacagaacaagacatttcattgtgaaatctgtgatgttcatgttaattcagaaattcaactcaaacagcacatttctagccgaaggcataaagatcgagttgcagggaaaccactgaagccaaaatacagcccttacaacaaactccagcggagcccgagtattctagcagcaaaacttgcattccagaaagatatgatgaagcctttggccccagccttcctgtcctcacctctcgcagcggcggcagccgtgtcctcagcgctgtcactcccaccccggccctctgcctcgctcttccaggctccagccattcctccagctcttctgaggcctgggcatgggccaatccgcgccactcctgcctccatcctctttgctccgtactaacgtctgcaaaccccaagacgtttgaggccagtaggaagttgagaaagaaagccacaaggattcagcaatttaagcagtttgtgttgcagtaccccccattcacccacaaaatgcagcccaccacccagtcccccaattccagagagaaacacatcactagattgacgagggcttttagagactgctcctataattgaggaatcagcagcataggctttatctccctacttcctcccccaccctaccgcgttcaatttgtgtatctcagatatttgatttcttgagcatgtattggtcagaaagaaaaagaaagaaaaccattctctatttttccatgggtatgatctggcttaaaacaatatggaatattttcctgacagacttgaaaactaggatcttcctcagatgtctgtaaataactctggtatccaactgggtgtattctagtgtggaacaaaaaacagtgaacacaagtgcttacttgtggatactatcttaccaacggatcacaaagttctctttttggtgtactgttgttgacagggattgtgtactgtttcgacccaagtactgctgtatcctgtgtagtactagatctgtatctcttgtctgaattaaacatttttagttgctgtgtaaatgttaggaagcaaagtagctttggattttctctgtaagagaataaaagataaaataatgtatttt

SEQ ID NO: 38536 - DNA, 618 bp, Homo sapiens
tgggaattcttacttattctgaagcctggtggaaatgcaagttctcgagctctacttactgaatcagggctccagagctgggacccaacacgccagcttttaccaagccctctcagtggttctgatggcctagagtcagaaccagtgccttagactgtgcctggtctatatgattacccctgtcaagttgctagatcataggtattattattgagtacatgagggtatttctcccttacagcagtattgtgagtctcttggggaacaggcaggacttgtgtcgtattcatccacaaaatcctaacacctagcaccatggccaacacataatcaacactcaagaaatgctggatggctgaattaacaagtgaacaaagcaactcaagctgggcttcccagcatcatttattcacctccctcttctgctttgcccaggtgccatgcacatacaggccattgtcatcctgactgttgctttccaaaaggacaaggtggtagagatagggcccttagtatattcaacaggagtcaaaagaaatgaattcctggcctagttctgccacttaggagccttcataagcctctttcagcctcagtgtctcatcaatgaacagaaaa

SEQ ID NO: 38537 - DNA, 309 bp, Homo sapiens
atggtgaaaacccatcttaactaaaaatataaaaaattagccaggcatggtggcgggcgcctgtagtcccagctactcggaaggctgaggcaggagaatggcgtgaacccaggaggcggagcttgcagtgagctgagatcacgccactgcactccagcctgggcgacagagtgagactctgtctcaaaaacaacaacaaaaacaacaacaaacaaacaaaaatccaaaatggacagagacttctaaatgaacccccagtgatatcagacagatgaaaagactgtttttatgtcataacatgtttaacgt

SEQ ID NO: 38538 - DNA, 484 bp, Homo sapiens
aaaaaattgtcattaagaaatacttttactttattaccgggcatactgctatcataaatgggcattagccaggaatataaaaagcattctttggttttaaaaatatatatatatatatatttctaaataagaggatttatgtcatggacttagttataacatttttctcggagacaaaacaacttcttagaattcagggggaaaaaaatacaatgctaagggaaacagaggcttgggcaaacctaggtagccttgagggataatctggcttctactccaagataagttcagctcttacaggagacagaagctttcagggaattaatgtagctgagggaagaaaagcaaatgggagtgataccaacagtgaccaaccagaagcttatctcctgtcaaagtgacagccacagaggagctctggccattgctatggaagaccatggcccctctcccaaaaaaaaaaatttctcagataccttcaaaa

SEQ ID NO: 38539 - DNA, 631 bp, Homo sapiens
aacacacagatttagtgaataccatttcattaaacatattttttaagtgtatctgaaacattctttttattgatgggaatgctaagacatagagtatgaatatttaacactttaataatttttgccaaattacgttccaaaattatacttctgttaacagtacttaagattgcccatttttctgataacattcattgatgttgttagtgtttccgatttttgccctttacttaaagtcagctgctgtattcttagcacagtgctttctgtgacagatgtttcagatgacagtgcttcctgcctgcaggctcatctgtctgcccctggtagctttcaggctctcaggcaccctccctaatgggaccgactggggtcaagggctctgaaaatgctgcccaccctggcccaagggcctcctgaacaggtaggctgggggtgggggtgagtccggtggcttagatgacaaatggaggtagaggacgcattctcgcctgttatttcgatttttttctctcctcaccctgaccgtcacgttctcaccttttccacctcaatccccagtcacactagcttcccaggattaaaatggtctctctctcatgaaacttgtttagaaatctagaagcattaa

SEQ ID NO: 38540 - DNA, 430 bp, Homo sapiens
ggcggagcttgcagtgagctgagatcacgccactgcactgcagcctgagtgacagagtgagactccatctcaaaaaaaaaaaaaaaaaaaaaaaagtgcatggcacctccctcttcactgtttctctctcctgctcctccatagtaagacgtgcttgcttccccttcaccttctaccatgattgtaagtttcctgaggcctcccagtcatgcttcctgttaagcctgtggaactgtgagtcaattaaacctcttttcttcataaattacccagtttcaggtagagcttgatagcagtgtgagaatggactaatatatcatccctggttgttttaagatgcaaactttgaccaggcacagtggctcatgccagtaatcccaacacattgggaggccaaggcagaaggatcacttgagtccaggagttcaag

SEQ ID NO: 38541 - DNA, 807 bp, Homo sapiens
acagaaccttaggctgggcttgtaaatatcagactcccatatgtgttgggggaaagagaagaattaataaacctatgaggctgacactagcaggtattcacatggagaagatgagaaatagagccccatgccactccagacacacaaacgcattccagatgcactgactactgtcacgtgaaaagcaacacaacaaatctctagaagaaaaagtaagaggcaatgccttcatgtaaggtccctaagacgggattctggcttctcaataaatgctgctttattgctgtgtaagaagatagcacagacttagtgggttagagcaacagaaatgtgcagcaatgtactctcatcacgctgaggtcagaagtcctaaatgagtttatgggggctaaagccaaggtgttgtcagagctggctccttctcaagattctggggaacaatccacttccttgcctttctcgcatgttggtggtgacctgtactctgacactcatggccccttcctccaatttcaaagtgggtcactcctatctcagcttccaccttcacatcaccatctcctcttctgcagccaaatctccctcttaaaaataatgacccttgtgatgacattcagggcccacctggataacccaagataattcctcccatctcaagatccttaacttcatcacatctgcaaagctccttttgccatatgaggtcacacattcagaggtaccagagactagaacctgaatatctttgggggccattaattagccagccacaaatatgttcaattgttatttgctcaataaaacaag

SEQ ID NO: 38542 - DNA, 780 bp, Homo sapiens
tctactgaaagttggtagcaactttgtacatttctgtgttgcctttgaccaaaggacccagctgagcattggaatagctcacgcagcatgtcgctaagtgggaaaggcttaaaggcaaaggaggtttaacacccagataacatggtggagtagttgagagtacagtgttcacttcctgccctcccatttcctgaaggtctgaccaagtcatttaatcttgatgtatctcagtccatctataaattgggtattataataatagtgagatagaaaacaggcaggacttgttttctgatcataaccctgctgaccaaaacaggatgtggtccagatgagataaggtttaaaaaaacactagccaaagccagcaaacgggaacgagggtgatccctggctgccctcattgctcatcagcatgggacactctcaccagtgccatgacagtttacaattgccatgacaacgacctggcagttaccatccctttccatggtaacgacccagaagttacctttcctaggaagtcttaaatagcttgcccctcaatttgcattaacccaccccttaatttgcatgtgactaaaagtgggtataaaatacaatttccaagagcccctatgtggccaactcagggtgtactgcctatgagttagccctgctccacaagaagcagtgcccttcaataaagaattgtggtctaacaccactggctcacccttgaattccttccttgatgaagccaagaaccctcccaggctaagccccaatttggggactcac

SEQ ID NO: 38543 - DNA, 898 bp, Homo sapiens
gtcctaatgggtgcaagactgtataaatatccacatttgacagacacattcagagatgcatagagttcattagatatttctttgatgtgacgtttgtacttgaactatatattattccagtaccttacatcttagatgtagaagtcgctaggtcaaaggatgtgttttgaatttaaaacatgttgaatgactgttctcacattttaaacaggagtaatctactacaaaccagccagcctaaccactgcccctgctctcagcaatgatgggctcatcagcttggtaagagagaacattactcacaatcttgcttctcaatcttaatctatttgtgcttggtgttttatataacatcactaaccctaatacttgagtatttactttggcccttctgtccattttatccaaaagcaaacagatagccttcaagggacaccattgccttaagcagaatatgcctcctaagcattgaaagcctttgacccatctgatatccaagttctggcttattatgttattagggccttgaataactttatgtatattattatggactgaatgtatccccacaaattcatgttgaccctctgacctccagtgtgatggtctttggagatgaggcctttggcaggtgattagagctagatgaggtcatgagagggaggccctcatgaaaggctcagtggcctgataagaagaaacaccagagagcttgctctgtttctctgcctacctggcgcacacatacagaagaggtgatatgaccacacagcaacatggtggccaccagcaagctaggagagggatcagaatgaaacctattttgctggcaccttgatcttgaaattctagcctccagaactgtgagaaataaaattcttttattgaagccacccag

SEQ ID NO: 38544 - DNA, 256 bp, Homo sapiens
accaggtggtaaacaaagtgtttgcccttatagaaaaacacttcccatacaactgaaggtgaatacacaacagaacaacgacagtcccagaagcttccccgggccttggtgcattgttatgtagatgagcttttgctaaagatggctgcaggtgcagccaggagtccctggaatatgcagaaagactcctggctttgtgtaaatcgcttccagctgatttagacagttagcaaagggcatttattcagcaactggg

SEQ ID NO: 38545 - DNA, 556 bp, Homo sapiens
gccgcacatctgaatactgggtgccatgtgcccgaccctccctgcaggctgcgtcctgaggcttcccgaggcgggtctggcctccccagaaggtcggcagtcagcagagctgcgtccggatctgcttgtgctcacctgggtcatcctcctacctgttccaggccacaaataacatgaatggatgcagcggaaaatgctgtaaagggagtgggctccacgctcatcactcaccagaaaatactgcggggaggagtcccagggcttgagggagggggctccacgctcaccactgactcagaagataccgcaagggagcactctcgctgggaggagtcccaggtcttggcgacagtcctactcactgccatgacttacaacggggaggcatcagccaggggagaaggtgcggcggggccggggagaccagccgcagcgtggaaccctccccagcggagccacacgggacgctcgggctgcgagcacaggtgcgggatgctgacggggaagctgtgcgagactcagttcccagggcttttcctaggctggcagtgcggcc

SEQ ID NO: 38546 - DNA, 535 bp, Homo sapiens
aggtgaaaataggtccaaagaactcatgaataaatgattcatttctcaaactacttaggtagaataataaaacatggaatgtcaaaagttaaatgagcactttcccctctgtcaaaataatcagttttcataggaattaggtttttagccaaatggctgtgaggcaagttgaagtaagacaagaaaattgcaaatatttttagatgaaaatatttactttcagcagattttgagacagtcttgctccgttgcccagcctgcagtgcagtggagcgatctcagctcattgcaaccacctcctcctggattcaagcgattcttgtgcctcggcctcccaagtggctgggatttacaggcatgtgccaccatgctctactaaaagtaaaaagattagctgggcgtggtggtgtgtgcttgtaatcctagctagttgggaggctgagacaggagaatcgcttgaatccaggaggcgaaggttgtagtgagcccagattgagccactgcactccagcttgggcaatagagcaagactctg

SEQ ID NO: 38547 - DNA, 399 bp, Homo sapiens
gtcgacgtcccagctactcgggaggctgaggtgggagaattgcttgaactcgggaggcagaggttacagtgagccaagattgtgccaccacgctccagcctgggtgacagagcaagactctgccttttctttctcaaaaatccctggagtctgcctttgcttcagaaattagtttatccagctatacttgatggaaaacccagtgtttcagtagcagaaagagctttgtggtgtaagccattctagaataagtagacaggctaggggtctcttccgtgggatgccagttagctgtgtcccaaagacagacctcaaagactccatcccagggacacaatgcctctcccgaagctaggactctggaatcaggacacaggttgctctctctggacatatttc

SEQ ID NO: 38548 - DNA, 567 bp, Homo sapiens
acagaaaatattaactgtcagcaaggctatagagaaattggaagctgtatgcattgctttttggaatgtaaaatggtacagcccactgcggaaaatggtttagcagctccttaaaaatatgaagcatagaattatatgatccatcaacaccctttaagcgtatatacccaaaagaactgagagcagggactcaaacaggtatttgtacacccgattaacagcagcattattcacagtggccaaaaggtagcccaaacctaatgcccatcagtaggtgaatagataaagaaaatgtaatatatacatacacagagtattattcagccataaaaagaaaaatatctggccagattcaggggcttacacctgtaatcccagtattttgggaggccaaggtgggcaggtctcttgagccccatattttgagaccagactggacaacatggcacttttggttagaagtgtttgaccataactactattccagaaaaagatctactcattagaactacaaatcataaaattataagttctacaaaaacaaatcaaccttatctaccacccagt

SEQ ID NO: 38549 - DNA, 886 bp, Homo sapiens
ttacctcaaaggggcagattaacttagatttacagaaacgacagctgaggaggtaaatctgagtccctctggaggtgaaggtgcttctgagatgggaccttctataaataggttataagaacttgcagaaacgagggccccgttgggcacaggccgtcctgcacatactgaacattccactggggtggggcctctgctctcccactcccagtgcacctctgaaaacgaaggtcccagaacccgcatgccaccgggacaggaaacggagcggcttccagggctcatgggaactggtctaatattagcagtgtttttctcatctggcccttgggacgtctctatggggtaggtgttgttatcactcatttcacagatgaagcagcttgggctgcccctggggaagagtggatgcctagctgtcatcccagatctctgcgtgtcatcccgccctaccccatcctgcctcacccttcattctgtgtcctctcctgtgccagctctgggcacatacccaggaatgcctggaacacctttctgctgcctaggctgtaggctcagacaccccgagaacagcttgatgtcactctattgcccatccctggtcaaacacaatgtccttcctccaccttcccaccagcctgcctcctgcccctggctatatttaggactttctacagtctttgccaccaaccccttcttagggtttgaagaggggccacatcagatatctttggaaacccatggcaggagtgagcttttctctgggcacctcttatttccatcctgtatcctgggtctttcccacctactcaggctttgggtaaaaaggccaggctattagaacatcatgggggtggcgaggcctgcaggagggtggcttaccacc

SEQ ID NO: 38550 - DNA, 2981 bp, Homo sapiens
  misc_feature (1137)..(1137): n is a, c, g, or t
ttttcataaggacatcatatatgaattagaataggaatgtttactaactgccctaaaacataaagatggtgctcctgaacgctacaccagttgccccagggcactgtagtgaactcacagggaggcagccggacatttttaaatttcaagggaaacacagtgacatttgccagctaccatgcaaactgccgttattaaattgtttagacccattaggcacttgctttggcctaggtccagaacaattaggtacttcttttggcctagagtttccatgaaaaaaactactgaaacactaaagatgctgggaaccaagaaagtttaagaatctctgtaataagaataagaaatctatacgaggctgggcacggtggctcacggtggtaatcccagcactttgggaggccaacaagggtggatcactggaggtcaggagttcgagaccggcctggccagcatggcagaaccccatctctactaaaaatgcaagggttagccggatgtggtggcgggcgcctacagtcccagctccccaggaggctgaggcaggataatggcttgagcccgggaggtggaggttgcagtgagccaagattgtgccactgcactccaggctgggcaacaagagtgagactttatctcaacaaaaaaaaagaaaaaaactatacaaactgctgttctctgtcaggctccactactctggtgtgcaactgcaagaattacagacagagtgcctcagagaaactgactggccttgaaaacctaaaactattcattgataaaaacagtgagtgatgatatggagcacctggaaggaacagtttggtgttacagctctaaaaatctccagcaaactctattaggtgagcttctaaattatttcaaacatatgattttcatcaaaaatgcccctcatgctgtgataaaacttaaatgtgcatctggctatttacctatgcaaagggagggcaagagttgagagggatcaggtagagcaatgggtgttgaaaggctgcaactgaagaaaaggaagacctcaggcatggtttttaatgaatagtcaatcaacctattttactcacaggtggtacttctgagatttaacctatgcttcatccctcctgaaaaaccggaacncagcttgaggaatatttattgaaaacttaccctcatttttacttaaaaggatagcatcagggaccctattttaggaatactgtgtcagcctaaataataaccagagacagactctctaaaagaaaggatatttatttaaagatagagcattgcaatgtcagtatgcatgccatagtaaactatgtgtgtgttcagggaggtaaagacaaaggtttttaaagggaaaaaatgaggaagattacatcattgttttgaaataattatccgtggctacaaagatcaacaataggggtgatgccagcctgaggttggacaggcagtagtgggacaggtgtccttgcagaggtactttttatataaggtggcaatggcctttgtgcaaggttgtgggttttgcagttttttgtgacagtttttgttaccagacatacacggatgagaaccctctctttgtggccttcccggctctatttgtcatggttttcttaactttagcaattccattttgattctaacaactatcacacttgcatttgtgcttatatagcaccaggagtactatcaggacactttgagtttccctgcagagggaaaggtgattgagtagataggaaagatgacaaagctattctcctcaaccatggacacatctgcacatgtaatcccagggccaaggccacacttggcttgcttcgctgatctctcttttacataaattccatttagcattttggctaccagataaatttctttccatttaaatataaaaagtcctatcagaggaatgaaggattgcaattttataaaaggtcataaggagaggttataacaatctttaacaggaatatgaaaaagcctgagtttgggggaaattttctgaacctgaaaaaggaagaaacagtagccataaggggaaatggcttttgaattttaacaaaatgaacttcgtatgttgctaaaaaatatgagctgaaaatatactgctttttttccctgagttatacctatctcctgaaggaccaagagtggcccgtgtgatgtcacttggcaacactaatcgatgagatgtctcgatctaaggcatcttagcaccaataacaaaaacattttaaaatcaatgattatataacctattcctattttctttgagagaagagctcttcctaaaaataccaccaaccatattctctttcagctacaaatgaattcaaatgtaatttttttctataacattaatgtcaggttttatgacccactgcagagaaataaatagtttaaagtgtttttggactactggcatttaaatggaaagccagccttaaggtcgtgtgttaggtcatgtaaagcctgaagctgtcctaggtcagcgtcagattccgagtcatgtttgcctagtccgcacatgactgcagtacttgaataagtgcctacagcagacatttctcattttcccagaactatgatttgtaggtaaagaaatggaactgtggtgtatccaacatcatgtcatatatgctaaggtaaaatctggcactaaataagaaaaatggtttaactcttaaatggaatgaaacttttaaaaaatctgattttttcagctcttaaatagggaagttaggctggagacagtaggctcagtcatctcttaagcattcatggaaaaacctactatgtgtagtcattttgctagggtcatggggcctacagagacatatcagacagtagtaggagatgataggttcataaacaataacaataacagcaccatggcacatgtatacctctgtaacaaacctgcacgttctgcacatgtatcccagaacttaaagcaaagtaaaaaaaaa

SEQ ID NO: 38551 - DNA, 384 bp, Homo sapiens
gagattacaaacacacaagattcttgccctcataaacttcatagtctcttgtcaagagtaataaacagacaaaaacttgcaattcatccagataaaatctgtgacattggcaatcctgtgcctccatagtaacacataaaccaaacatcgtatgttctcacgcataagtgggagctaagctatgaggatgcaaaggcataagaatgatacaatgaactttggggtcttgagggagaaagggtgggaagggggtgaaggataaaaggctacaaattgggttcagcgtatactgcttgggtaatgggtgcaccaaaatctcacaaatcaccactaaagaatatactcatgtaaccaaataccacatgttctcccaaaaacctatga

SEQ ID NO: 38552 - DNA, 385 bp, Homo sapiens
gaaatctttcacaatagcaacaaaaaacaaaaggtcctcgtgatacagagcataactcctcactccttaaaggtggattgtacacagtgacttccttccaaaaagtagcacaggaaaattaattttcaattaatatattaggttttagtccactactgtgtattccattattttaaaatttaatagaatgattctaaaagcaattgatagtgtaaacaggaaaagatataacaaaaactctgaaaaagaaaagtaaggaggaaagaagtagctctattggctggtaaatagcttttaaaacaacgtgtggttggctgagcacattgtacaggtgagtagcccacacctgtagccccagcactttgggaggctgaggtgacaggat

SEQ ID NO: 38553 - DNA, 390 bp, Homo sapiens
gatcttcacctcgaagcagtgaccgtgactgtggttacatataaggatacacagtcggctccagggtgtacgccacagaatgaggcttcggcaagcgtgttcctcagatgctgctaggctgatgccccatagtcagtcaagggaggtaaaccctggagtcaacaaagtgaaacacatttcttggctgcaggacttctcagagcctttactatgtgaatttccactgtgactctccaagaggggatacaaaatacaaggtttcccagacttacttggtcatagaattttctctccagatattcatgttccactttgggaaatgccatgggtcaatgatgtggaggcctgagacccaacattggacagcacagtgcctaggcagggagccca

SEQ ID NO: 38554 - DNA, 443 bp, Homo sapiens
gttttctgcaggtcactggaggaaggtagccacacttcactgtgaggggatggtgccctacctgtcaccttcaacttctgctatctcacactgttgttggatgtttcagaccattttgcacttgctttgaaacttagctccttcactgaatcacgttgctccttcgttgctgctgcctccagatctccaaaggtgtcccctaccctctcctgtaccagccagataatcattggtctcctaccctgagaatggctatgagtccactgcaaaaggaatttctctagtttttcaaaatcttgagtcacatggtgaagctcttcaggagcaactctgctatgttgaagagattgggacatgtcaagttaatatctgatgggcctccttccttcagtacgcaccatcacttccaactcttcgtaggcttctgtaggtctcatatgctc

SEQ ID NO: 38555 - DNA, 658 bp, Homo sapiens
tcattaagttaatattgctttgtttcacttttacattttataaaatgattttatctaaactctttgtactcatctttggcttgtgtcttcaccactaaagccaattttgagtcttttaaaattgtttcccagatatattcactaataaaagataattttgtcttctatatagatgaacctcagatttttgaagtcttaacccaatgaaaattaatttcacacttatctaacagtacaatgcaggtgtacattaatagatgtgattcacacgtggtgattcaggcacccagggttccctctttggacctacggtttcaagagtgctgtgctcacttgcaggcagcttgtagaaaggaatgaaagggtggaggcagcaacccgcttatcaaccacgtcagccttttaaaggggacacatatcatttctgctcactttctactggctaaattagtgacttggtcctacctaggtacaacgtagtcttggcaatgtggtcacttctgagccataattcaattctatggaaagagaataacagagtttgatggagtattggtcatctaggccatatcatcttaagacagaagatgctgttactgaaaaagttattccaagatataagtacccattcataatacatattagggaggtttttgta

SEQ ID NO: 38556 - DNA, 317 bp, Homo sapiens
ttttttttggaggcacggtctcactctgtcaccgaggctggtgcaatcacagctcactgcagcctcaaattcatgggttcaagtgatcctcctgcctcagtctcttgcaacccttaccatcaaaatgtaagaaactagtatgaagccccttgatactactttcgtgattagaaatattctgctttggccaggcatggtagctcgcgcctgtaatcccagcactttggtaggccgaggcgggcagatcacctgaggtcaggagttcaagaccagcctggccaacatggtgaaaccccatctctaccaaaaatacaaaa

SEQ ID NO: 38557 - DNA, 426 bp, Homo sapiens
ggtcgacggaaaacagatcatgtttgattccttaagatgtggccactgctatttgtggtacaatttgtgatctgagagctgcatgtaaaaaacacatgagcaaaaagaatatccagcacacaagggctggctttctgattctcagaggtatagtgacaacacagcttacctctgcattcaaagaagctagaacttaccgcggataatcattagtagaagacagcttaaagtagtgtctgctttctggctaggcctgattcacaggtgctgtgataaattcaaaaagacctgcctcctctgatgtgctagtatcaagggtgagggagacagttaaccaaactggtcaaaagcattgtcagcaaagacctggtgctgaatcatgttgggaaactggagtttggagctagagaggcaataccaagtatc

SEQ ID NO: 38558 - DNA, 445 bp, Homo sapiens
aaaataatctctgttacccacacttctgatttttatttaggagcattttttttttcgtttcatcctcacagttttcacaattgcaatactttgggtaaatatttgatttcatcacttaaattctcatcacaaacatacatacatgtatgtatatatagtatatatatctatatttctgtctctatatacatctgtctatgtatgtatgtatgtatctatctatctatctatctatctatctatctatctatctatctatctatctttctatacagagagagtcagtcttgccctgtctcccaggctggagtacaatggtgccatcagctcactctaaccttgaactcctgaggcaggaggatcgtttgagcccaggagttcgaggttgcagtgagctatgattgcaccactgcactccagcctggtgacagtgagaccctgtctc

SEQ ID NO: 38559 - DNA, 316 bp, Homo sapiens
gggtcctctccttccttggctccactcctccagtccctcagacctcaacaggatattgaagcctgcccatatgggcatgcactcattaaatgtttccttctgactccattcctggcctgacagaggaagaagaagagacccataagattggcagtctggctgagaacgcattctcagaccctgcaggcagtgccaaccctttggaacccagccaggatgagaagagcatccccttgatctggggtgctgtgctcctggtaggtctgctggtggcagcggtggtgctgtttgctgtgatggccaagaggaaacaagg

SEQ ID NO: 38560 - DNA, 497 bp, Homo sapiens
attgtaataacccccatgaatcaagggtggggccaggtggagatcattgaatcacgggggcagtttcccccatactgttctcgtggtaatgaataagtcgcatgagatttgatggttttataaatggaagtacccctgcacaaatccttttgcctgatgtcatgtaagacatgccttcgctcctccttgccttctgccatgattgtgaggtctgcccagccatgtggaactgtgagtccactaaacctctttttctttataaattacccagtcttgggtatgtgtttaccagcagtgtgaaaatggactaatacagcctccaagatgataagcctcccaaaactcatctgtcaaccttcctttgtgtatcctgtcttccctggtttgcccttgtagagaagaatcatcctggattacgctcatgaatattcaagtcatgggaagaaacacattcttattgtaaaaaataaaatgatgtctggcttaccttagtcttt

SEQ ID NO: 38561 - DNA, 488 bp, Homo sapiens
gctactagaatggtgtctacctaccaaaatagtaaactttcctggaggaattgcagagccaccataaaggatttgaaaaatgcaagagtggtgattcttattacattcccattcaccttgcctatttggctttggagagtgacagtggattaccataaacttaatccaggtgatttcaattgcaggtattttttccagatgtgcttttgttgctggagcaaatctatacaatccctgacttttggtatgcagatattgatctggcatacacttcttttctgtatacctattagtaaagaccatcagaatcagtttacttttgactggcaaggtttgcattacactcttactaacctacatcagggctatattaagtcttatgacgtatcaagtcttatgcaaaggacctggatagccccttccttccacatattttgcctatccgttatgttaataccatgctgattgacctggtgatcaaaaaataa

SEQ ID NO: 38562 - DNA, 347 bp, Homo sapiens
ccatcagaatagagagaaatagtaagaagttggatttaaggttgttaaattcttgttttcctctttgatgccttttttttttctggttatctgtgctagccttcataggtgcattgctgttctgccagcattcggcttgatgccagccttggccaagcccagtttgtacatatctagaatctagattttccaatctgcttgcaaaaagtagtaaatcttttgctgggactagggggttaacagtgcttcctgtagcagacagctatctcttctcatgtaacttgatactcgagtttttcaggaaccacatttattgaaaacaaagcaaaattatgtcaaaaaaataa

SEQ ID NO: 38563 - DNA, 369 bp, Homo sapiens
tttttttttttttagtttccagaatttggctttattttgcagtatagaaatcatttggagccattttgagacagaagtagaggctctgtcaagtcaatactgcattgcagcttggtccactgaagaagccatgcctgagatacaaaagatgtgctacactttacccgctttatgttcgattcctctccccttttctctcatcaactttattaggttaaaacaccacatacaggctttctccaaatgactccctattgtctggagtttggttagaattttatgcccacataaaccaaacttgtggctaggctatttgggccctgccataacatttgacataacacaaaatataaagtcatagggaaaact

SEQ ID NO: 38564 - DNA, 905 bp, Homo sapiens
gtgggaggtgcctaaaaccacaacgctaatgttatgttaatggcattatagtgagctgggtcaaattaaggacatttaggttgatttgttgcacctgtgcctaagttgagaccgtccctgctgagcaacatcctggcataagggcaagttcttaaccacatttcttcctgttagctgcagaggcggggtaggtgctgtcctgcagttgttcctgtgaacattgttcctttctgtcccttctccctagaccctccatctctatctgcctatccagcccctaactcctctctcagtgctttccctccagtacatacccatattttaattttcaagtgtgcaattttcacatgtataattcgttaagaaagaatgcaagggaacgattcagatagtcatcaacaaactgcagctgagtccagactctgtctacctttcttccctcttctgtttgcatcatctccaatagtttttctaggatccaaaactgatactgatgctgcccagtttttagtgctggccctttgaggttcactgattctcctacattttctggctaacgtgtggaaaatctgctttgttcctagtacaacagtgataaaataattttttattcccctaaattcccaaaagtagcttatacttgccatgaagtttaggctatatctcgatctctatctttccatttatctatccatccatccgtctatccacacatacatatatgtgtctatttatctctcaagatttacagtatcagaatttttcagagtgtggctcaggaatcttttttctgttaagcaagtttcttaagcattgtgatgtatttttttgcttcaatttacttattgcatctgttaataaattactgcttacaaaaacagtaaagaaaaaaaagaattaaaaac

SEQ ID NO: 38565 - DNA, 296 bp, Homo sapiens
cagatattttaaaggacttgagtgttgtgatctaagctgtatctgctttagggagcacccctagccaagtaatgctatagaggtgccaccttgacagtcttggacaagatccgggagaattctctggattaccaggcagagactcctgtttccttcccttaatttctcccaaacttagagtctctctttctgttctgagccccctaaagctggggggtggagtaacacaggcacccccgtggcggccaccactatgactgcacggggtaagacctgaagccagcacagcactgggt

SEQ ID NO: 38566 - DNA, 408 bp, Homo sapiens
aggctgaaggaaaggggtctgggtcttgtccctaggaattctccccccccttctccctgatttctcggcctctctctctgtgtgaaggggcctctccctaatgtctcctccttcccccctcttctctctcctgcggcccagcctccctctccctcctccattcctctctccctgcccttttcctgcctgaagagcagaggtgaggacctgggacccctgaggggcagcgggtgatggctctgaagctgaacccagggcctggctgtggtcttcttggtcttgctgccccctgtgacccaaaggcatgggatggacagagatgcctgcccccgtgaagctggttggggagggcagttcaccagcatccatagagtaataaagtcactgtgtgtagacccggaaaaaaag

SEQ ID NO: 38567 - DNA, 628 bp, Homo sapiens
aggtgggggaggggaaggggaccctagcagagggtgggctgtgagatgaaagctgagtgggaagctggaccctacaaaggagtctgggggcgccgggaccggaccccttcggaaaggacaggctgcgggaggagctgcaggactgaggtacagaggccaggggcccagggcaggacccagcctggacttgactccctgggatcccaggaagggcacaccctttcctcaccacccgagtgagcgctgccccctcacagagacctctttgccccctgggccaggcagagcagtgcgctgcagtgtccagggaggccccattggcacggtggcgggtgccccgtgaaatccaacggaggccggagggtgccttgtgctgctggaacctcaccacggtgggcagccgctattccgcacgcatttcaccagcattggggtcagaactgactgcgctgggggcacaccgccagggggaacggccgcctggggggcctgctatcccgcggcgcccgtgatggcccgcgtggaacttggcgcattggaggggacccggaagcggtgccacaaacccaaacgcgaaggcaagcaactgcttggcgaagacctgcatgcggtggctgggaaacaacgt

SEQ ID NO: 38568 - DNA, 1960 bp, Homo sapiens
  misc_feature (16)..(16): n is a, c, g, or t
ccaggaaggacaaaanagcaggcagggaccgggccggcaaacccgggaagggcggggggggcctcgccaggagagagtgaggacaggctgcgggaggagctgcaggactgaggtacagaggccaggggcccagggcaggacccagcctggacttgactccctgggatcccaggaagggcacaccctttcctcaccacccgagtgagcgctgccccctcacagagacctctttgccccctgggccaggcagagcaggcgctgcggtccgggaggccccatggaggtggcggtgcccgtgaagcaggaggccgagggcctggcgctggactccccgtggcaccgcttccgccgcttccacctgggcgacgcgccgggcccgcgggaggcgctggggctgctccgcgccctgtgccgggactggctgcggcccgaggtgcacaccaaggagcagatgttggagctgctggtgctggaacagttcctgagcgcgctgcccgccgacacgcaggcctgggtgtgcagccggcagccgcagagcggggaggaggcggtggccctgctggaggagctctgggggccagcagcctcccccgatgggtcgtcagcaacgagggtgcctcaggatgtgacgcagggccctggggccacaggtggaaaggaggacagtgggatgattcccttagcaggcaccgcccctggggctgaggggccggcgcctggggactcccaggctgtgcgcccctacaagcaggagcccagcagccccccgctggcgcctggcctgcccgccttcctagcggccccgggcaccacgtcctgccccgagtgcggcaaaacgtccctgaaaccagctcacctgctgcgccaccggcagagccactcgggcgagaagccgcacgcctgccctgagtgcgggaaggcctttcggcgcaaggagcacctgcggcgccaccgcgacacgcaccccggcagccccggcagccccgggcccgcgctgcgccctctgcccgcccgtgagaagccccacgcgtgctgcgagtgtggcaagaccttctactggcgcgagcacctggtgcgccaccgcaagacgcactcgggagcgcggccctttgcctgctgggagtgtggcaagggcttcgggcgccgcgagcacgtgctgcgccaccagcgcatccacggccgggcagcggccagcgcgcagggggcggtagctccgggcccggatggtggaggccccttcccgccctggcccttgggttagccgcctcccggccagcgccatctcccgcccttggtgctgcccccgggcggtacctgctctctcccagcgccacttggcctcttcctctcctccttccctcccatcgtcctcctccacctgcgcctcccttgtctgaacttcccaacgccttcctattcctttccaactccttttcccccaaatttcactttccttctcaggtctcacctcagccccccccttctccctgatttctcggcctctctctctgtgtgaaggggcctctccctaatgtctcctccttcccccctcttctctctcctgcggcccagcctccctctccctcctccattcctctctccctgcccttttcctgcctgaagagcagaggtgaggacctgggacccctgaggggcaggccaggaggagctcgggcgcaggccaggcccccttggtgaagcagaggctgaaggaaaggggtctgggtcttgtccctaggaattctcctccctcaggagattgggggttgggggaggcagcgggtgatggctctgaagctgaacccagggcctggctgtggtcttcttggtcttgctgccccctgtgacccaaaggcatgggatggacagagatgcctgcccccgtgaagctggttggggagggcagttcaccagcatccatagagtaataaagtcactgtgtgtagacccggaaaaaaag

SEQ ID NO: 38569 - DNA, 1599 bp, Homo sapiens
ggcttcaagatggctccctggcagggggttggcaggaggccttggttcctcacctgggggcctctctgtggggcagcttcagtgtcgcccagcatgactgtggcttccccccagcagggatgggattgcacagctggtcgacggtggttgggagagggagaaatagaggcccttgctcaggtttctgagttcaaaactgtgctctcatttcaggggccagcagcctcccccgatgggtcgtcagcaacgagggtgcctcaggatgtgacgcagggccctggggccacaggtggaaaggaggacagtgggatgattcccttagcaggcaccgcccctggggctgaggggccggcgcctggggactcccaggctgtgcgcccctacaagcaggagcccagcagccccccgctggcgcctggcctgcccgccttcctagcggccccgggcaccacgtcctgccccgagtgcggcaaaacgtccctgaaaccagctcacctgctgcgccaccggcagagccactcgggcgagaagccgcacgcctgccctgagtgcgggaaggcctttcggcgcaaggagcacctgcggcgccaccgcgacacgcaccccggcagccccggcagccccgggcccgcgctgcgccctctgcccgcccgtgagaagccccacgcgtgctgcgagtgtggcaagaccttctactggcgcgagcacctggtgcgccaccgcaagacgcactcgggagcgcggccctttgcctgctgggagtgtggcaagggcttcgggcgccgcgagcacgtgctgcgccaccagcgcatccacggccgggcagcggccagcgcgcagggggcggtagctccgggcccggatggtggaggccccttcccgccctggcccttgggttagccgcctcccggccagcgccatctcccgcccttggtgctgcccccgggcggtacctgctctctcccagcgccacttggcctcttcctctcctccttccctcccatcgtcctcctccacctgcgcctcccttgtctgaacttcccaacgccttcctattcctttccaactccttttcccccaaatttcactttccttctcaggtctcacctcagccccccccttctccctgatttctcggcctctctctctgtgtgaaggggcctctccctaatgtctcctccttcccccctcttctctctcctgcggcccagcctccctctccctcctccattcctctctccctgcccttttcctgcctgaagagcagaggtgaggacctgggacccctgaggggcaggccaggaggagctcgggcgcaggccaggcccccttggtgaagcagaggctgaaggaaaggggtctgggtcttgtccctaggaattctcctccctcaggagattgggggttgggggaggcagcgggtgatggctctgaagctgaacccagggcctggctgtggtcttcttggtcttgctgccccctgtgacccaaaggcatgggatggacagagatgcctgcccccgtgaagctggttggggagggcagttcaccagcatccatagagtaataaagtcactgtgtgtagacccggaaaaaaag

SEQ ID NO: 38570 - DNA, 969 bp, Homo sapiens
atgagccaccaggcccacgctcttgtattttgacccccttatttaggaaacgttttcttgtctgtcagagtgagggcaggtggtttgcccctgccgctttgcttttttttttggagacagagtctcactctgttgcccaggctggagtacagtggtgtgatctcggctcactgcaacctccgcctcccgggttcaagtgattctcctgcctcagcgtcccgagtagctttgattacaggtacatggcaccacgcccagctaatttgttgtatctttagtagagttaggatttcaccatgttggccaagctggtctcaagctcctcaccttgtgatctgcccgcctcagcctcccaaagtgctgggattacaggtgtgagccacctcgcctggcctaggcattgctaattttcacaccagtgattgctttgtgatccaggtactcctctggccaaaaatatttgaaacggggaaaaggtgtggtgcgtgacttagctgtcataggcaccagaagaattctcatccctttcccttggggacgtggttttgaggaattatgtagtagggcgaagaaaccacaacgagttggactgaaactttttaaatttttggtcttcctggttggtgccgtcctgcttggcagctgttctgctgtttcacaccaagaaaagttgtttctgaacttagtttacttttttcccaagttaaaagtagcttatatattctgcattttgttaaggagcttgcactttatccaaagggcaggacgaagctgatctgagacaggtgtattagttatttcttgcttcctgacaagtcaccccacactcaggggtgtaaacagtaacatctgtcagctcagaaagcctctgtgggtccggagtctgtgagtggcttgggcacgcggacctggcccagggtctcctgtgaggtcacagtgcagtgttggccgggctgtcatctgaaggtt

SEQ ID NO: 38571 - DNA, 596 bp, Homo sapiens
  misc_feature (546)..(546): n is a, c, g, or t
  misc_feature (554)..(555): n is a, c, g, or t
gtgaggccggggcttcatggggagttgttgggctgaacgagcggctcggagtatgggattgggggagggggacgggggagtttggcgcaaagcctgctggggcatggagtcccggcgaggctttgtgcgcatgtgcggggaggtgagggggcttggggggcctcgcctgagagagtgaggacaggctgcgggaggagctgcaggactgaggtacagaggccaggggcccagggcaggacccagcctggacttgactccctgggatcccaggaagggcacaccctttcctcaccacccgagtgagcgctgccccctcacagagacctctttgccccctgggccaggcagagcaggcgctgcggtccgggaggccccatggaggtggcggtgcccgtgaagcaggaggccgagggcctggcgctggactccccgtggcaccgcttccgccgcttccacctgggcgacgcgccgggcccgcgggaggcgctggggctgctccgcgccctgtgccgggactggctgcggcccgaggtgccacgaaagccnttttttgnnactgtttggtgggaaaacaacgattctgtggggcgcttgcc

SEQ ID NO: 38572 - DNA, 2058 bp, Homo sapiens
gtgaggccggggcttcatggggagttgttgggctgaacgagcggctcggagtatgggattgggggagggggacgggggagtttggcgcaaagcctgctggggcatggagtcccggcgaggctttgtgcgcatgtgcggggaggtgagggggcttggggggcctcgcctgagagagtgaggacaggctgcgggaggagctgcaggactgaggtacagaggccaggggcccagggcaggacccagcctggacttgactccctgggatcccaggaagggcacaccctttcctcaccacccgagtgagcgctgccccctcacagagacctctttgccccctgggccaggcagagcaggcgctgcggtccgggaggccccatggaggtggcggtgcccgtgaagcaggaggccgagggcctggcgctggactccccgtggcaccgcttccgccgcttccacctgggcgacgcgccgggcccgcgggaggcgctggggctgctccgcgccctgtgccgggactggctgcggcccgaggtgcacaccaaggagcagatgttggagctgctggtgctggaacagttcctgagcgcgctgcccgccgacacgcaggcctgggtgtgcagccggcagccgcagagcggggaggaggcggtggccctgctggaggagctctgggggccagcagcctcccccgatgggtcgtcagcaacgagggtgcctcaggatgtgacgcagggccctggggccacaggtggaaaggaggacagtgggatgattcccttagcaggcaccgcccctggggctgaggggccggcgcctggggactcccaggctgtgcgcccctacaagcaggagcccagcagccccccgctggcgcctggcctgcccgccttcctagcggccccgggcaccacgtcctgccccgagtgcggcaaaacgtccctgaaaccagctcacctgctgcgccaccggcagagccactcgggcgagaagccgcacgcctgccctgagtgcgggaaggcctttcggcgcaaggagcacctgcggcgccaccgcgacacgcaccccggcagccccggcagccccgggcccgcgctgcgccctctgcccgcccgtgagaagccccacgcgtgctgcgagtgtggcaagaccttctactggcgcgagcacctggtgcgccaccgcaagacgcactcgggagcgcggccctttgcctgctgggagtgtggcaagggcttcgggcgccgcgagcacgtgctgcgccaccagcgcatccacggccgggcagcggccagcgcgcagggggcggtagctccgggcccggatggtggaggccccttcccgccctggcccttgggttagccgcctcccggccagcgccatctcccgcccttggtgctgcccccgggcggtacctgctctctcccagcgccacttggcctcttcctctcctccttccctcccatcgtcctcctccacctgcgcctcccttgtctgaacttcccaacgccttcctattcctttccaactccttttcccccaaatttcactttccttctcaggtctcacctcagccccccccttctccctgatttctcggcctctctctctgtgtgaaggggcctctccctaatgtctcctccttcccccctcttctctctcctgcggcccagcctccctctccctcctccattcctctctccctgcccttttcctgcctgaagagcagaggtgaggacctgggacccctgaggggcaggccaggaggagctcgggcgcaggccaggcccccttggtgaagcagaggctgaaggaaaggggtctgggtcttgtccctaggaattctcctccctcaggagattgggggttgggggaggcagcgggtgatggctctgaagctgaacccagggcctggctgtggtcttcttggtcttgctgccccctgtgacccaaaggcatgggatggacagagatgcctgcccccgtgaagctggttggggagggcagttcaccagcatccatagagtaataaagtcactgtgtgtagacccggaaaaaaag

SEQ ID NO: 38573 - DNA, 2059 bp, Homo sapiens
gaaatgcagcttcaatctccaaccggagagatttctctccagagagtaaagggctggaagtgggggcgagacagaagccacagtatcaacctctgagaagccgcgttcattcctgccagacattgcgagatacagttgggaagaatttccaaggaattcttctctgccttggcagtgagggacaggctgcgggaggagctgcaggactgaggtacagaggccaggggcccagggcaggacccagcctggacttgactccctgggatcccaggaagggcacaccctttcctcaccacccgagtgagcgctgccccctcacagagacctctttgccccctgggccaggcagagcaggcgctgcggtccgggaggccccatggaggtggcggtgcccgtgaagcaggaggccgagggcctggcgctggactccccgtggcaccgcttccgccgcttccacctgggcgacgcgccgggcccgcgggaggcgctggggctgctccgcgccctgtgccgggactggctgcggcccgaggtgcacaccaaggagcagatgttggagctgctggtgctggaacagttcctgagcgcgctgcccgccgacacgcaggcctgggtgtgcagccggcagccgcagagcggggaggaggcggtggccctgctggaggagctctgggggccagcagcctcccccgatgggtcgtcagcaacgagggtgcctcaggatgtgacgcagggccctggggccacaggtggaaaggaggacagtgggatgattcccttagcaggcaccgcccctggggctgaggggccggcgcctggggactcccaggctgtgcgcccctacaagcaggagcccagcagccccccgctggcgcctggcctgcccgccttcctagcggccccgggcaccacgtcctgccccgagtgcggcaaaacgtccctgaaaccagctcacctgctgcgccaccggcagagccactcgggcgagaagccgcacgcctgccctgagtgcgggaaggcctttcggcgcaaggagcacctgcggcgccaccgcgacacgcaccccggcagccccggcagccccgggcccgcgctgcgccctctgcccgcccgtgagaagccccacgcgtgctgcgagtgtggcaagaccttctactggcgcgagcacctggtgcgccaccgcaagacgcactcgggagcgcggccctttgcctgctgggagtgtggcaagggcttcgggcgccgcgagcacgtgctgcgccaccagcgcatccacggccgggcagcggccagcgcgcagggggcggtagctccgggcccggatggtggaggccccttcccgccctggcccttgggttagccgcctcccggccagcgccatctcccgcccttggtgctgcccccgggcggtacctgctctctcccagcgccacttggcctcttcctctcctccttccctcccatcgtcctcctccacctgcgcctcccttgtctgaacttcccaacgccttcctattcctttccaactccttttcccccaaatttcactttccttctcaggtctcacctcagccccccccttctccctgatttctcggcctctctctctgtgtgaaggggcctctccctaatgtctcctccttcccccctcttctctctcctgcggcccagcctccctctccctcctccattcctctctccctgcccttttcctgcctgaagagcagaggtgaggacctgggacccctgaggggcaggccaggaggagctcgggcgcaggccaggcccccttggtgaagcagaggctgaaggaaaggggtctgggtcttgtccctaggaattctcctccctcaggagattgggggttgggggaggcagcgggtgatggctctgaagctgaacccagggcctggctgtggtcttcttggtcttgctgccccctgtgacccaaaggcatgggatggacagagatgcctgcccccgtgaagctggttggggagggcagttcaccagcatccatagagtaataaagtcactgtgtgtagacccggaaaaaaag

SEQ ID NO: 38574 - DNA, 1624 bp, Homo sapiens
atgagccaccaggcccacgctcttgtattttgacccccttatttaggaaacgttttcttgtctgtcagagtgagggcaggtggtttgcccctgccgctttgcttttttttttggagacagagtctcactctgttgcccaggctggagtacagtggtgtgatctcggctcactgcaacctccgcctcccgggttcaagtgattctcctgcctcagcgtcccgagtagctttgattacaggggccagcagcctcccccgatgggtcgtcagcaacgagggtgcctcaggatgtgacgcagggccctggggccacaggtggaaaggaggacagtgggatgattcccttagcaggcaccgcccctggggctgaggggccggcgcctggggactcccaggctgtgcgcccctacaagcaggagcccagcagccccccgctggcgcctggcctgcccgccttcctagcggccccgggcaccacgtcctgccccgagtgcggcaaaacgtccctgaaaccagctcacctgctgcgccaccggcagagccactcgggcgagaagccgcacgcctgccctgagtgcgggaaggcctttcggcgcaaggagcacctgcggcgccaccgcgacacgcaccccggcagccccggcagccccgggcccgcgctgcgccctctgcccgcccgtgagaagccccacgcgtgctgcgagtgtggcaagaccttctactggcgcgagcacctggtgcgccaccgcaagacgcactcgggagcgcggccctttgcctgctgggagtgtggcaagggcttcgggcgccgcgagcacgtgctgcgccaccagcgcatccacggccgggcagcggccagcgcgcagggggcggtagctccgggcccggatggtggaggccccttcccgccctggcccttgggttagccgcctcccggccagcgccatctcccgcccttggtgctgcccccgggcggtacctgctctctcccagcgccacttggcctcttcctctcctccttccctcccatcgtcctcctccacctgcgcctcccttgtctgaacttcccaacgccttcctattcctttccaactccttttcccccaaatttcactttccttctcaggtctcacctcagccccccccttctccctgatttctcggcctctctctctgtgtgaaggggcctctccctaatgtctcctccttcccccctcttctctctcctgcggcccagcctccctctccctcctccattcctctctccctgcccttttcctgcctgaagagcagaggtgaggacctgggacccctgaggggcaggccaggaggagctcgggcgcaggccaggcccccttggtgaagcagaggctgaaggaaaggggtctgggtcttgtccctaggaattctcctccctcaggagattgggggttgggggaggcagcgggtgatggctctgaagctgaacccagggcctggctgtggtcttcttggtcttgctgccccctgtgacccaaaggcatgggatggacagagatgcctgcccccgtgaagctggttggggagggcagttcaccagcatccatagagtaataaagtcactgtgtgtagacccggaaaaaaag

SEQ ID NO: 38575 - DNA, 1077 bp, Homo sapiens
cataaatgggacatttacttcacaagctgttttcccagggtcttcctctgggtatgtctgaaatataaaaatctggactgggattgaagattgtgtttacaaatgcttttgaataggatttctcctgcagttgttacgtagcttttcagaaacacacaaactacaaataatgaacaacatctgcaatgattcggcagggtggcagcatccacgctctccacccaaaccctggtgggatttggagaggccgctggtgggcagaggttggccctaagcatggcagcctccggcttactgcacccagcctgtggggcggctcagtagccgctgacatggtggcctgttgtctcttctcttgttctagttaagcactatcctttgtactccctcaacgtggcctccatgtggttgaagctagggagactctacatgggcctggaacacaaagccgcaggggagaaagccctgaagaaggccattgcaatcatggaagtagctcacggcaaagatcatccatatatttctgagatcaaacaggaaattgaaagccactgaaactatgcagcatttcagttttcatttaaacacttagttcagaaaccttaaaggatttgaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagacagagttttaaaaatggaattattttttctttcatgcctcttgtaatgttctgaacaaacttgaatgatgaaagtattaaagagatatcagtatttgaggtttgtattttcttctgtctctggggaggatttctcagtggtggtgggagcccagtcttggagtgaaagtgacacctgctgtccataattcagcaagctcaagtcttatccatgggactggggtcgggcagcctctttattctgcagttgctctgtggggctgtgccag

SEQ ID NO: 38576 - DNA, 1808 bp, Homo sapiens
  misc_feature (126)..(127): n is a, c, g, or t
agcgggggggcgccctcccttccggggagcggggagccgccgccgcgtccgccgggcggctcccaccccgccccccgcagctctaggtgacgcgtctccaataacagctcgccgggagccgcagcnngggcacagccggcggccgcgccccgccgccaccatgagggccgagggcctcggcggcctggagcgcttctgcagcccgggcaaaggccgggggctgcgggctctgcagcccttccaggtgggggacttgctgttctcctgcccggcctatgcctacgtgctcacggtcaacgagcggggcaaccactgcgagtactgcttcaccaggaaagaaggattgtccaaatgtggaagatgcaagcaggcattttactgcaatgtggagtgtcagaaagaagattggcccatgcacaagctggaatgttctcccatggttgtttttggggaaaactggaatccctcggagactgtaagactaacagcaaggattctggccaaacagaaaatccacccagagagaacaccttcggaaaaattgttagctgtgaaggagtttgaatcacatctggataagttagacaatgagaagaaggatttgattcagagtgacatagctgctctccatcacttttactccaagcatctcgaattccctgacaatgatagcctcgtagtactctttgcacaggttaactgtaatggcttcacaattgaagatgaagaactttctcatttgggatcagcgatatttcctgatgttgcattgatgaatcatagctgttgccccaatgtcattgtgacctacaaagggaccctggcagaagtcagagctgtacaggaaatcaagccgggagaggaggtttttaccagctatattgatctcctgtacccaacggaagatagaaatgaccggttaagagattcttatttctttacctgtgagtgccaggagtgtaccaccaaggacaaggataaggccaaggtggaaatccggaagctcagcgatcccccaaaggcagaagccatccgagacatggtcagatatgcacgcaacgtcattgaagagttccggagggccaagcactataaatcccctagtgagctgctggagatctgcgagctcagccaggagaagatgagctctgtgtttgaggacagtaacgtgtacatgttgcacatgatgtaccaggccatgggtgtctgcttgtacatgcaggactgggaaggagccctgcaatatggacagaaaatcattaagccctacagtaagcactatcctttgtactccctcaacgtggcctccatgtggttgaagctagggagactctacatgggcctggaacacaaagccgcaggggagaaagccctgaagaaggccattgcaatcatggaagtagctcacggcaaagatcatccatatatttctgagatcaaacaggaaattgaaagccactgaaactatgcagcatttcagttttcatttaaacacttagttcagaaaccttaaaggatttgaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagacagagttttaaaaatggaattattttttctttcatgcctcttgtaatgttctgaacaaacttgaatgatgaaagtattaaagagatatcagt

SEQ ID NO: 38577 - DNA, 1984 bp, Homo sapiens
  misc_feature (126)..(127): n is a, c, g, or t
agcgggggggcgccctcccttccggggagcggggagccgccgccgcgtccgccgggcggctcccaccccgccccccgcagctctaggtgacgcgtctccaataacagctcgccgggagccgcagcnngggcacagccggcggccgcgccccgccgccaccatgagggccgagggcctcggcggcctggagcgcttctgcagcccgggcaaaggccgggggctgcgggctctgcagcccttccaggtgggggacttgctgttctcctgcccggcctatgcctacgtgctcacggtcaacgagcggggcaaccactgcgagtactgcttcaccaggaaagaaggattgtccaaatgtggaagatgcaagcaggcattttactgcaatgtggagtgtcagaaagaagattggcccatgcacaagctggaatgttctcccatggttgtttttggggaaaactggaatccctcggagactgtaagactaacagcaaggattctggccaaacagaaaatccacccagagagaacaccttcggaaaaattgttagctgtgaaggagtttgaatcacatctggataagttagacaatgagaagaaggatttgattcagagtgacatagctgctctccatcacttttactccaagcatctcgaattccctgacaatgatagcctcgtagtactctttgcacaggttaactgtaatggcttcacaattgaagatgaagaactttctcatttgggatcagcgatatttcctgatgttgcattgatgaatcatagctgttgccccaatgtcattgtgacctacaaagggaccctggcagaagtcagagctgtacaggaaatcaagccgggagaggaggtttttaccagctatattgatctcctgtacccaacggaagatagaaatgaccggttaagagattcttatttctttacctgtgagtgccaggagtgtaccaccaaggacaaggataaggccaaggtggaaatccggaagctcagcgatcccccaaaggcagaagccatccgagacatggtcagatatgcacgcaacgtcattgaagagttccggagggccaagcactataaatcccctagtgagctgctggagatctgcgagctcagccaggagaagatgagctctgtgtttgaggacagtaacgtgtacatgttgcacatgatgtaccaggccatgggtgtctgcttgtacatgcaggactgggaaggagccctgcaatatggacagaaaatcattaagccctacagtaagcactatcctttgtactccctcaacgtggcctccatgtggttgaagctagggagactctacatgggcctggaacacaaagccgcaggggagaaagccctgaagaaggccattgcaatcatggaagtagctcacggcaaagatcatccatatatttctgagatcaaacaggaaattgaaagccactgaaactatgcagcatttcagttttcatttaaacacttagttcagaaaccttaaaggatttgaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagacagagttttaaaaatggaattattttttctttcatgcctcttgtaatgttctgaacaaacttgaatgatgaaagtattaaagagatatcagtatttgaggtttgtattttcttctgtctctggggaggatttctcagtggtggtgggagcccagtcttggagtgaaagtgacacctgctgtccataattcagcaagctcaagtcttatccatgggactggggtcgggcagcctctttattctgcagttgctctgtggggctgtgccag

SEQ ID NO: 38578 - DNA, 1747 bp, Homo sapiens
  misc_feature (126)..(127): n is a, c, g, or t
agcgggggggcgccctcccttccggggagcggggagccgccgccgcgtccgccgggcggctcccaccccgccccccgcagctctaggtgacgcgtctccaataacagctcgccgggagccgcagcnngggcacagccggcggccgcgccccgccgccaccatgagggccgagggcctcggcggcctggagcgcttctgcagcccgggcaaaggccgggggctgcgggctctgcagcccttccaggtgggggacttgctgttctcctgcccggcctatgcctacgtgctcacggtcaacgagcggggcaaccactgcgagtactgcttcaccagcagaaagaagattggcccatgcacaagctggaatgttctcccatggttgtttttggggaaaactggaatccctcggagactgtaagactaacagcaaggattctggccaaacagaaaatccacccagagagaacaccttcggaaaaattgttagctgtgaaggagtttgaatcacatctggataagttagacaatgagaagaaggatttgattcagagtgacatagctgctctccatcacttttactccaagcatctcgaattccctgacaatgatagcctcgtagtactctttgcacaggttaactgtaatggcttcacaattgaagatgaagaactttctcatttgggatcagcgatatttcctgatgttgcattgatgaatcatagctgttgccccaatgtcattgtgacctacaaagggaccctggcagaagtcagagctgtacaggaaatcaagccgggagaggaggtttttaccagctatattgatctcctgtacccaacggaagatagaaatgaccggttaagagattcttatttctttacctgtgagtgccaggagtgtaccaccaaggacaaggataaggccaaggtggaaatccggaagctcagcgatcccccaaaggcagaagccatccgagacatggtcagatatgcacgcaacgtcattgaagagttccggagggccaagcactataaatcccctagtgagctgctggagatctgcgagctcagccaggagaagatgagctctgtgtttgaggacagtaacgtgtacatgttgcacatgatgtaccaggccatgggtgtctgcttgtacatgcaggactgggaaggagccctgcaatatggacagaaaatcattaagccctacagtaagcactatcctttgtactccctcaacgtggcctccatgtggttgaagctagggagactctacatgggcctggaacacaaagccgcaggggagaaagccctgaagaaggccattgcaatcatggaagtagctcacggcaaagatcatccatatatttctgagatcaaacaggaaattgaaagccactgaaactatgcagcatttcagttttcatttaaacacttagttcagaaaccttaaaggatttgaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagacagagttttaaaaatggaattattttttctttcatgcctcttgtaatgttctgaacaaacttgaatgatgaaagtattaaagagatatcagt

SEQ ID NO: 38579 - DNA, 1572 bp, Homo sapiens
ccagagtaacataggtatccgaagagtccctcccggcctatgcctacgtgctcacggtcaacgagcggggcaaccactgcgagtactgcttcaccaggaaagaaggattgtccaaatgtggaagatgcaagcaggcattttactgcaatgtggagtgtcagaaagaagattggcccatgcacaagctggaatgttctcccatggttgtttttggggaaaactggaatccctcggagactgtaagactaacagcaaggattctggccaaacagaaaatccacccagagagaacaccttcggaaaaattgttagctgtgaaggagtttgaatcacatctggataagttagacaatgagaagaaggatttgattcagagtgacatagctgctctccatcacttttactccaagcatctcgaattccctgacaatgatagcctcgtagtactctttgcacaggttaactgtaatggcttcacaattgaagatgaagaactttctcatttgggatcagcgatatttcctgatgttgcattgatgaatcatagctgttgccccaatgtcattgtgacctacaaagggaccctggcagaagtcagagctgtacaggaaatcaagccgggagaggaggtttttaccagctatattgatctcctgtacccaacggaagatagaaatgaccggttaagagattcttatttctttacctgtgagtgccaggagtgtaccaccaaggacaaggataaggccaaggtggaaatccggaagctcagcgatcccccaaaggcagaagccatccgagacatggtcagatatgcacgcaacgtcattgaagagttccggagggccaagcactataaatcccctagtgagctgctggagatctgcgagctcagccaggagaagatgagctctgtgtttgaggacagtaacgtgtacatgttgcacatgatgtaccaggccatgggtgtctgcttgtacatgcaggactgggaaggagccctgcaatatggacagaaaatcattaagccctacagtaagcactatcctttgtactccctcaacgtggcctccatgtggttgaagctagggagactctacatgggcctggaacacaaagccgcaggggagaaagccctgaagaaggccattgcaatcatggaagtagctcacggcaaagatcatccatatatttctgagatcaaacaggaaattgaaagccactgaaactatgcagcatttcagttttcatttaaacacttagttcagaaaccttaaaggatttgaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagacagagttttaaaaatggaattattttttctttcatgcctcttgtaatgttctgaacaaacttgaatgatgaaagtattaaagagatatcagt

SEQ ID NO: 38580 - DNA, 2195 bp, Homo sapiens
  misc_feature (126)..(127): n is a, c, g, or t
  misc_feature (2195)..(2195): n is a, c, g, or t
agcgggggggcgccctcccttccggggagcggggagccgccgccgcgtccgccgggcggctcccaccccgccccccgcagctctaggtgacgcgtctccaataacagctcgccgggagccgcagcnngggcacagccggcggccgcgccccgccgccaccatgagggccgagggcctcggcggcctggagcgcttctgcagcccgggcaaaggccgggggctgcgggctctgcagcccttccaggtgggggacttgctgttctcctgcccggcctatgcctacgtgctcacggtcaacgagcggggcaaccactgcgagtactgcttcaccaggaaagaaggattgtccaaatgtggaagatgcaagcaggcattttactgcaatgtggagtgtcagaaagaagattggcccatgcacaagctggaatgttctcccatggttgtttttggggaaaactggaatccctcggagactgtaagactaacagcaaggattctggccaaacagaaaatccacccagagagaacaccttcggaaaaattgttagctgtgaaggagtttgaatcacatctggataagttagacaatgagaagaaggatttgattcagagtgacatagctgctctccatcacttttactccaagcatctcgaattccctgacaatgatagcctcgtagtactctttgcacaggttaactgtaatggcttcacaattgaagatgaagaactttctcatttgggatcagcgatatttcctgatgttgcattgatgaatcatagctgttgccccaatgtcattgtgacctacaaagggaccctggcagaagtcagagctgtacaggaaatcaagccgggagaggaggtttttaccagctatattgatctcctgtacccaacggaagatagaaatgaccggttaagagattcttatttctttacctgtgagtgccaggagtgtaccaccaaggacaaggataaggccaaggtggaaatccggaagctcagcgatcccccaaaggcagaagccatccgagacatggtcagatatgcacgcaacgtcattgaagagttccggagggccaagcactataaatcccctagtgagctgctggagatctgcgagctcagccaggagaagatgagctctgtgtttgaggacagtaacgtgtacatgttgcacatgatgtaccaggccatgggtgtctgcttgtacatgcaggactgggaaggagccctgcaatatggacagaaaatcattaagccctacagtaagcactatcctttgtactccctcaacgtggcctccatgtggttgaagctagggagactctacatgggcctggaacacaaagccgcaggggagaaagccctgaagaaggccattgcaatcatggaagtagctcacggcaaagatcatccatatatttctgagatcaaacaggaaattgaaagccactgaaactatgcagcatttcagttttcatttaaacacttagttcagaaaccttaaaggatttgaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagacagagttttaaaaatggaattattttttctttcatgcctcttgtaatgttctgaacaaacttgaatgatgaaagtattaaagagatatcagtgaaaaagagaaaaaagatagaaataaaaggggggggggggcaagagtttcccgtgggggggcccaaggttcagcgttaccacagttttctggttaaagggggggcccaatagggaggtggtagtaataagctaggggatgggaccgtcgtataacaagcgtcgggacgtgggaacagctggtagctggagaatctttggtgaagggagacctatatgtccggaggggggggacacaagtgggggagaatctaccctagaagagaatattaaaagaggtcttaggggaaatataaagatttaaggggggtaagtgtggtatacatagggtggaatatgctatgagttagaaaatttggtataaggaggatgattgtcgaaatttttgn

SEQ ID NO: 38581 - DNA, 1886 bp, Homo sapiens
  misc_feature (126)..(127): n is a, c, g, or t
agcgggggggcgccctcccttccggggagcggggagccgccgccgcgtccgccgggcggctcccaccccgccccccgcagctctaggtgacgcgtctccaataacagctcgccgggagccgcagcnngggcacagccggcggccgcgccccgccgccaccatgagggccgagggcctcggcggcctggagcgcttctgcagcccgggcaaaggccgggggctgcgggctctgcagcccttccaggtgggggacttgctgttctcctgcccggcctatgcctacgtgctcacggtcaacgagcggggcaaccactgcgagtactgcttcaccaggaaagaaggattgtccaaatgtggaagatgcaagcaggcattttactgcaatgtggagtgtcagaaagaagattggcccatgcacaagctggaatgttctcccatggttgtttttggggaaaactggaatccctcggagactgtaagactaacagcaaggattctggccaaacagaaaatccacccagagagaacaccttcggaaaaattgttagctgtgaaggagtttgaatcacatctggataagttagacaatgagaagaaggatttgattcagagtgacatagctgctctccatcacttttactccaagcatctcgaattccctgacaatgatagcctcgtagtactctttgcacaggttaactgtaatggcttcacaattgaagatgaagaactttctcatttgggatcagcgatatttcctgatgttgcattgatgaatcatagctgttgccccaatgtcattgtgacctacaaagggaccctggcagaagtcagagctgtacaggaaatcaagccgggagaggaggtttttaccagctatattgatctcctgtacccaacggaagatagaaatgaccggttaagagattcttatttctttacctgtgagtgccaggagtgtaccaccaaggacaaggataaggccaaggtggaaatccggaagctcagcgatcccccaaaggcagaagccatccgagacatggtcagatatgcacgcaacgtcattgaagagttccggagggccaagcactataaatcccctagtgagctgctggagatctgcgagctcagccaggagaagatgagctctgtgtttgaggacagtaacgtgtacatgttgcacatgatgtaccaggccatgggtgtctgcttgtacatgcaggactgggaaggagccctgcaatatggacagaaaatcattaagccctacagtaagcactatcctttgtactccctcaacgtggcctccatgtggttgaagctagggagactctacatgggcctggaacacaaagccgcaggggagaaagccctgaagaaggccattgcaatcatggaagtagctcacggcaaagatcatccatatatttctgagatcaaacaggaaattgaaagccactgaaactatgcagcatttcagttttcatttaaacacttagttcagaaaccttaaaggatttgaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagagttttaaattcggcacgagggacgtccttcctcaggagccgactgggcaatcacaggcaggaagatgaaggttctgtgggctgcgttgctggtcacattcctggcaggatgccaggccacagtggagctagcggtggagacagagcccggggcccgaagctgtgccaacg

SEQ ID NO: 38582 - DNA, 1083 bp, Homo sapiens
gcaacaacaaaggtctaggtctgacccggctctttcttgttgcattgatgaatcatagctgttgccccaatgtcattgtgacctacaaagggaccctggcagaagtcagagctgtacaggaaatcaagccgggagaggaggtttttaccagctatattgatctcctgtacccaacggaagatagaaatgaccggttaagagattcttatttctttacctgtgagtgccaggagtgtaccaccaaggacaaggataaggccaaggtggaaatccggaagctcagcgatcccccaaaggcagaagccatccgagacatggtcagatatgcacgcaacgtcattgaagagttccggagggccaagcactataaatcccctagtgagctgctggagatctgcgagctcagccaggagaagatgagctctgtgtttgaggacagtaacgtgtacatgttgcacatgatgtaccaggccatgggtgtctgcttgtacatgcaggactgggaaggagccctgcaatatggacagaaaatcattaagccctacagtaagcactatcctttgtactccctcaacgtggcctccatgtggttgaagctagggagactctacatgggcctggaacacaaagccgcaggggagaaagccctgaagaaggccattgcaatcatggaagtagctcacggcaaagatcatccatatatttctgagatcaaacaggaaattgaaagccactgaaactatgcagcatttcagttttcatttaaacacttagttcagaaaccttaaaggatttgaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagacagagttttaaaaatggaattattttttctttcatgcctcttgtaatgttctgaacaaacttgaatgatgaaagtattaaagagatatcagt

SEQ ID NO: 38583 - DNA, 1174 bp, Homo sapiens
aactattagatttttaaaaaatgtcttgcaaagattcagttcctctgacttagcaagtaagtagtgaaggcagctaaacagtctgcctatctcattttaaaaactgggttttctcttctgactgacagtgttgcattgatgaatcatagctgttgccccaatgtcattgtgacctacaaagggaccctggcagaagtcagagctgtacaggaaatcaagccgggagaggaggtttttaccagctatattgatctcctgtacccaacggaagatagaaatgaccggttaagagattcttatttctttacctgtgagtgccaggagtgtaccaccaaggacaaggataaggccaaggtggaaatccggaagctcagcgatcccccaaaggcagaagccatccgagacatggtcagatatgcacgcaacgtcattgaagagttccggagggccaagcactataaatcccctagtgagctgctggagatctgcgagctcagccaggagaagatgagctctgtgtttgaggacagtaacgtgtacatgttgcacatgatgtaccaggccatgggtgtctgcttgtacatgcaggactgggaaggagccctgcaatatggacagaaaatcattaagccctacagtaagcactatcctttgtactccctcaacgtggcctccatgtggttgaagctagggagactctacatgggcctggaacacaaagccgcaggggagaaagccctgaagaaggccattgcaatcatggaagtagctcacggcaaagatcatccatatatttctgagatcaaacaggaaattgaaagccactgaaactatgcagcatttcagttttcatttaaacacttagttcagaaaccttaaaggatttgaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagacagagttttaaaaatggaattattttttctttcatgcctcttgtaatgttctgaacaaacttgaatgatgaaagtattaaagagatatcagt

SEQ ID NO: 38584 - DNA, 1423 bp, Homo sapiens
  misc_feature (126)..(127): n is a, c, g, or t
agcgggggggcgccctcccttccggggagcggggagccgccgccgcgtccgccgggcggctcccaccccgccccccgcagctctaggtgacgcgtctccaataacagctcgccgggagccgcagcnngggcacagccggcggccgcgccccgccgccaccatgagggccgagggcctcggcggcctggagcgcttctgcagcccgggcaaaggccgggggctgcgggctctgcagcccttccaggtgggggacttgctgttctcctgcccggcctatgcctacgtgctcacggtcaacgagcggggcaaccactgcgagtactgcttcaccaggaaagaaggattgtccaaatgtggaagatgcaagcaggcattttactgcaatgtggagtgtcagaaagaagattggcccatgcacaagctggaatgttctcccatggttgtttttggggaaaactggaatccctcggagactgtaagactaacagcaaggattctggccaaacagaaaatccacccagagagaacaccttcggaaaaattgttagctgtgaaggagtttgaatcacatctggataagttagacaatgagaagaaggatttgattcagagtgacatagctgctctccatcacttttactccaagcatctcgaattccctgacaatgatagcctcgtagtactctttgcacaggttaactgtaatggcttcacaattgaagatgaagaactttctcatttgggatcagcgatatttcctgatgttgcattgatgaatcatagctgttgccccaatgtcattgtgacctacaaagggaccctggcagaagtcagagctgtacaggaaatcaagccgggagaggaggtttttaccagctatattgatctcctgtacccaacggaagatagaaatgaccggttaagagattcttatttctttacctgtgagtgccaggagtgtaccaccaaggacaaggataaggccaaggtggaaatccggaagctcagcgatcccccaaaggcagaagccatccgagacatggtcagatatgcacgcaacgtcattgaagagttccggagggccaagcactataaatcccctagtgagctgctggagatctgcgagctcagccaggagaagatgagctctgtgtttgaggacagtaacgtgtacatgttgcacatgatgtaccaggccatgggtgtctgcttgtacatgcaggactgggaaggagccctgcaatatggacagaaaatcattaagccctacagtaagcactatcctttgtactccctcaacgtggcctccatgtggttgaagctagggagactctacatgggcctggaacacaaagccgcaggggagaaagccctgaagaagccatgccatcatggctaccgccgtgaccctctcgacgccacc

SEQ ID NO: 38585 - DNA, 1512 bp, Homo sapiens
  misc_feature (126)..(127): n is a, c, g, or t
agcgggggggcgccctcccttccggggagcggggagccgccgccgcgtccgccgggcggctcccaccccgccccccgcagctctaggtgacgcgtctccaataacagctcgccgggagccgcagcnngggcacagccggcggccgcgccccgccgccaccatgagggccgagggcctcggcggcctggagcgcttctgcagcccgggcaaaggccgggggctgcgggctctgcagcccttccaggtgggggacttgctgttctcctgcccggcctatgcctacgtgctcacggtcaacgagcggggcaaccactgcgagtactgcttcaccaggaaagaaggattgtccaaatgtggaagatgcaagcaggcattttactgcaatgtggagtgtcagaaagaagattggcccatgcacaagctggaatgttctcccatggttgtttttggggaaaactggaatccctcggagactgtaagactaacagcaaggattctggccaaacagaaaatccacccagagagaacaccttcggaaaaattgttagctgtgaaggagtttgaatcacatctggataagttagacaatgagaagaaggatttgattcagagtgacatagctgctctccatcacttttactccaagcatctcgaattccctgacaatgatagcctcgtagtactctttgcacaggttaactgtaatggcttcacaattgaagatgaagaactttctcatttgggatcagcgatatttcctgatgttgcattgatgaatcatagctgttgccccaatgtcattgtgacctacaaagggaccctggcagaagtcagagctgtacaggaaatcaagccgggagaggaggtttttaccagctatattgatctcctgtacccaacggaagatagaaatgaccggttaagagattcttatttctttacctgtgagtgccaggagtgtaccaccaaggacaagtaagcactatcctttgtactccctcaacgtggcctccatgtggttgaagctagggagactctacatgggcctggaacacaaagccgcaggggagaaagccctgaagaaggccattgcaatcatggaagtagctcacggcaaagatcatccatatatttctgagatcaaacaggaaattgaaagccactgaaactatgcagcatttcagttttcatttaaacacttagttcagaaaccttaaaggatttgaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagacagagttttaaaaatggaattattttttctttcatgcctcttgtaatgttctgaacaaacttgaatgatgaaagtattaaagagatatcagt

SEQ ID NO: 38586 - DNA, 901 bp, Homo sapiens
cataaatgggacatttacttcacaagctgttttcccagggtcttcctctgggtatgtctgaaatataaaaatctggactgggattgaagattgtgtttacaaatgcttttgaataggatttctcctgcagttgttacgtagcttttcagaaacacacaaactacaaataatgaacaacatctgcaatgattcggcagggtggcagcatccacgctctccacccaaaccctggtgggatttggagaggccgctggtgggcagaggttggccctaagcatggcagcctccggcttactgcacccagcctgtggggcggctcagtagccgctgacatggtggcctgttgtctcttctcttgttctagttaagcactatcctttgtactccctcaacgtggcctccatgtggttgaagctagggagactctacatgggcctggaacacaaagccgcaggggagaaagccctgaagaaggccattgcaatcatggaagtagctcacggcaaagatcatccatatatttctgagatcaaacaggaaattgaaagccactgaaactatgcagcatttcagttttcatttaaacacttagttcagaaaccttaaaggatttgaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagacagagttttaaaaatggaattattttttctttcatgcctcttgtaatgttctgaacaaacttgaatgatgaaagtattaaagagatatcagt

SEQ ID NO: 38587 - DNA, 579 bp, Homo sapiens
agttatcttatgttgttaagggaaagggcaggagcctataacataagcactatcctttgtactccctcaacgtggcctccatgtggttgaagctagggagactctacatgggcctggaacacaaagccgcaggggagaaagccctgaagaaggccattgcaatcatggaagtagctcacggcaaagatcatccatatatttctgagatcaaacaggaaattgaaagccactgaaactatgcagcatttcagttttcatttaaacacttagttcagaaaccttaaaggatttgaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagacagagttttaaaaatggaattattttttctttcatgcctcttgtaatgttctgaacaaacttgaatgatgaaagtattaaagagatatcagt

SEQ ID NO: 38588 - DNA, 718 bp, Homo sapiens
ctctcagttcattgaggaccagttacataccaagaccctcgtgtgcttttcctttgaattctcacaaaaccgagaggctttcctgatgaagaaagtgaggttcaagcaggtttaagccattgcaatcatggaagtagctcacggcaaagatcatccatatatttctgagatcaaacaggaaattgaaagccactgaaactatgcagcatttcagttttcatttaaacacttagttcagaaaccttaaaggatttgaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagacagagttttaaaaatggaattattttttctttcatgcctcttgtaatgttctgaacaaacttgaatgatgaaagtattaaagagatatcagtatttgaggtttgtattttcttctgtctctggggaggatttctcagtggtggtgggagcccagtcttggagtgaaagtgacacctgctgtccataattcagcaagctcaagtcttatccatgggactggggtcgggcagcctctttattctgcagttgctctgtggggctgtgccag

SEQ ID NO: 38589 - DNA, 1613 bp, Homo sapiens
  misc_feature (126)..(127): n is a, c, g, or t
agcgggggggcgccctcccttccggggagcggggagccgccgccgcgtccgccgggcggctcccaccccgccccccgcagctctaggtgacgcgtctccaataacagctcgccgggagccgcagcnngggcacagccggcggccgcgccccgccgccaccatgagggccgagggcctcggcggcctggagcgcttctgcagcccgggcaaaggccgggggctgcgggctctgcagcccttccaggtgggggacttgctgttctcctgcccggcctatgcctacgtgctcacggtcaacgagcggggcaaccactgcgagtactgcttcaccaggaaagaaggattgtccaaatgtggaagatgcaagcaggcattttactgcaatgtggagtgtcagaaagaagattggcccatgcacaagctggaatgttctcccatggttgtttttggggaaaactggaatccctcggagactgtaagactaacagcaaggattctggccaaacagaaaatccacccagagagaacaccttcggaaaaattgttagctgtgaaggagtttgaatcacatctggataagttagacaatgagaagaaggatttgattcagagtgacatagctgctctccatcacttttactccaagcatctcgaattccctgacaatgatagcctcgtagtactctttgcacaggttaactgtaatggcttcacaattgaagatgaagaactttctcatttgggatcagcgatatttcctgagtaggctgtgtttgacttcatttctttcctttttacttacttaacactaatttgatttttttttcatttttaaataacccacctaactgcatgtggcagacatgaaactcaaagtgaattaaaacagctttttaatctgccagatttcaaaatatttcccctacacttaaggatccaaaggtagtagttaagagaacagttgcttgttaagtcctgctaggcagagagctgttattaaagaatattttatagcgtgcatagaaggaacagctcatgccctgctgagaaatttgctttctgcctatctgtggttctggaaatctttccatttcttatgctcaaagtgaaacattaattgccaaccaagaattggccacaagcttgagtacagactatatgagcttcttctccatctgtcctttttgataaataccagtacagaaacagcacaatttggagggagaatatgctgaagtagtgggccggataaaaatttcaaagaactgtaggattttctctggatttgaagaatacttgagtaattcagcaaaggctagccagttgacaaatggagatctttatagatctgactttaatggattgccaagaatgattttgcctttgtctgtctcatggaatgagtatttccaaaatgcttcagtccctgaaatcaaacccttgcttcacagatagagccaaggaattcatcatgcatccccccagcctccaaattaatccacattgtagataagttctatccagagggaggttgcttaacatatactgcaggggcctttgcctgtaggttgccacataggtaggaaacccttaatactcatgcatttgccctg

SEQ ID NO: 38590 - DNA, 831 bp, Homo sapiens
cggacgcgtgggtccggacgcgtgggctaatttgatttttttttcatttttaaataacccacctaactgcatgtggcagacatgaaactcaaagtgaattaaaacagctttttaatctgccagatttcaaaatatttcccctacacttaaggatccaaaggtagtagttaagagaacagttgcttgttaagtcctgctaggcagagagctgttattaaagaatattttatagcgtgcatagaaggaacagctcatgccctgctgagaaatttgctttctgcctatctgtggttctggaaatctttccatttcttatgctcaaagtgaaacattaattgccaaccaagaattggccacaagcttgagtacagactatatgagcttcttctccatctgtcctttttgataaataccagtacagaaacagcacaatttggagggagaatatgctgaagtagtgggccggataaaaatttcaaagaactgtaggattttctctggatttgaagaatacttgagtaattcagcaaaggctagccagttgacaaatggagatctttatagatctgactttaatggattgccaagaatgattttgcctttgtctgtctcatggaatgagtatttccaaaatgcttcagtccctgaaatcaaacccttgcttcacagatagagccaaggaattcatcatgcatccccccagcctccaaattaatccacattgtagataagttctatccagagggaggttgcttaacatatactgcaggggcctttgcctgtaggttgccacataggtaggaaacccttaatactcatgcatttgccctg

SEQ ID NO: 38591 - DNA, 384 bp, Homo sapiens
aaaaatacaaaaaattagccaggcatggtggtgggcgcctgtggtcccagctactcgggaagctgaggcaggagaatggcgtgaacccgggatgcggagcttgcagtgagcggagatcgcaccactgcactccagcctgggcgacagagcgagactccgtctcaaaataaataaataaattaaaataaaaacaggtcctggtggagaacataggctctaatggccagtttgcatcctgtgccttaaagcagagagatccaacttaaagttaccctgggtggaggtgtgaggagattggcttctaggctctcattgtttgtcttgctttttcctaggccattgcaatcatggaagtagctcacggcaaagatcatccatatattt

SEQ ID NO: 38592 - DNA, 1027 bp, Homo sapiens
  misc_feature (31)..(31): n is a, c, g, or t
  misc_feature (40)..(40): n is a, c, g, or t
cgaattccgagtctcggtaaccctccaaganccgctggcnagaagttcagagactgtacagggaaatcaagaccgggagaggaggtttttaccagctatattgatctcctgtacccaacggaagatagaaatgaccggttaagagattcttatttctttacctgtgagtgccaggagtgtaccaccaaggacaaggataaggccaaggtggaaatccggaagctcagcgatcccccaaaggcagaagccatccgagacatggtcagatatgcacgcaacgtcattgaagagttccggagggccaagcactataaatcccctagtgagctgctggagatctgcgagctcagccaggagaagatgagctctgtgtttgaggacagtaacgtgtacatgttgcacatgatgtaccaggccatgggtgtctgcttgtacatgcaggactgggaaggagccctgcaatatggacagaaaatcattaagccctacagtaagcactatcctttgtactccctcaacgtggcctccatgtggttgaagctagggagactctacatgggcctggaacacaaagccgcaggggagaaagccctgaagaaggccattgcaatcatggaagtagctcacggcaaagatcatccatatatttctgagatcaaacaggaaattgaaagccactgaaactatgcagcatttcagttttcatttaaacacttagttcagaaaccttaaaggatttgaatatttcaaattgcacacgtcactccagcatctctgtaaaataattggaatgaaaatacttcttgcacttaaacactgcacatgccgtactttgaggttagtctgaatcttgaactttaataccaaattaattttgaatgcttttgtttcctaagagataatggcatggtttcatatgttatactttggacagacagagttttaaaaatggaattattttttctttcatgcctcttgtaatgttctgaacaaacttgaatgatgaaagtattaaagagatatcagt

SEQ ID NO: 38593 - DNA, 1361 bp, Homo sapiens
  misc_feature (126)..(127): n is a, c, g, or t
agcgggggggcgccctcccttccggggagcggggagccgccgccgcgtccgccgggcggctcccaccccgccccccgcagctctaggtgacgcgtctccaataacagctcgccgggagccgcagcnngggcacagccggcggccgcgccccgccgccaccatgagggccgagggcctcggcggcctggagcgcttctgcagcccgggcaaaggccgggggctgcgggctctgcagcccttccaggtgggggacttgctgttctcctgcccggcctatgcctacgtgctcacggtcaacgagcggggcaaccactgcgagtactgcttcaccaggaaagaaggattgtccaaatgtggaagatgcaagcaggcattttactgcaatgtggagtgtcagaaagaagattggcccatgcacaagctggaatgttctcccatggttgtttttggggaaaactggaatccctcggagactgtaagactaacagcaaggattctggccaaacagaaaatccacccagagagaacaccttcggaaaaattgttagctgtgaaggagtttgaatcacatctggataagttagacaatgagaagaaggatttgattcagagtgacatagctgctctccatcacttttactccaagcatctcgaattccctgacaatgatagcctcgtagtactctttgcacaggttaactgtaatggcttcacaattgaagatgaagaactttctcatttgggatcagcgatatttcctgatgttgcattgatgaatcatagctgttgccccaatgtcattgtgacctacaaagggaccctggcagaagtcagagctgtacaggaaatcaagccgggagaggaggtttttaccagctatattgatctcctgtacccaacggaagatagaaatgaccggttaagagattcttatttctttacctgtgagtgccaggagtgtaccaccaaggacaaggataaggccaaggtggaaatccggaagctcagcgatcccccaaaggcagaagccatccgagacatggtcagatatgcacgcaacgtcattgaagagttccggagggccaagcactataaatcccctagtgagctgctggagatctgcgagctcagccaggagaagatgagctctgtgtttgaggacagtaacgtgtacatgttgcacatgatgtaccaggccatgggtgtctgcttgtacatgcaggactgggaaggagccctgcaatatggacagaaaatcattaagccctacagtaagcactatcctttgtgttccaggcccatgtagagtctccctagcttcaaccaccgggaggccacgttgagggagtacaaagtacgac

SEQ ID NO: 38594 - DNA, 1099 bp, Homo sapiens
  misc_feature (126)..(127): n is a, c, g, or t
  misc_feature (1037)..(1037): n is a, c, g, or t
  misc_feature (1053)..(1053): n is a, c, g, or t
agcgggggggcgccctcccttccggggagcggggagccgccgccgcgtccgccgggcggctcccaccccgccccccgcagctctaggtgacgcgtctccaataacagctcgccgggagccgcagcnngggcacagccggcggccgcgccccgccgccaccatgagggccgagggcctcggcggcctggagcgcttctgcagcccgggcaaaggccgggggctgcgggctctgcagcccttccaggtgggggacttgctgttctcctgcccggcctatgcctacgtgctcacggtcaacgagcggggcaaccactgcgagtactgcttcaccaggaaagaaggattgtccaaatgtggaagatgcaagcaggcattttactgcaatgtggagtgtcagaaagaagattggcccatgcacaagctggaatgttctcccatggttgtttttggggaaaactggaatccctcggagactgtaagactaacagcaaggattctggccaaacagaaaatccacccagagagaacaccttcggaaaaattgttagctgtgaaggagtttgaatcacatctggataagttagacaatgagaagaaggatttgattcagagtgacatagctgctctccatcacttttactccaagcatctcgaattccctgacaatgatagcctcgtagtactctttgcacaggttaactgtaatggcttcacaattgaagatgaagaactttctcatttgggatcagcgatatttcctgatgttgcattgatgaatcatagctgttgccccaatgtcattgtgacctacaaagggaccctggcagaagtcagagctgtacaggaaatcaagccgggagaggaggtttttaccagctatattgatctcctgtacccaacggaagatagaaatgaccggttaagagattcttatttctttacctggtgaagttgccccaaagggggaaaggcttgtaccacgccaaagggggaaccaaaaggggaataaaatgggccaaggtggaaatccggaaggnccctttcccaaaaggncccgggaaaaatttcccccccaacgccaaaaaaaggcaagaaacgc

SEQ ID NO: 38595 - DNA, 3054 bp, Homo sapiens
gaaaacctcctgggggagcctgcggcgcggtcctttcctgtgtccccttcgctgcgggtcctgcccggggccgcgccaggtggaggccccgagaggcggcgcgtttcctgcgctccgggattgcgggagaagcgtgagtccctgtctccgagactagaggccacggacacccgcgcaggagcatcccctggcaccccgccccacgcccgtccttccggagtctacacatcggcgacctcccgtgtctaggcgcacacatttcccgccccgcggagactcccacgccccgggccctctctgccgcaggcgccagatcccgcctctgggggctggaccgagagggtcctcggcggcttctttaaggctgcggtccccgccccgtcgtcctccccgccctcctccctctcgccgcggctcctcccgccctcccagagcagccgggcggctgggcgcgcgcggcgcagagcaggtgccggggagcccttcgcatgcggctgccgggccggaggtggtagcggcgccgggcgcgctccgcccgcccctcctccgggccgcactgaggctcgggcgcgcggggacatgtcggtggcgacgggcagcagcgaggcggccggcggggccagcggcggcggcgcacgggttttcttccaaagcccccggggtggcgccggtggcagccccggctccagcagcggctcaggctcctcccgggaggactcggcgcccgtggccacggcggccgctgcagggcaggttcagcagcaacagcagcggcgacaccagcagggaaaagtgacagtgaaatacgatcgtaaggagcttcggaagcggctggtgctggaggaatggatcgtggagcagctgggtcagctctacggctgcgaggaagaagaaatgccagaggtagaaattgacattgatgatcttcttgatgcagacagtgatgaagagagagcttcaaaattacaggaagctcttgtagactgctacaaaccaacagaggaatttatcaaagagctgctttctcggataagaggcatgaggaaactgagccctccgcagaagaagagtgtatgattctggaacagggtgaaactctcccagagacgaagaaagagtcctgggatttgtacttcatgaagacttttgtgaaagaataggtgtccttatgaacaacgtttttgtttttttttttttcttttttggtgtgaaggtgggggggtctattagacatttattcaagagcgttctttttttggttttaaaggtttttgttaatgtaatattttaatagcaaagatatcatgactctagccacagcctaaccaaggattatcaaaggaggtggacactcaaggaagggccacgccaggctgcgtttcctgcaaggactcagatgttcagtaccttatgatacagggaagatagttttcttacaagtagtttggtaatattttttttcttaagttgtacatttgactcagctgtcaaatttctcacacttgtatatatctacacacaactaagttaaaatgttgatgtgagttttatttcacatggatggaataaacttgtggttgtcctttaactggaggtcccagcacatgtgttttcaagaggccactaggcattcttcactgagtgctgctgacttcaacgttcactttatgcaccaaagtgaaagaattcagtgtatccgttattttaatgcactacaccacagaaatgttaagttggtcaagggcttaatttatggaatttctattatttcattggttgggatgctttgccaggtcatgtgcttattgtctcattttgtagtcttttaaagttgtatgaacccttaatttgaagaactaacttgatttctagagaaatatccacactatctcagtggtattttgcattggaaaaaggaagcactgtgtagcagtgaattgtctgctttccaccgagtactgtgtttattctctctccaggaaagcagatcaaaagaaagttagcagatcgagtgtcttcttccttagaaataggttctggtagcttctgtgcctgggtagtatcagaccagtgggagtaaaccgagtgttaagtgtcaaggtgagaaagcctcacattctctcaagacagttgctctaggagctgagttgctggtttggaagtgtggagattgcatttctggcttctctcaatggcttgtgttgaggactctgggtgctcctggccctaattgtgcaccctgatccccgtgcttggagctaggcctggtggcgtgctctagccctctcagttaccagctctttggagaaggatcaaaattcagatggaatgtgggatgggtaataggtgagagtagaaacccttccctccaggaggcccccgctgactcccacagaaacccacctaccataagatgtcttcaggtggccttgtccaaggatgggggtcaggcattttatatcaagggtgctctgaacatattttattttttaaaaaaactatgtttgtgaattttgcgtatactggcaagcttttgaaaatgtatttaattttgtattgtttaccaatgatttatttacaagatatttactcaaataaatggagctgcttacaaaaaaaaaaaaaaaaaaaaaaaaaaaaaaaaaaaaaaaaaaaaaaaaaaaaaaaaaaaaaaaaaaaaacaaaaaaaaaaaaaaaaaaaaaaaaaaaaaaaacaaaaaaaaaaaaaaaaaaaaaaaaaaaaaaaaaacacggcgggggggggcgggggagaaagaaaaaaaaaaaaaaacaacaggcggggggggggaccaggaagagaaagaagaacgggagtggagagagaagaacaagagaggggcagaacaaaaggcgagggggagacaccaacataaagaaacaagcaggggggagggaagaaaagaagaggagaaagcaagcaaacagaggagagacggagcaagacacagaaaaggagagtaagaataacagaggaggacaacagaacgacgacgaccaagcaaaacgagacacccccgcgccggggggagaggt

SEQ ID NO: 38596 - DNA, 2531 bp, Homo sapiens
gaaaacctcctgggggagcctgcggcgcggtcctttcctgtgtccccttcgctgcgggtcctgcccggggccgcgccaggtggaggccccgagaggcggcgcgtttcctgcgctccgggattgcgggagaagcgtgagtccctgtctccgagactagaggccacggacacccgcgcaggagcatcccctggcaccccgccccacgcccgtccttccggagtctacacatcggcgacctcccgtgtctaggcgcacacatttcccgccccgcggagactcccacgccccgggccctctctgccgcaggcgccagatcccgcctctgggggctggaccgagagggtcctcggcggcttctttaaggctgcggtccccgccccgtcgtcctccccgccctcctccctctcgccgcggctcctcccgccctcccagagcagccgggcggctgggcgcgcgcggcgcagagcaggtgccggggagcccttcgcatgcggctgccgggccggaggtggtagcggcgccgggcgcgctccgcccgcccctcctccgggccgcactgaggctcgggcgcgcggggacatgtcggtggcgacgggcagcagcgaggcggccggcggggccagcggcggcggcgcacgggttttcttccaaagcccccggggtggcgccggtggcagccccggctccagcagcggctcaggctcctcccgggaggactcggcgcccgtggccacggcggccgctgcagggcaggttcagcagcaacagcagcggcgacaccagcagggaaaagtgacagtgaaatacgatcgtaaggagcttcggaagcggctggtgctggaggaatggatcgtggagcagctgggtcagctctacggctgcgaggaatttatcaaagagctgctttctcggataagaggcatgaggaaactgagccctccgcagaagaagagtgtatgattctggaacagggtgaaactctcccagagacgaagaaagagtcctgggatttgtacttcatgaagacttttgtgaaagaataggtgtccttatgaacaacgtttttgtttttttttttttcttttttggtgtgaaggtgggggggtctattagacatttattcaagagcgttctttttttggttttaaaggtttttgttaatgtaatattttaatagcaaagatatcatgactctagccacagcctaaccaaggattatcaaaggaggtggacactcaaggaagggccacgccaggctgcgtttcctgcaaggactcagatgttcagtaccttatgatacagggaagatagttttcttacaagtagtttggtaatattttttttcttaagttgtacatttgactcagctgtcaaatttctcacacttgtatatatctacacacaactaagttaaaatgttgatgtgagttttatttcacatggatggaataaacttgtggttgtcctttaactggaggtcccagcacatgtgttttcaagaggccactaggcattcttcactgagtgctgctgacttcaacgttcactttatgcaccaaagtgaaagaattcagtgtatccgttattttaatgcactacaccacagaaatgttaagttggtcaagggcttaatttatggaatttctattatttcattggttgggatgctttgccaggtcatgtgcttattgtctcattttgtagtcttttaaagttgtatgaacccttaatttgaagaactaacttgatttctagagaaatatccacactatctcagtggtattttgcattggaaaaaggaagcactgtgtagcagtgaattgtctgctttccaccgagtactgtgtttattctctctccaggaaagcagatcaaaagaaagttagcagatcgagtgtcttcttccttagaaataggttctggtagcttctgtgcctgggtagtatcagaccagtgggagtaaaccgagtgttaagtgtcaaggtgagaaagcctcacattctctcaagacagttgctctaggagctgagttgctggtttggaagtgtggagattgcatttctggcttctctcaatggcttgtgttgaggactctgggtgctcctggccctaattgtgcaccctgatccccgtgcttggagctaggcctggtggcgtgctctagccctctcagttaccagctctttggagaaggatcaaaattcagatggaatgtgggatgggtaataggtgagagtagaaacccttccctccaggaggcccccgctgactcccacagaaacccacctaccataagatgtcttcaggtggccttgtccaaggatgggggtcaggcattttatatcaagggtgctctgaacatattttattttttaaaaaaactatgtttgtgaattttgcgtatactggcaagcttttgaaaatgtatttaattttgtattgtttaccaatgatttatttacaagatatttactcaaataaatggagctgcttacaagcctgttgacatgtgtggcttgcacaacacgtta

SEQ ID NO: 38597 - DNA, 1167 bp, Homo sapiens
gaaaacctcctgggggagcctgcggcgcggtcctttcctgtgtccccttcgctgcgggtcctgcccggggccgcgccaggtggaggccccgagaggcggcgcgtttcctgcgctccgggattgcgggagaagcgtgagtccctgtctccgagactagaggccacggacacccgcgcaggagcatcccctggcaccccgccccacgcccgtccttccggagtctacacatcggcgacctcccgtgtctaggcgcacacatttcccgccccgcggagactcccacgccccgggccctctctgccgcaggcgccagatcccgcctctgggggctggaccgagagggtcctcggcggcttctttaaggctgcggtccccgccccgtcgtcctccccgccctcctccctctcgccgcggctcctcccgccctcccagagcagccgggcggctgggcgcgcgcggcgcagagcaggtgccggggagcccttcgcatgcggctgccgggccggaggtggtagcggcgccgggcgcgctccgcccgcccctcctccgggccgcactgaggctcgggcgcgcggggacatgtcggtggcgacgggcagcagcgaggcggccggcggggccagcggcggcggcgcacgggttttcttccaaagcccccggggtggcgccggtggcagccccggctccagcagcggctcaggctcctcccgggaggactcggcgcccgtggccacggcggccgctgcagggcaggttcagcagcaacagcagcggcgacaccagcagggaaaagtgacagtgaaatacgatcgtaaggagcttcggaagcggctggtgctggaggaatggatcgtggagcagctgggtcagctctacggctgcgaggaagaagaaatgccagaggtagaaattgacattgatgatcttcttgatgcagacagtgatgaagagagagcttcaaaattacaggaagctcttgtagactgctacaaaccaacagaggaatttatcaaagagctgctttctcggataagaggcatgaggaaactgagccctccgcagaagaagagtgtatgattctggaacagggtgaaactctcccaggactctttcacaatgtaaacgcaaaacttaatttgtaatgcttatgatacatgtaaagaaggt

SEQ ID NO: 38598 - DNA, 2648 bp, Homo sapiens
gaaaacctcctgggggagcctgcggcgcggtcctttcctgtgtccccttcgctgcgggtcctgcccggggccgcgccaggtggaggccccgagaggcggcgcgtttcctgcgctccgggattgcgggagaagcgtgagtccctgtctccgagactagaggccacggacacccgcgcaggagcatcccctggcaccccgccccacgcccgtccttccggagtctacacatcggcgacctcccgtgtctaggcgcacacatttcccgccccgcggagactcccacgccccgggccctctctgccgcaggcgccagatcccgcctctgggggctggaccgagagggtcctcggcggcttctttaaggctgcggtccccgccccgtcgtcctccccgccctcctccctctcgccgcggctcctcccgccctcccagagcagccgggcggctgggcgcgcgcggcgcagagcaggtgccggggagcccttcgcatgcggctgccgggccggaggtggtagcggcgccgggcgcgctccgcccgcccctcctccgggccgcactgaggctcgggcgcgcggggacatgtcggtggcgacgggcagcagcgaggcggccggcggggccagcggcggcggcgcacgggttttcttccaaagcccccggggtggcgccggtggcagccccggctccagcagcggctcaggctcctcccgggaggactcggcgcccgtggccacggcggccgctgcagggcaggttcagcagcaacagcagcggcgacaccagcagggaaaagtgacagtgaaatacgatcgtaaggagcttcggaagcggctggtgctggaggaatggatcgtggagcagctgggtcagctctacggctgcgaggaagaagaaatgccagaggtagaaattgacattgatgatcttcttgatgcagacagtgatgaagagagagcttcaaaattacaggaagctcttgtagactgctacaaaccaacagaggaatttatcaaagagctgctttctcggataagaggcatgaggaaactgagccctccgcagaagaagagtgtatgattctggaacagggtgaaactctcccagagacgaagaaagagtcctgggatttgtacttcatgaagacttttgtgaaagaataggtgtccttatgaacaacgtttttgtttttttttttttcttttttggtgtgaaggtgggggggtctattagacatttattcaagagcgttctttttttggttttaaaggtttttgttaatgtaatattttaatagcaaagatatcatgactctagccacagcctaaccaaggattatcaaaggaggtggacactcaaggaagggccacgccaggctgcgtttcctgcaaggactcagatgttcagtaccttatgatacagggaagatagttttcttacaagtagtttggtaatattttttttcttaagttgtacatttgactcagctgtcaaatttctcacacttgtatatatctacacacaactaagttaaaatgttgatgtgagttttatttcacatggatggaataaacttgtggttgtcctttaactggaggtcccagcacatgtgttttcaagaggccactaggcattcttcactgagtgctgctgacttcaacgttcactttatgcaccaaagtgaaagaattcagtgtatccgttattttaatgcactacaccacagaaatgttaagttggtcaagggcttaatttatggaatttctattatttcattggttgggatgctttgccaggtcatgtgcttattgtctcattttgtagtcttttaaagttgtatgaacccttaatttgaagaactaacttgatttctagagaaatatccacactatctcagtggtattttgcattggaaaaaggaagcactgtgtagcagtgaattgtctgctttccaccgagtactgtgtttattctctctccaggaaagcagatcaaaagaaagttagcagatcgagtgtcttcttccttagaaataggttctggtagcttctgtgcctgggtagtatcagaccagtgggagtaaaccgagtgttaagtgtcaaggtgagaaagcctcacattctctcaagacagttgctctaggagctgagttgctggtttggaagtgtggagattgcatttctggcttctctcaatggcttgtgttgaggactctgggtgctcctggccctaattgtgcaccctgatccccgtgcttggagctaggcctggtggcgtgctctagccctctcagttaccagctctttggagaaggatcaaaattcagatggaatgtgggatgggtaataggtgagagtagaaacccttccctccaggaggcccccgctgactcccacagaaacccacctaccataagatgtcttcaggtggccttgtccaaggatgggggtcaggcattttatatcaagggtgctctgaacatattttattttttaaaaaaactatgtttgtgaattttgcgtatactggcaagcttttgaaaatgtatttaattttgtattgtttaccaatgatttatttacaagatatttactcaaataaatggagctgcttacaagcctgttgacatgtgtggcttgcacaacacgtta

SEQ ID NO: 38599 - DNA, 2931 bp, Homo sapiens
gaaaacctcctgggggagcctgcggcgcggtcctttcctgtgtccccttcgctgcgggtcctgcccggggccgcgccaggtggaggccccgagaggcggcgcgtttcctgcgctccgggattgcgggagaagcgtgagtccctgtctccgagactagaggccacggacacccgcgcaggagcatcccctggcaccccgccccacgcccgtccttccggagtctacacatcggcgacctcccgtgtctaggcgcacacatttcccgccccgcggagactcccacgccccgggccctctctgccgcaggcgccagatcccgcctctgggggctggaccgagagggtcctcggcggcttctttaaggctgcggtccccgccccgtcgtcctccccgccctcctccctctcgccgcggctcctcccgccctcccagagcagccgggcggctgggcgcgcgcggcgcagagcaggtgccggggagcccttcgcatgcggctgccgggccggaggtggtagcggcgccgggcgcgctccgcccgcccctcctccgggccgcactgaggctcgggcgcgcggggacatgtcggtggcgacgggcagcagcgaggcggccggcggggccagcggcggcggcgcacgggttttcttccaaagcccccggggtggcgccggtggcagccccggctccagcagcggctcaggctcctcccgggaggactcggcgcccgtggccacggcggccgctgcagggcaggttcagcagcaacagcagcggcgacaccagcagggaaaagtgacagtgaaatacgatcgtaaggagcttcggaagcggctggtgctggaggaatggatcgtggagcagctgggtcagctctacggctgcgaggaagaagaaatgccagaggtagaaattgacattgatgatcttcttgatgcagacagtgatgaagagagagcttcaaaattacaggaagctcttgtagactgctacaaaccaacagagacggagtctcgctctgttgcgcaggttggagtgcagtggtgtgatctcggctcactgcaacctccgcctcctgagttcaaccaattctcccgcctcagcctcctgagtagctgggattacagacgtgcgtcaccacgcccggctaatttttgtatttttagtagagacggggtttcaccatgttggccaggctggtctcaaactcctgacctcaggtattcacccgcctcggcctcccaaagtgctgggattacaggtgtgagccaccgcacccggcctatcggaatttatcaaagagctgctttctcggataagaggcatgaggaaactgagccctccgcagaagaagagtgtatgattctggaacagggtgaaactctcccagagacgaagaaagagtcctgggatttgtacttcatgaagacttttgtgaaagaataggtgtccttatgaacaacgtttttgtttttttttttttcttttttggtgtgaaggtgggggggtctattagacatttattcaagagcgttctttttttggttttaaaggtttttgttaatgtaatattttaatagcaaagatatcatgactctagccacagcctaaccaaggattatcaaaggaggtggacactcaaggaagggccacgccaggctgcgtttcctgcaaggactcagatgttcagtaccttatgatacagggaagatagttttcttacaagtagtttggtaatattttttttcttaagttgtacatttgactcagctgtcaaatttctcacacttgtatatatctacacacaactaagttaaaatgttgatgtgagttttatttcacatggatggaataaacttgtggttgtcctttaactggaggtcccagcacatgtgttttcaagaggccactaggcattcttcactgagtgctgctgacttcaacgttcactttatgcaccaaagtgaaagaattcagtgtatccgttattttaatgcactacaccacagaaatgttaagttggtcaagggcttaatttatggaatttctattatttcattggttgggatgctttgccaggtcatgtgcttattgtctcattttgtagtcttttaaagttgtatgaacccttaatttgaagaactaacttgatttctagagaaatatccacactatctcagtggtattttgcattggaaaaaggaagcactgtgtagcagtgaattgtctgctttccaccgagtactgtgtttattctctctccaggaaagcagatcaaaagaaagttagcagatcgagtgtcttcttccttagaaataggttctggtagcttctgtgcctgggtagtatcagaccagtgggagtaaaccgagtgttaagtgtcaaggtgagaaagcctcacattctctcaagacagttgctctaggagctgagttgctggtttggaagtgtggagattgcatttctggcttctctcaatggcttgtgttgaggactctgggtgctcctggccctaattgtgcaccctgatccccgtgcttggagctaggcctggtggcgtgctctagccctctcagttaccagctctttggagaaggatcaaaattcagatggaatgtgggatgggtaataggtgagagtagaaacccttccctccaggaggcccccgctgactcccacagaaacccacctaccataagatgtcttcaggtggccttgtccaaggatgggggtcaggcattttatatcaagggtgctctgaacatattttattttttaaaaaaactatgtttgtgaattttgcgtatactggcaagcttttgaaaatgtatttaattttgtattgtttaccaatgatttatttacaagatatttactcaaataaatggagctgcttacaagcctgttgacatgtgtggcttgcacaacacgtta

SEQ ID NO: 38600 - DNA, 2593 bp, Homo sapiens
gaaaacctcctgggggagcctgcggcgcggtcctttcctgtgtccccttcgctgcgggtcctgcccggggccgcgccaggtggaggccccgagaggcggcgcgtttcctgcgctccgggattgcgggagaagcgtgagtccctgtctccgagactagaggccacggacacccgcgcaggagcatcccctggcaccccgccccacgcccgtccttccggagtctacacatcggcgacctcccgtgtctaggcgcacacatttcccgccccgcggagactcccacgccccgggccctctctgccgcaggcgccagatcccgcctctgggggctggaccgagagggtcctcggcggcttctttaaggctgcggtccccgccccgtcgtcctccccgccctcctccctctcgccgcggctcctcccgccctcccagagcagccgggcggctgggcgcgcgcggcgcagagcaggtgccggggagcccttcgcatgcggctgccgggccggaggtggtagcggcgccgggcgcgctccgcccgcccctcctccgggccgcactgaggctcgggcgcgcggggacatgtcggtggcgacgggcagcagcgaggcggccggcggggccagcggcggcggcgcacgggttttcttccaaagcccccggggtggcgccggtggcagccccggctccagcagcggctcaggctcctcccgggaggactcggcgcccgtggccacggcggccgctgcagggcaggttcagcagcaacagcagcggcgacaccagcagggaaaagtgacagtgaaatacgatcgtaaggagcttcggaagcggctggtgctggaggaatggatcgtggagcagctgggtcagctctacggctgcgaggaagaagaaatgccagaggtagaaattgacattgatgatcttcttgatgcagacagtgatgaagagagagcttcaaaattacaggaagctcttgtagactgctacaaaccaacagaggaatttatcaaagagctgctttctcggataagaggcatgaggaaactgagccctccgcagaagaagagtgtatgattctggaacagggtgaaactctcccagagacgaagaaagagtcctgggatttgtacttcatgaagacttttgtgaaagaataggtgtccttatgaacaacgtttttgtttttttttttttcttttttggtgtgaaggtgggggggtctattagacatttattcaagagcgttctttttttggttttaaaggtttttgttaatgtaatattttaatagcaaagatatcatgactctagccacagcctaaccaaggattatcaaaggaggtggacactcaaggaagggccacgccaggctgcgtttcctgcaaggactcagatgttcagtaccttatgatacagggaagatagttttcttacaagtagtttggtaatattttttttcttaagttgtacatttgactcagctgtcaaatttctcacacttgtatatatctacacacaactaagttaaaatgttgatgtgagttttatttcacatggatggaataaacttgtggttgtcctttaactggaggtcccagcacatgtgttttcaagaggccactaggcattcttcactgagtgctgctgacttcaacgttcactttatgcaccaaagtgaaagaattcagtgtatccgttattttaatgcactacaccacagaaatgttaagttggtcaagggcttaatttatggaatttctattatttcattggttgggatgctttgccaggtcatgtgcttattgtctcattttgtagtcttttaaagttgtatgaacccttaatttgaagaactaacttgatttctagagaaatatccacactatctcagtggtattttgcattggaaaaaggaagcactgtgtagcagtgaattgtctgctttccaccgagtactgtgtttattctctctccaggaaagcagatcaaaagaaagttagcagatcgagtgtcttcttccttagaaataggttctggtagcttctgtgcctgggtagtatcagaccagtgggagtaaaccgagtctgagttgctggtttggaagtgtggagattgcatttctggcttctctcaatggcttgtgttgaggactctgggtgctcctggccctaattgtgcaccctgatccccgtgcttggagctaggcctggtggcgtgctctagccctctcagttaccagctctttggagaaggatcaaaattcagatggaatgtgggatgggtaataggtgagagtagaaacccttccctccaggaggcccccgctgactcccacagaaacccacctaccataagatgtcttcaggtggccttgtccaaggatgggggtcaggcattttatatcaagggtgctctgaacatattttattttttaaaaaaactatgtttgtgaattttgcgtatactggcaagcttttgaaaatgtatttaattttgtattgtttaccaatgatttatttacaagatatttactcaaataaatggagctgcttacaagcctgttgacatgtgtggcttgcacaacacgtta

SEQ ID NO: 38601 - DNA, 432 bp, Homo sapiens
agcccaactgtaaatgccattgcccaattaccccttctctttcttctttgtattgtgaagggttttgttgtcaagaacagtagagagaggaatacgatccccctgtacactccaccttgattttcatgaacacggtgccacatttgtctcatctattttttcaatgtgttagatttttgtaattaaaatataattcacatataaaaaatacacagctagtggccgggtgtgatggctcacacctgtaatcccagcactttggtaggctgaggtgggcagatcacctgaggccaagagttcgagaccaggctggccaacatggagaaacccgtctctactaaaaaatacaaaactcagccaggtatggtggcaggcgcctgtaatctacttgggaggctgaggcaggagtattgcttgaacccaggaggtgga

SEQ ID NO: 38602 - DNA, 314 bp, Homo sapiens
agagacacagagtgcattgcccgggtgccacttcaaggaaggacttgctgcccagctgcagggagtgtggtcaacaggcggcctccagctgttagcaactgaagggtctgccttgactgcacaacacgtagtctttaacctcctggagttgattatctgaccaatgccaaatacagattggcccgaggtttcacccctcccagggcagcttgctgctgggggtataatggccagctatttcagccaggtgcccgcaaccctgaagagcaacctccactccaactccttttgggttgagtgagactttgtcctgc

SEQ ID NO: 38603 - DNA, 449 bp, Homo sapiens
caagttattccaaatgaaggcgtaagaaagggaataataacaataataagaggagttgttcatgaggaaaaaccaaagcttgaaaattcaacaaagccagtgaagctcattcttgaaaacatgaatcacactcatgaattctaactacaatgaaaaagagaaagaaagagcaggcatgcatttccatatgggagtgagccagcagacagccctacagatcgtacacacgttttccaaaactaacaatggaacaggcggcaaacctatgccaatatactagaaattgcagattaaatagatgaaatattctaaactggagtttacataatgaacataagagtaatcagagaatctgactcattttagatgtgtgtgtgtgtgtatatatatgtgtgtgtgtgtgaaaaacattgactataataaaaataatctcgagttcaaaaaaaaaa

SEQ ID NO: 38604 - DNA, 419 bp, Homo sapiens
aagaggttggctgctggatccttcttgaaaaggaagagcagacaggatttgctggcagattggagtgggtgtgagagaggagtaaaggatgataccagggatttttgtagctggtgggcgttgccatgtataaggaaagggaagacttgggaagaacagcgtgtggaagtaagatcaggagttgggttttgtgcatgttcagtttctgaagcttttggagagcagattggagatatgctggattggggtgttcactgctcaagggagagatctaggctgcagatagaaataggagtctttgggccgggcgcggtggctcactcctgtaatcccagcactttgggaggctgagacgggcggatcacaaggtcaggagatgagaccatcctggctaacatggtgaaaccccgtctctacta

SEQ ID NO: 38605 - DNA, 456 bp, Homo sapiens
taaacaatcaaaataccaaatgttttaatccacaaaactgaaagtctttcctggaagacaagtgacattacatttcttcaatctatattcattcaaatatatgctaaaagtattatatttcaatagaaagggataattctgtcttccaagatataagatacaaacatgataaaaaagtttttaaaaaaagtccaacaagggcagaagcactagtgtagagagttgggaggataaaagggcaaagccagaggcaagtatgataggttcagatcagaaacagggctgtctatgaagtcatacctgggtgctcatgcacccaaatttaaagtgtgtagaacaaatagtccagggcccaataaaagcaagtcaaaaaacaagagctaagccagctgtatcaatcaccagtcataagaacagggtccggactgtgttcatcatttttggaggtcagggaat

SEQ ID NO: 38606 - DNA, 802 bp, Homo sapiens
ggatgcagtgtgctggcgtggtcctctcctttctggttctctggtggagaaaggctatggctgtagggtggggcggcctgggaggttggcccgctagttgcagaggtggtcagcctaggttgatcaagggcttttcacaacagcagtggcattgaacgttcattttggagatgccagaaactcttagaaattccactgagtcccaagggcttccgggacttgaaaaggaaagacacatttctcatctcctgggaaggttccttcagttacctaaggcatcatcttcgctaatgatgtgttaagccaaccccaggtcctggagtcactggagctcaaagaggctcattcccacctgtgggcctcccccatggggagctccttggctggctatggcctgcgtttgcctcagagagtccttgttggggcctgaccaaggcagactttggggagaatggtccctggtgttgggttttctctctgatattttcttcgttacctacgtagacttaaagaaatgtgcctctgggttgggcacagtggcactgtaatcccactgctttgggaggctgaggcaggaggatcatatgaggccaggagcacaagaccaacttaggcaacatagtgagacccccatttctgcaaaaaatttaaaccattagctgggcgtagtagtgctcacctgtagtcccagctactcaagcagctgaggtgggaggatcgcttgagcccaggagtttggggctgcagggagctgtgattatgcctctgcagtccagcctggatgatagaggaagactctgtc

SEQ ID NO: 38607 - DNA, 594 bp, Homo sapiens
tcttttctactccctccctccctcctcctactatgtgctaggtagtatgtaaggttgagaagtggaaggagatgctaaagtcagagtttgaatgcctgagggagatgcagaagttcttcacttaattatattgagaaggcaaattccatcacatcaacatgtgtgccacagtcattcaaagagtgacactgattggctttagtatactggttctgacttttggaaaccatttcctaggaagccagcacttgttaaagcttcattgatgtgaagaattggagaggggaggagtagagaggtaccttagcattgtgagagtgtaaaattcggagtcttacagtgtgctggagccacggaaagctgattgtgaagagagcctctcttcccaactccacatttggtgatgtcattggccccttgaaatgggccacagtgggggtatttacactacagaaattggcaaatgccataaaactgagctatttttttcagagatatagttgttagaccagtaaaccactgagaggtccccacatgcaggaaaatacacaaataaatactcaagatacaggccaggtgcggccgctcacgcct

SEQ ID NO: 38608 - DNA, 604 bp, Homo sapiens
gtgtgggtgacgggtagaataagagcccttgaagcaagttcagaaattctaataagctgaaatgcagcagagactgcagaggcacaaggaaagggattagatacccaaatcctgcaggggttcaggaggctatgcttcaaagcccctttgattcctgcctttcagctctctctagcggtcaccaagcgcaaagttctatgcctggttttcaagtcatttaagcagtcttttctagagacctgctgcgtgtcagacactctgctagaatccgggaacttcaggaatgaaaggaacataagtagaaaaaaaccagaagaacacaaagagtttgtactacctaacttccaagatacccttttcttctctgggcgccagtacccagagagtaccgaccttagcgccaaaattcggtcctctctgaggcagatcaggagccaccacgcccccagtgaaatggaggcggcaggaatcccacccccaacccctcttcctctccccacgactatcctcccgggggcgagagtcgcccggaagaactacccgcgcctcggcattggtttcctgctgagccccagccggataaaattagtcgattgctcacact

SEQ ID NO: 38609 - DNA, 601 bp, Homo sapiens
gaccctatctcagaagtgaataaataaaacaaatacagcatttaaatgaattgacattgagaaatttacaatttacaaatttatattaactgtagtttccaaaatatgttactgttggtcctgtaagttacaaagagactgaagaactttctttttatacattagagcattttcccctggaatgagtattgattaaaaagataacatttattaattaataaaggcaatttaaaatttagtgttatttgaagactgtcaacatctgaaggtatgaaacttggtacagtgaaataatttctcctttctccttccttttagttattcccacagaaaactcagcccagtgggaatttgtcatattatgcccatgttttaaaaatattcatagtttgaatcttattgacattttaaagaagagttttttcctccctggaatgtaaaacaaaaatattttttaatgatgtggaagtatatatttcatgttcattatgataaatctacaaacaaatgaattgtttttatgggtggagttcttctataagagtatattaaatgctttcagagttgtattaattttgtttctaaataatataccacttat

SEQ ID NO: 38610 - DNA, 230 bp, Homo sapiens
ccacaatgtttttggacctgttatccctcagcctttgggaaagagaatgtctttttctcctgttttatgagctgtgtagtgtgcgtgtgtatcttagtgaactaagattggatactaatctgggatcagaatcctgaatatggcttaaagatgtacgtcttagtacagacatttatagatgatgatgtttaataccgtagcgatcagattccaatgaattaaactgagag

SEQ ID NO: 38611 - DNA, 1013 bp, Homo sapiens
agtttcacatttatcaatctgaaaacttagtttgcagattggtaaatcagggtacttgacaagaataaatatggtacgcctttatatattcatgtgttacatgccagaaatgagtctgtttctggaccctgttcaaggaaatagtgatgactgagagaggtacagggaaataaacacccaagggaaacaacagaaataagcctccccaactttctaaaaaactgctcagcattatctctgtggattctgggtaaattcagctttttaacatcagctagtcactaatgccagaaattccacttcaagtgtatttattttcttgtgttaagcattattctacctggtttatgtctacaatgtagtattagtgtacttaggattcttgacacctcagtgtgcaataaataaaattttgaagttgttgtttttcatttgaaggtgagaccacagcccctgagttgctaaggggacctgggaatcctaggggaatggaggtggtggacgataagaggatggttgagggcaggagtttaaaggacacagaagctaggagagcagaaaatgtactccaccaccttctgtctaacttgtctcttaaaagtgcttttacattttaacttttttaaaaaatgtgggccgggcatagtggctcatgcctgtaatcccagcactttgggaggccgaggtgggcggatcacctgaggtcaagagttcaagaccagcctgaccaatatgatgaaaccccatctctactaaaaatacaaaaatagccaggtgtggtggcacatgcctgtcatcccagctactcaggaggctgaggtgggagaatcgcttgaacccgggaggtggaggttgcagtgagccgagatcatgccattgcactctagcctgggcaacgagagtgaaactctgtctcaataaataaataaaacacctggagaacagaacttccaacatattcctgaaaatgatatgtgggggggactagagggggggcaacaaaggtttgaagg

SEQ ID NO: 38612 - DNA, 1750 bp, Homo sapiens
agtttcacatttatcaatctgaaaacttagtttgcagattggtaaatcagggtacttgacaagaataaatatggtacgcctttatatattcatgtgttacatgccagaaatgagtctgtttctggaccctgttcaaggaaatagtgatgactgagagaggtacagggaaataaacacccaagggaaacaacagaaataagcctccccaactttctaaaaaactgctcagcattatctctgtggattctgggtaaattcagctttttaacatcagctagtcactaatgccagaaattccacttcaagtgtatttattttcttgtgttaagcattattctacctggtttatgtctacaatgtagtattagtgtacttaggattcttgacacctcagtgtgcaataaataaaattttgaagttgttgtttttcatttgaaggtgagaccacagcccctgagttgctaaggggacctgggaatcctaggggaatggaggtggtggacgataagaggatggttgagggcaggagtttaaaggacacagaagctaggagagcagaaaatgtactccaccaccttctgtctaacttgtctcttaaaagtgcttttacattttaacttttttaaaaaatgtgggccgggcatagtggctcatgcctgtaatcccagcactttgggaggccgaggtgggcggatcacctgaggtcaagagttcaagaccagcctgaccaatatgatgaaaccccatctctactaaaaatacaaaaatagccaggtgtggtggcacatgcctgtcatcccagctactcaggaggctgaggtgggagaatcgcttgaacccgggaggtggaggttgcagtgagccgagatcatgccattgcactctagcctgggcaacgagagtgaaactctgtctcaataaataaataaataaataaaaaataaaaaagtgtgaacttaaatatatttatatgtgtgtacatatattttcttttttaatattctggttaaatgagaggccatcgggcctctttttaagagtctaatgatgtgtatatctaatgcccattccagctggattgtaacactgcttggggaagataacttaaaaaaaagtagtaccgagattacagcagctagtgtcctaaatggaaaagaagtgaaactaaatgtcataggagaaatcctttcagttttgtgcagtggttcatttgctgttaaatctaccccattaccattccccttactccttgaaaataaagtgatcttcatgttacaaaaaaaaaaaaaaaaaaaaaaaaaaaaaaaaaaaaaacaaacaaaaaacaaaaacaaaaaaaaacgagagcaaagagcacccgcaggggagcgcagacagcagcaacgctgctacacaggagagcgagagatgagagacaaagtgtcgtagaggagtgttgaggcacaccagggacgcgaggcgagaggagcggcgacaagcgtgcggagaggatggcgagacagaagagcgagaagaagcggacacaaaaagagaaaaggaagagggagaggaaagaggggcggggaagagagggtaggaggggcgagaggaggagacagagagatacaagagagagagggaaagaggaaacgaaaggaggaggggaaggatgagtgggcacggcggtagacgacggagggggggaaggtggatagacaagaagaaagaggcggtaatcgagagcggggagaagaaagagggagagaaagag

SEQ ID NO: 38613 - DNA, 1008 bp, Homo sapiens
aattctcccacagggagaggccccgtgggtattctcccacaatctgcagcctccaccaggccttgagtagctttgggtgcagagccaggagggcgtttggctgtcctaggtctagcccctggcccaatcccagccccattccaggcccactcaaaagccaaggcccaatcccaggtccaggctcaatcctaggccctggcctgattccaagccaggcttactcccaggcccaggcttagtcctagccccaatcccaggtcctggcccaatcccaaacttaggatccctcccagccccagccctagtccccttgtgacctcagagcacttatgcctccaatttcttgccagacagtcattccctgacttcacagagctcctcccacccctagaccagttcgaggaatccttggtctccaccacgacatctcagtaccaagagggggatggctctatggacaaaaagactcgggccccaagtgattaatggatttatagggggcctgtgtctgcaaagtcctgcggataccagtggacctggagtggctggttggtctacactgctggtgaatgcaccaccaccatttaaccaccctgccgctggtgggcatttgctgtcttcactgtgtggccatcacgactagctctgctatgaatgcacctgccctcatttgagttgagcctgagcatttcgcagctgggattggagtcgctgctcatggggatgtttggcattagtggatgctacttgagagctttgtaaagagctttactcagcacttctgatagtcagcattctccctgacacttaggattgtgagactttttaatgtttgtggatccaatggcttatggcttccctgatgactgagaggttgagaagttctcacatgttaattgaaccttagaaatcctcatatgtgtccatttgtttgcccatttttcttcatttatttgaatgtatttttatattctcttgataattaaagtgctgcaaacaccccccaaa

SEQ ID NO: 38614 - DNA, 437 bp, Homo sapiens
gaactattatgactctttgaggtctatgaggcttcatccctgtggtaaggggccagaccacctgtaaggaagtggtgttcccactgctggtcatcctggggcaaggctggagaactgtttcttctcttggttcctgttgtcttgggccttgcctctgcagaataagatgcacttgaagactttttcccaggtcatggggaatgaagacttctccttgcagggaggaggaataactggacagcccccaaagagtacccacatagggccaggcgcgggtggctcacgcctctcatcccagcactttgggaggccgaggcagacagatcacgaggtcaggagttcgagaccagcctggccaacatggtgaaaccccatctctactaaaaatacaaaaagtagccaggcatggtagtgctgcatgcctataatcccagcta

SEQ ID NO: 38615 - DNA, 410 bp, Homo sapiens
tatcatggtgtggtccaggactggtggtacccttcactctgcaaagcccctgtaagggagacccaccgtcctggactgcagattcttcccacaaataacctttgaaggacaatgggcagcccacagttaaagataacaaggatagaaatggttaggcgaatattcatggagagacttgagtccgtttggcaaatcgggctgatttccagtgaatacctacagtgggcgtaggacaattaaacatgtcaaaaatgtagtctcccctgtaaacattagattctcctagtaattggccgggcacggtggctcatgcctgtaatcccagcactttgggaggccgaggtgggcggatcatgaggtcaggagatcgagaccatcctggctaacacggtgaaaccccgtctctacta

SEQ ID NO: 38616 - DNA, 571 bp, Homo sapiens
tggtgaagtaaccatctttgagactgaggttgggttttttgagctggggagattaaggtggcagtgagctatgattgcatcagtacactacagcttgggtgacagctacatataaatatgtatatataaatatagataagtaaataaaagccatctttgtgccatgcatggtggctcactcctgtaatcccaacactgggaagctgaggtactgagatgggaggatgacttgagaccagcctgggaaacatggcaaaattccatctctacaaaaaatgcagaagttatcccagggtggtagcatgtccctgtagtcccagctactcggaggcctaaggtgggagaattacttgcaaggtcaaggctgcagggagctgaggtggcgccacaaccctccaaacggtgacagcccctgtctccaaaaaaaaaagtttttaaactttccaattgtaaaaggatcctagttttataaaataggaatgtgttttgccttccccccatagagagccagacatgtttgaaatgtagtatttgagaagcacaaaataaacgtcttaacattatagaactg

SEQ ID NO: 38617 - DNA, 492 bp, Homo sapiens
agcttgctgctttcctcccctcgcgcctctagagcccatgaaggagctctggtgctgggcagagactcccagtggttcaggggctaggcatagtggggacctttctcaggggcactgacaagtgccttagcgagtttggcatggaagaacatgaacagaaagctggggcgggggggatgcgtagagttcctgcaattatgcggggtggaggggggctgagagttattatgatttatatttcattaaatatgatttcatctgtatccaaaggaaggtgaggcttcaaacattcagtttatgcatacaaaaagccaaggaacacagtttgcatctccagccaggtcaatggccaatgataagaggatgcagaagactcagtttctcaggagcacaaccagagtctgggcagcacctctgatcttctgcggggtgctgcgagaaccatgtggccctcgggaaagcatgagctgggtgcccttggctgaggatagt

SEQ ID NO: 38618 - DNA, 825 bp, Homo sapiens
tttgagacagagtcttggctctgttgcccaggctggagtgcagtggcactatctcagctcactgcaacctctgcctctcggcactacaggtgtgtaccaccacgctgggctaatttttgtatttttagtacagatggggtttcaccatattggccaggctggtcttgaactcctgacctcataatctacctgccttggcctcccaaagtgctgggattacaagcgtgagccactgcgcccggccagaccactataaaggataaaattatgagttaatatatgaattaaaaacagaacaagtccacactgatctgaaagtaagtgtggaggcaggaggaagagaaacatcttctttagagaagaaagccaaataattaaatacataagggattacagaaatagaaaatcaccatttttacaatcactatagtatactattactgattcaggtaagaatcagtgaatactaaaacaactatgtgaaagactgtcgggaaaaaggattgtcacagtgtcaaaatatcattcccacagattgccttattaattacaaaaagaacaaagtacctttacaactgggaaatctggaagcactgccttaaccaagtgatcaaacttactaccaccaatgataagcacaaattcacaccatgtgccttctaatgcaatatactaatatgcattcgaatgcatattctaatgcaataatccatgtactatgcttgacaaacacggttaacctgaatttaatcatgaggaaacaatcaaacaaatccaaactaaggtggcataaaacaactagcctggattcttaaattaaaaaaa

SEQ ID NO: 38619 - DNA, 500 bp, Homo sapiens
aaggttgtggtggcctttgtgcaggttgtaaatttttgtagtcttttgatagttcttgttatcaaccatatgtacatgagaacccttccccttcatggcgtttcctggctccgtttgccagggttttaatacgagtgactccattttgaatctgacaactttcacatttccccttttgatcaaggtctttctcaaaagcatcactgatcaatcatcctgtatttaggttttgatatctcttggtgccagtctgccctcatgttgaagggagtcactggtaactaggaattagcatcaaaaccctttagccacatttgaacaacaaaagaggtttggagggagtggatctcaggctaagtctacctggagtccactgttaagttcaattctgtctgttccataggcactgtctatcatctcaaagtgctgggagagcattattctcttaggagttgcatttctatgcaaatttgacaagaaacaggtatgaagttcttaaa

SEQ ID NO: 38620 - DNA, 390 bp, Homo sapiens
ataggccccagtgtgtgttgctccctactatgtgtccatgtgttctcatcatttagctcccacttataagtgagaacatgtggtatttggttttctgttcctgtgttagtttactgaggataatggcctccagctgcatccatgttcccgtaaaagacgtgatctcatttatgtttatggctgcatagtattccatggtgtatatgtcccacatctttatgcaatctgtcattaatgggacttaggttgattccatggctttgctattgtgcatagtgacagcagagattcttgctgcccagaaatttatggagaaaaaggccacagcagtcgctgattttccatagctttaactgacttggaccagatttgtgcactaacaaataagga

SEQ ID NO: 38621 - DNA, 292 bp, Homo sapiens
tgtttctactaaacacgaaatctaaactatttcctggaaactccaggcatttcataacaccccttcctcctcctcctgcaattcctcagtgtgtgcccctaaagtgctcagccccactgccacagccccacttctgtgaaatagcatttccccctgccccaaccttcaaggccacttcaggcctcattccctccaggaaccttcctgccctgccctccctgttcacctccccaacactgtattttgtagcttggtgtagtctctatttcagcaagaaagaagccgtcctctt

SEQ ID NO: 38622 - DNA, 1428 bp, Homo sapiens
gtgctgtgaggcttgcccgcggacagtaaacttgcaggggcgagagggagggacatcgattaaacctaaatcgtgggcgttcagtcctcagggcaccgagcgcgtgaaaactccagcggactctgctggaaaggagatcatgccctctaagtctctttccaacctctcggtgaccaccggcgcgaatgagagcggttccgttcccgaggggtgggaaagggatttcctgccggcctcggacgggaccaccacggagttggtgatccgctgtgtgatcccgtccctctacctgctcatcatcaccgtgggcttgctgggcaacatcatgctggtgaagatcttcatcaccaacagcgccatgaggagcgtccccaacatcttcatctctaacctggcggccggggacttgctgctgctgctcacctgcgtcccggtggacgcctcgcgctacttcttcgacgagtggatgtttggcaaggtgggctgcaaactgatccctgtcatccagctcacttccgtgggggtttccgtgttcactctcactgccctcagcgccgacaggtacagagccatcgttaaccccatggacatgcagacgtcaggggcattgctgcggacctgtgtgaaggccatgggtatctgggtggtctccgtgttgctggcagttcccgaagcggtgttttcagaagtggctcgcatcagtagcttggataatagcagcttcacagcatgtatcccataccctcaaacagatgaattacatccaaagattcattcagtgctcattttcttggtctatttcctcataccacttgctattattagcatttattattatcatattgcaaagaccttaattaaaagcgcacacaatcttcctggagaatacaatgaacataccaaaaaacagatggaaacacggaaacgcctggctaaaattgtgcttgtctttgtgggctgtttcatcttctgttggtttccaaaccacatcctttacatgtatcggtctttcaactataatgagattgatccatctctaggccacatgattgtcaccttagttgcccgggttctcagttttggcaattcttgtgtcaacccatttgctctttacctactcagtgaaagcttcaggaggcatttcaacagccaactctgctgtgggaggaagtcctatcaagagagaggaaccagctacctactcagctcttcagcggtgcgtatgacatctctgaaaagcaatgctaagaacatggtgaccaattctgttttactaaatgggcacagcatgaagcaggaaatggcaatgtgattttggccattcaactcactacctggagagaacttagtaactgttaaaattcctattcggcagatcagaacttgctgttgcttagctaatttattaggcaattgcatgattgactc

SEQ ID NO: 38623 - DNA, 1438 bp, Homo sapiens
gtgctgtgaggcttgcccgcggacagtaaacttgcaggggcgagagggagggacatcgattaaacctaaatcgtgggcgttcagtcctcagggcaccgagcgcgtgaaaactccagcggactctgctggaaaggagatcatgccctctaagtctctttccaacctctcggtgaccaccggcgcgaatgagagcggttccgttcccgaggggtgggaaagggatttcctgccggcctcggacgggaccaccacggagttggtgatccgctgtgtgatcccgtccctctacctgctcatcatcaccgtgggcttgctgggcaacatcatgctggtgaagatcttcatcaccaacagcgccatgaggagcgtccccaacatcttcatctctaacctggcggccggggacttgctgctgctgctcacctgcgtcccggtggacgcctcgcgctacttcttcgacgagtggatgtttggcaaggtgggctgcaaactgatccctgtcatccagctcacttccgtgggggtttccgtgttcactctcactgccctcagcgccgacaggtacagagccatcgttaaccccatggacatgcagacgtcaggggcattgctgcggacctgtgtgaaggccatgggtatctgggtggtctccgtgttgctggcagttcccgaagcggtgttttcagaagtggctcgcatcagtagcttggataatagcagcttcacagcatgtatcccataccctcaaacagatgaattacatccaaagattcattcagtgctcattttcttggtctatttcctcataccacttgctattattagcatttattattatcatattgcaaagaccttaattaaaagcgcacacaatcttcctggagaatacaatgaacataccaaaaaacagatggaaacacggaaacgcctggctaaaattgtgcttgtctttgtgggctgtttcatcttctgttggtttccaaaccacatcctttacatgtatcggtctttcaactataatgagattgatccatctctaggccacatgattgtcaccttagttgcccgggttctcagttttggcaattcttgtgtcaacccatttgctctttacctactcagtgaaagcttcaggaggcatttcaacagccaactctgctgtgggaggaagtcctatcaagagagaggaaccagctacctactcagctcttcagcggcatagtcctaaagctttacatttactatctaatttaatcatcaatataatcactgaggtgaacaagagaaggatctaatttggcgagatggataccagatgtgttcttgatctggagagactgtttcattaactcacagaaaatgaaggtgaagataaacatggctggtctgttattcttttttactttcttatgtcaagtaataaaaaagcaaaaataaa

SEQ ID NO: 38624 - DNA, 470 bp, Homo sapiens
gcctactactactaaattcgcggccgcgtcgacactttttgtgctttaaatcatacattatacactgctttatttgctttacatatattatcagatttctcatattagcccataataaggtagacattactatcctgattttacattgaagaaactaaaatattcagaggttaagtaaattactcaaggtcacacaggtaagattaaagtttaggtttcaaattcaggtatgtttgctacaaaaccttgtcactgtgttagactgcctctaaagtgagtaaggtaaatgaaataaatgctttgtatgtttaaaattttgttataaaggaaaggaaataatgaattaatgaaatgttcaaattacagactttaaagtaaatacagatttcgttttatactagtcataaggtaattcagtgttagtagttaataccattaaatataatgtgataatcagctagcgaaaaaga

SEQ ID NO: 38625 - DNA, 239 bp, Homo sapiens
atgagtctcggtcatgtaatctacaaaatgagggaaatgtttccaattcctatggacttcagataataattcagttataaattagattcctatttcagtgattgtctgtgtttagcaaagcatgattatatcctcttccccttcagggtcaacactggctctgacttcctgggccagcttctgttgacggcatctccaagtctaggcaactgccttggtcttgctgtggatctaaattg

SEQ ID NO: 38626 - DNA, 456 bp, Homo sapiens
ggccctactgatgactaatcctcagttggggagtgggagaagctgagtgtcacagagagaacacagcctcaggatggagacagccaggccccactcaccttgtgactgcaggaagcaccgagcctctctgagctctggtctcaccaccgggatgaggccacccactatgtgcgtgcagatgcagcaggcagcctggctgtggaggggaaggagggcagcaggcaagggttcaaggtgtggagcctatagggcagcacagctgccagtcatgtggtagtggaagctcagaacatcggagatgggtcctctccagcccccggttcctcttgctgagtcccacattgcctgtgctctcctggttaccgagcaagcagcagccattacaatggggggccgtggagagtggcgatggggctccttagtttccagctgagccctgcagggaatggcttttag

SEQ ID NO: 38627 - DNA, 776 bp, Homo sapiens
ggagatgaatgaggtgagtcctgtgattaccccggtttaatgttttgagagagagtccagtctgtagtgcaggggggaagaacccaagtcgagcctggaagactccctgactagaaatagagctaaaagttgggagtgaataaagtgacaagagtcactggaatgtctaccaggcaagatatctgaagatctgtaactccctttgagttttaagctgagcaataattagcacatgcatggaaggaaactacctgaggccaggaacagaatcacctggaaggacagaggtaacagtgtctggcattcacacagagtcaacatagtgcctgttacccagaaatcacactggaaaacctcatgtttcataaggcatttggtagaatactcagaaaggtcttgtcttggtaatgggggataattagccctgtaatacgaggactgctctcgtcccatttaataaatcatgaaaccaaaacctgaaaggattgaactattttcacatacattaactgtgtcccagaacaaagctgatttggtttggctgtatctccacccaaatctcatcttgaactgtagttcccatgatccctacatgtcatgggagggacccagtgggaggtaatttaatcatgggggccgttactcccatgcttttctcatgattgtgagtgagttctatgagatctgatggtttatgaggggcttttccccttttgcttggcacttttccttgctgctgccatgtgaagagggatatgtttgcttctccttccacc

SEQ ID NO: 38628 - DNA, 362 bp, Homo sapiens
tctaaagaaaacctgccttgcaaaggaaaatgctttcttactttgaatagaaagtgaaagataacttacaaaatcacaaaagagcaatgtgtttcctaggtaggtatgtttttgaaagagattgaagatagacattactactagcctgccagcccctactagcctgccagccccagacttactgagggtgaagaaagcttgaaataatttaagagaaaggtatagtgctttcccaagagctctactacaagcaagtctgatgctaagcatctaacttatttattagcctataaagagaaagtaaaagaaatggagaccataaaaatcagataagagattcatgtatagcagattcacagagg

SEQ ID NO: 38629 - DNA, 787 bp, Homo sapiens
aaagtactgggattacaggtgtgagccactgcccctggcctattccagattcttaatctgggatccatgcacctctgaaggcatatataaatcccatgaaattgcaaaattttgtgtaaacgtgaattgttttagagagggagttttaaaaatcagtttcttaagggaacttatggctcaaaagtagttaagaaccattgttttatggttatttgagaaccttctgtgcctaatggtgatttgagaaccttctgtgcctatgtcccatcatctcctccatccttccctcacacccctcagcctctaatgcccagcccccttgcttttgtggtctgcctttgaccccttaagtttctgctctttgggcagctgctatgtgtaccaatttggcattgtttagtctttttggcttctacactttgaaacattagtgctttgctgtcctttagcagtgctttggctgtcagaaatgaaatttctgggctggccatggtggctcatacctgtaatccaagcactttgggaggctgagtggggatgattgcttgagcccaggacttcaagaccagtcctgacaactgacaacatagcaagatcccatctcaaaaaaaaaaaaaaaagaaaaaattagccaggcatggtggtgcatgcctgtagtctcaactacttgggaggtagaggtggaaggatcacttgaacctgggagttcaaggctgcagtgcatcatgattgtgccactacactgcagcctgggtgacagtgtaagaccctgtctaaaaaaaaataa

SEQ ID NO: 38630 - DNA, 372 bp, Homo sapiens
tcttgagacagggattctctatgacatccaggctggagtgcagtggcaagtcacagctcactgcagccttaatctcctgggctcaagtgaattatgatagtcactacactacagcctgggtgacaggatgagagcctgtctggagaaaaataataataataatataacttatgccttattcactgaattagtattttgcttggatccctgagccaccataaaagaagtgagaagaccttaaggctgccacactatgaggaaggcaaggtaacagactacgtacaggtgctcaagtcagcagtcacagtctttgagtcctgttaggcaaggcaccaaacatgagtgaacaaactttcagattattccaacatc

SEQ ID NO: 38631 - DNA, 292 bp, Homo sapiens
gcactacaaagtctctagagcaaatttagaccctattatcagatcaagagtgctgtaacctcaaatcaacattccccagctggctcagagtggaacctacctcaaggggtcacttaggtaacctttaagtcaaggagacagcctttctctccttggtctcgaacaccatctttggaaaacaaaatgtgtataaaaactacgaagggctgcatgcagtttggttagaaactctgggggaacaaaacagagtggtagaagacatttctaccagattctacaaccaggtcaaagt

SEQ ID NO: 38632 - DNA, 588 bp, Homo sapiens
tcgcctaggctggagggcagtggcatgatctcagctcactgaaacctccacctcccgggttcaagcgattcccctgcctcagcctcctgagtagtgtgggactacaggcgtattcaccatgcccggctaattttttttttttagtagaaacggggtttcaccatgttggccaggatggtctcaatctcctgacctcgtgactcgctcgcctcagcctctgaaagtgctgggattacaggtgtgagccactgcgcctggcctatatgaattttatatttacctgctcccttcaccaggagatcatgctgctgtgatgtcgagttttcttaacagcataaggaagacttgccctcttgccctatcaaagagaatagttttggaggggagaagtgggaccaaaaaagatgcagttttcatttgtattgggaaatgtgaaaataaaattgacaactcttttagttaaaaacaaaaaaaagaaaaggaaacaagatgtggggctgccatatgtaataccgtggattccacggatcttctactctggaggcaaatattatctttgctgaagccagaccaacctgacacaaagac

SEQ ID NO: 38633 - DNA, 616 bp, Homo sapiens
actggaattctctttgttctgcccgacatttgggggtgtccaaggacctgtgtttttaacaaagatgactttatgaccgttctaaggattgaacagattcctgcacagggtgccaggtttcaagttaggtcctcttagtataagctctctttttttctgaatgtaaacctatttgcattgtcatttctaataatccagtaggtttctggatattgtaaagatactgagtacagatataactgtgtaaatttcatagtgttttattttgaggtgagagttttgttatagtttataaaagatattttcctattcagacctcagggctattttgggacctacaaataaatgtgattcccagcagcttcaatttttgatattcaaaaagttaataatctttaagctaaatataatgtgatatgattcagaaaaaaatgtttttcccttttaacttctaacaaattatgtatctaatgtttaaaaaatatggaaaaaagggataatgtaaaaatgtgggagaattgtggctaaagaataaaaaatcacttgttaaaacgcattcttatggtacaaatgtgtgatatttaaataaacttaagtgtgtataaattagagaatg

SEQ ID NO: 38634 - DNA, 494 bp, Homo sapiens
tgggtgagctcgtgggaactgagaaactgtgtctagggcttccttagttatactgaatgctgcatgtagaggtctgcagggtggccagctgatggctggcggaagatctgctgacttggattcagttactactaaaatggcaggtttagaaagaggagagaacttctagatccagaggaaataatcaggtaagtatgctaagatgtgtgtatgtgttagccaggcacggtggctcacgcctgtaatcccagcactttgtgaggctgaggcaggtggatcaccaggtcaggagctcaagaccagtctggccaacatggtgaaaccccgtctttactaaaaatacaaaaattagctgggtgtggtggcgggcgcctgtaatcccagctactcgggaagctgaggcagagaatcacttgaacccgcaaggcagaggttgcagtgagccgagatcatgccactgcactccagcctgggcgacagagcgagtttccatc

SEQ ID NO: 38635 - DNA, 1360 bp, Homo sapiens
tggggcccgagctcggaggcggccgggcggcgcggagtcctcctggatcgtggcaatgggcagacacagagcagaaagtggcggacttgggcggccacaggtaactttctcgcaaggagctgaattctttcactaaagggtacaagcccgagggacgagctgcgcgatgattggctggggagctccctcaggtgagctgccattggcagaggcgcgctcaggtaaggcccttctccgagtgcaggtaactcactccgaagtttacctgagtggagcggcggcatgcttgcagctcggcggcagcctgtgagagctgagggtcagttcttcgagtagatctcaagctgcgttttcctccttctccaaagcagggatgggaaggtggaggctactggttgaagagaagaaaggggttgggggaatgcaacacctgcaaacactagggattgtgggtcgagcggaagagctaatgagagccgagctcaggtatcccaagtcaaccagaatcaaatgcgcagtacgccacaaggcatttaatgcccacagtaacagggctgtttgacagtggcagaagaggacgggactaaagttactttgtgctgagagggggaaagaagcacaaagtttggtctgttgcgtaattgaatttttaacactcttatccacaacaaacactttttcgtgtcctgctgtgtaaaagacatcagatatattacagattttcaaacaggtgagcatccttttacgagctgggcaggtggggagtggcgtggttttgatggagtgaggagatttggttgaatgaacgctaagatggccagacgcacctcttcgatctcaactctgcagcctgggattccagagctgcaaacaaccactgaattcgttctgtaaacctgttgtcatttgacgtttccaggcaggcatcaacatttacattgtaattcaatagacgctactactacaaaggagctttattcttccagcttaatatggttgctgcgggaacactgcaggatgaaactgactttttttgtggtaatgtttctcctggttgggaacaacgcaaattagcaaaggcgtaatttataaccgctgctaccaaagagtgaagtatttgtggaagttctgactggaatctagctcgtacatatggattgtggaaataaaggaggacgtggaaagcttgccatattttatttcaagttaatactaaagctgccagacttaatacaactttcttttaatctttatggatcacatattttctgaaaattacatgataaaacaaggtttggtttgttccatgtgtccattttcaacaataaatttcaaaattgtatttttaaaaaacaatata

SEQ ID NO: 38636 - DNA, 1098 bp, Homo sapiens
ggcccagccttctccagtatctcatcagcaacagcctcagcagtctcctttgccacctggtattaaacctaccatccaaatcaaacaggagtcaggtgttaaaatcatcacacaacaggttcaaccaagtaaaatcttacccaaaccagtgacagcaactctacccaccagtagcaattcccctattatggtggttagcagtaatggtgcaattatgacaactaaactggtaaccactcctactggcacacaagcaacctatacccggccaacagtgagcccatccattggtcggatggctgcaacccctggagctgcaacctatgtgaaaactacgagtggtagcatcattacagtagtacccaaatcattagctaccttggggggcaagataattagcagtaatatagtttctggaacgactaccaaaatcactacaatcccaatgacttccaagcccaacgtgattgttgtacaaaagactacaggaaaaggaacgaccattcaaggcctcccgggcaaaaatgttgtcacaacgttgctaaatgctggaggagaaaagactattcagacagtgccaacaggagcaaagccagctatccttactgctacaagacccatcaccaaaatgattgtaacgcagccaaaaggaataggttctacagttcaaccagcagctaaaatcatcccaacaaaaattgtttatgggcagcaagggaaaacgcaggttcttattaaacccaaaccagtgacttttcaagcgacagttgttagtgaacaaacaagacagctagtaacagaaacattacagcaagcatccagggtagcagaggctggtaattcatctattcaggaaggaaaagaagaaccacagaattatacagatagtagttcctcttctacagagtcctcccagagttcccaaggtaagatctattttacttctgatttatataagtactactgacatagtgcccaaattctaaaatagaggttgcttctacacatttcacaacaaatttgtatgctctatcaattcttttccttttttttttttttttttattgtttgatgttaaatcggtgagctgaaatttta

SEQ ID NO: 38637 - DNA, 995 bp, Homo sapiens
ggcccagccttctccagtatctcatcagcaacagcctcagcagtctcctttgccacctggtattaaacctaccatccaaatcaaacaggagtcaggtgttaaaatcatcacacaacaggttcaaccaagtaaaatcttacccaaaccagtgacagcaactctacccaccagtagcaattcccctattatggtggttagcagtaatggtgcaattatgacaactaaactggtaaccactcctactggcacacaagcaacctatacccggccaacagtgagcccatccattggtcggatggctgcaacccctggagctgcaacctatgtgaaaactacgagtggtagcatcattacagtagtacccaaatcattagctaccttggggggcaagataattagcagtaatatagtttctggaacgactaccaaaatcactacaatcccaatgacttccaagcccaacgtgattgttgtacaaaagactacaggaaaaggaacgaccattcaaggcctcccgggcaaaaatgttgtcacaacgttgctaaatgctggaggagaaaagactattcagacagtgccaacaggagcaaagccagctatccttactgctacaagacccatcaccaaaatgattgtaacgcagccaaaaggaataggttctacagttcaaccagcagctaaaatcatcccaacaaaaattgtttatgggcagcaagggaaaacgcaggttcttattaaacccaaaccagtgacttttcaagcgacagttgttagtgaacaaacaagacagctagtaacagaaacattacagcaagcatccagggtagcagaggctggtaattcatctattcaggaaggaaaagaagaaccacaagattcccagcctgtagttcatgtaattgcttcccggcgtcaggattggtcagaacatgagattgcaatggagactagccctaccataatttatcaggatgtatccagtgaatcacaatcag

SEQ ID NO: 38638 - DNA, 946 bp, Homo sapiens
ggcccagccttctccagtatctcatcagcaacagcctcagcagtctcctttgccacctggtattaaacctaccatccaaatcaaacaggagtcaggtgttaaaatcatcacacaacaggttcaaccaagtaaaatcttacccaaaccagtgacagcaactctacccaccagtagcaattcccctattatggtggttagcagtaatggtgcaattatgacaactaaactggtaaccactcctactggcacacaagcaacctatacccggccaacagtgagcccatccattggtcggatggctgcaacccctggagctgcaacctatgtgaaaactacgagtggtagcatcattacagtagtacccaaatcattagctaccttggggggcaagataattagcagtaatatagtttctggtaggtatatctgaaatatgttaaaggtataggtggccttcattgagaggaaaaaaaaaacttacttcattgaaggattatatttgatctcaattttttgcttagaaatctaaagctttgttttagtccttatgtttcatgattaaataaagtttttagttttaatattcaatattcacatataaagcttttgatagttttaaaatggaaagaacctttagttgcttttagtcagagtggaaagattatagtttaaatttgcatagagatttttcatttgcaaagtatccttctatttgtcaacctattcagaccccataacaactctgaggtggttgctattgtgctgaatttacaaatgaagatagatttggctttagagagatcaaattgacctgtccaagaccaattagagttagaaagtggaagaactcttatttgttctgaatatgttttagggaacatatctcataatttcaattactgatgtcactttagtttattaaaaataaaaatatttgaatacttta

SEQ ID NO: 38639 - DNA, 2547 bp, Homo sapiens
aggagtgtgggaggggcagtggaactggagtcagctaatggctgacgcactacgcgcagagggaaagacgggtcaccaatagcgacacggatatggccccgcgggcggggtttaggcccaaagtggtgtcggagcagcgcctattagtgtcatcctcaccgtcacggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcagttgtcacaggtagtactgatggaattggaaaatcatatgcagaagagttagcaaagcatggaatgaaggttgtccttatcagcagatcaaaggataaacttgaccaggtttccagtgaaataaaagaaaaattcaaagtggagacaagaaccattgctgttgactttgcatcagaagatatttatgataaaattaaaacaggcttggctggtcttgaaatcggcatcttagtgaacaacgtgggaatgtcgtatgagtatcctgaatactttttggatgttcctgacttggacaatgtgatcaagaaaatgataaatattaatattctttctgtttgtaagatgacacaattggtactgcctggcatggtggaaagatccaaaggggctattctgaacatttcatctggcagtggcatgctccctgtcccactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatgggctcgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactctttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcttataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatgaaaaacaca

SEQ ID NO: 38640 - DNA, 2232 bp, Homo sapiens
  misc_feature (44)..(44): n is a, c, g, or t
taaatataaatctcacgagtaattaatatatagaatataaaaancttaactgcaactgatctcttaattttccaccgctacagttgtcacaggtagtactgatggaattggaaaatcatatgcagaagagttagcaaagcatggaatgaaggttgtccttatcagcagatcaaaggataaacttgaccaggtttccagtgaaataaaagaaaaattcaaagtggagacaagaaccattgctgttgactttgcatcagaagatatttatgataaaattaaaacaggcttggctggtcttgaaatcggcatcttagtgaacaacgtgggaatgtcgtatgagtatcctgaatactttttggatgttcctgacttggacaatgtgatcaagaaaatgataaatattaatattctttctgtttgtaagatgacacaattggtactgcctggcatggtggaaagatccaaaggggctattctgaacatttcatctggcagtggcatgctccctgtcccactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatgggctcgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactctttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcttataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatgaaaaacaca

SEQ ID NO: 38641 - DNA, 2430 bp, Homo sapiens
actggatcctattaaataattcaatggtagcggtgtaattttggttggaaccagcacggattcccaagtcgtgactgcaaaaagtggtcaaacctgtcctgacacccagaggtctgcatgaggggtggccactgaaggaggagttctcaaaggccacaggtgatgaagagcttggatgaataaacttagaagtcccaggaaaatagcaaaaatttcatctcctgaagaaatttgaagatttttttggatattcttttaaaggtgaaacttttcttctttagttgtcacaggtagtactgatggaattggaaaatcatatgcagaagagttagcaaagcatggaatgaaggttgtccttatcagcagatcaaaggataaacttgaccaggtttccagtgaaataaaagaaaaattcaaagtggagacaagaaccattgctgttgactttgcatcagaagatatttatgataaaattaaaacaggcttggctggtcttgaaatcggcatcttagtgaacaacgtgggaatgtcgtatgagtatcctgaatactttttggatgttcctgacttggacaatgtgatcaagaaaatgataaatattaatattctttctgtttgtaagatgacacaattggtactgcctggcatggtggaaagatccaaaggggctattctgaacatttcatctggcagtggcatgctccctgtcccactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatgggctcgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactctttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcttataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatgaaaaacaca

SEQ ID NO: 38642 - DNA, 1749 bp, Homo sapiens
  misc_feature (26)..(26): n is a, c, g, or t
  misc_feature (29)..(29): n is a, c, g, or t
gttctagaggatcccgtggatgcaangtncactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatgggctcgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactctttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcttataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatgaaaaacaca

SEQ ID NO: 38643 - DNA, 3373 bp, Homo sapiens
aggagtgtgggaggggcagtggaactggagtcagctaatggctgacgcactacgcgcagagggaaagacgggtcaccaatagcgacacggatatggccccgcgggcggggtttaggcccaaagtggtgtcggagcagcgcctattagtgtcatcctcaccgtcacggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcagttgtcacaggtagtactgatggaattggaaaatcatatgcagaagagttagcaaagcatggaatgaaggttgtccttatcagcagatcaaaggataaacttgaccaggtttccagtgaaataaaagaaaaattcaaagtggagacaagaaccattgctgttgactttgcatcagaagatatttatgataaaattaaaacaggcttggctggtcttgaaatcggcatcttagtgaacaacgtgggaatgtcgtatgagtatcctgaatactttttggatgttcctgacttggacaatgtgatcaagaaaatgataaatattaatattctttctgtttgtaagatgacacaattggtactgcctggcatggtggaaagatccaaaggggctattctgaacatttcatctggcagtggcatgctccctgtcccactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatgggctcgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactctttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcttataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatgaaaaacacattgtttgcccttttttcctctcatttcattgtagaaatggtgacaccacaatgacctggacagtattttatctgctttcacacattggttggttagttggttggttggttggttggtgagttggttttagtgtagtggtggtagatagaggagggattctcttgcaagtatacaaaatactctctttttcttttatcccagttagaaaatagttgtaggctaagcacagtggcttacacctgtaaactcaatgctttgggaggctgagacaggaggattgcttgagcccgggagttcaagcccagcccgggcaacgtagcaagctcttgtctctacaaaaaaattaaaaaataaaaaattagccaggtgtggtggcacgcacctgtagtcccagctacttggaaggctgaggcaggaggattgcctgagcccagggattagaagctaccgtgatgctatgttgactactactgcactccagtctgatgacatagtaagccctgtctcaaaaaaaaaaaaaaaaaaaaaccaaactggtccagggggtttccgcccccccaagggcttatcctcttggagagcctcctaagtaagaacttaagagtccttcgtggacaagccaaatttccctcactttgcataggggttcacactgtgtgcacgggacacgtttgcacgaaaaatctaagggagggtaacgctacttatagtgccttgttaacggtgtggaacacaacctttggtctttttaaaaacccattttggcccaaattggggtcgtccttttaacctttcaaaagttagttttacaaccttcgaaataacg

SEQ ID NO: 38644 - DNA, 2562 bp, Homo sapiens
aggagtgtgggaggggcagtggaactggagtcagctaatggctgacgcactacgcgcagagggaaagacgggtcaccaatagcgacacggatatggccccgcgggcggggtttaggcccaaagtggtgtcggagcagcgcctattagtgtcatcctcaccgtcacggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcagttgtcacaggtagtactgatggaattggaaaatcatatgcagaagagttagcaaagcatggaatgaaggttgtccttatcagcagatcaaaggataaacttgaccaggtttccagtgaaataaaagaaaaattcaaagtggagacaagaaccattgctgttgactttgcatcagaagatatttatgataaaattaaaacaggcttggctggtcttgaaatcggcatcttagtgaacaacgtgggaatgtcgtatgagtatcctgaatactttttggatgttcctgacttggacaatgtgatcaagaaaatgataaatattaatattctttctgtttgtaagatgacacaattggtactgcctggcatggtggaaagatccaaaggggctattctgaacatttcatctggcagtggcatgctccctgtcccactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatgggctcgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactctttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcttataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggtatattcgctccaatccatctggttttgcaaaactctaatgaatggtatatagtaataa

SEQ ID NO: 38645 - DNA, 2493 bp, Homo sapiens
aggagtgtgggaggggcagtggaactggagtcagctaatggctgacgcactacgcgcagagggaaagacgggtcaccaatagcgacacggatatggccccgcgggcggggtttaggcccaaagtggtgtcggagcagcgcctattagtgtcatcctcaccgtcacggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcagttgtcacaggtagtactgatggaattggaaaatcatatgcagaagagttagcaaagcatggaatgaaggttgtccttatcagcagatcaaaggataaacttgaccaggtttccagtgaaataaaagaaaaattcaaagtggagacaagaaccattgctgttgactttgcatcagaagatatttatgataaaattaaaacaggcttggctggtcttgaaatcggcatcttagtgaacaacgtgggaatgtcgtatgagtatcctgaatactttttggatgttcctgacttggacaatgtgatcaagaaaatgataaatattaatattctttctgtttgtaagatgacacaattggtactgcctggcatggtggaaagatccaaaggggctattctgaacatttcatctggcagtggcatgctccctgtcccactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatgggctcgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactctttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcttataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatgaaaaacaca

SEQ ID NO: 38646 - DNA, 2337 bp, Homo sapiens
aggagtgtgggaggggcagtggaactggagtcagctaatggctgacgcactacgcgcagagggaaagacgggtcaccaatagcgacacggatatggccccgcgggcggggtttaggcccaaagtggtgtcggagcagcgcctattagtgtcatcctcaccgtcacggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcagttgtcacaggtagtactgatggaattggaaaatcatatgcagaagagttagcaaagcatggaatgaaggttgtccttatcagcagatcaaaggataaacttgaccaggtttccagtgaaataaaagaaaaattcaaagtggagacaagaaccattgctgttgactttgcatcagaagatatttatgataaaattaaaacaggcttggctggtcttgaaatcggcatcttagtgaacaacgtgggaatgtcgtatgagtatcctgaatactttttggatgttcctgacttggacaatgtgatcaagaaaatgataaatattaatattctttctgtttgtaagatgacacaattggtactgcctggcatggtggaaagatccaaaggggctattctgaacatttcatctggcagtggcatgctccctgtcccactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatgggctcgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactctttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcttataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacatctgctatcagcatcattatgtaaaagaaaatatattttagcccctaaaattaggaagaatgtaatctcagaataaaggttgtcatttaagttgaataaatatatagctttatgaaaaacaca

SEQ ID NO: 38647 - DNA, 1148 bp, Homo sapiens
ttatcaagggtagctaatgacatgaaaataattgtgaaatatggaattatttctgacacatgaagcccactaaactatgctttcttataatgcatatttcttctcagttaattttttttttttaatttttattttttgagacggagtctcgctctgtcgcccaggctggagtgcagtggcgggatctcggctcactgcaagctccgcctcccgggttcacaccattctcctgcctcagcctcccaagtagctgggactacaggcacccgccactacgcccggctaattttttgtatttttagtagagacggggtttcaccgttttggccgggatggtctcgatctcctgacctcgtgatccgcccgcctcggcctcccaaagtgctgggattacaggcgtgagccaccgcgcccggccctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatgaaaaacaca

SEQ ID NO: 38648 - DNA, 889 bp, Homo sapiens
actagttctagatcgcgagcggccgactcttttgtatttttagtagagacggggtttcaccgttttggccgggatggtctcgatctcctgacctcgtgatccgcccgcctcggcctcccaaagtgctgggattacaggcgtgagccaccgcgcccggccctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatgaaaaacaca

SEQ ID NO: 38649 - DNA, 837 bp, Homo sapiens
tgcaattatactctaaattccactacactacattaaagtaaatggacattccagaatatagatgtgattatagtcttaaactaattattattaaaccaatgattgctgaaaatcagtgatgcatttgttatagagtataactcatcgtttacagtatgttttagttggcagtatcatacatagatggttaaaccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatgaaaaacaca

SEQ ID NO: 38650 - DNA, 1073 bp, Homo sapiens
aggagtgtgggaggggcagtggaactggagtcagctaatggctgacgcactacgcgcagagggaaagacgggtcaccaatagcgacacggatatggccccgcgggcggggtttaggcccaaagtggtgtcggagcagcgcctattagtgtcatcctcaccgtcacggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcagttgtcacaggtagtactgatggaattggaaaatcatatgcagaagagttagcaaagcatggaatgaaggttgtccttatcagcagatcaaaggataaacttgaccaggtttccagtgaaataaaagaaaaattcaaagtggagacaagaaccattgctgttgactttgcatcagaagatatttatgataaaattaaaacaggcttggctggtcttgaaatcggcatcttagtgaacaacgtgggaatgtcgtatgagtatcctgaatactttttggatgttcctgacttggacaatgtgatcaagaaaatgataaatattaatattctttctgtttgtaagatgacacaattggtactgcctggcatggtggaaagatccaaaggggctattctgaacatttcatctggcagtggcatgctccctgtcccactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccctctccggagacgtttgtgaagtctgcaattaaaaccagatgcggccgtcgttattagttttattgtttcgtattgtcattaataa

SEQ ID NO: 38651 - DNA, 512 bp, Homo sapiens
ccccggtagatttgtattaaaagaaaaaaaaatgggcaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatgaaaaacaca

SEQ ID NO: 38652 - DNA, 855 bp, Homo sapiens
aggagtgtgggaggggcagtggaactggagtcagctaatggctgacgcactacgcgcagagggaaagacgggtcaccaatagcgacacggatatggccccgcgggcggggtttaggcccaaagtggtgtcggagcagcgcctattagtgtcatcctcaccgtcacggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcagttgtcacaggtagtactgatggaattggaaaatcatatgcagaagagttagcaaagcatggaatgaaggttgtccttatcagcagatcaaaggataaacttgaccaggtttccagtgaaataaaagaaaaattcaaagtggagacaagaaccattgctgttgactttgcatcagaagatatttatgataaaattaaaacaggcttggctggtcttgaaatcggcatcttaggttgggctggcttaaagccccagccctctagtcacagagttggtctttctggtgtccaaccccatcctgggtcatcttgattccactactgagtatatatcaaaaacgaagaaactcaatatattgaagagatatctgcactctatgtttattgcagcactattcacagtagccaaaatatggaatcagcctaacagtctatcagcagatgaatggataaagaaaa

SEQ ID NO: 38653 - DNA, 2866 bp, Homo sapiens
aggagtgtgggaggggcagtggaactggagtcagctaatggctgacgcactacgcgcagagggaaagacgggtcaccaatagcgacacggatatggccccgcgggcggggtttaggcccaaagtggtgtcggagcagcgcctattagtgtcatcctcaccgtcacggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcagttgtcacaggtagtactgatggaattggaaaatcatatgcagaagagttagcaaagcatggaatgaaggttgtccttatcagcagatcaaaggataaacttgaccaggtttccagtgaaataaaagaaaaattcaaagtggagacaagaaccattgctgttgactttgcatcagaagatatttatgataaaattaaaacaggcttggctggtcttgaaatcggcatcttagtgaacaacgtgggaatgtcgtatgagtatcctgaatactttttggatgttcctgacttggacaatgtgatcaagaaaatgataaatattaatattctttctgtttgtaagatgacacaattggtactgcctggcatggtggaaagatccaaaggggctattctgaacatttcatctggcagtggcatgctccctgtcccactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatgggctcgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactctttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcttataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatgaaaaacacaaaaaacaacaacgaagaaaaaaaaaaaactcttgttcgggcgcgcctctgggcccttgggaaaaacttttctgaaacccattcgcgttgggagcgccgggggccccagtggggttaggtgaacactgggcccaaggcggtttccccggaggagaacccgcggggccagaaacaagggcgttggggtttctctcccccattaaagaaagcgccgcgggggaaaccgcgaggtttttgagaccattccccaaggggagttccagagggccaaaaacgggaattctcaaccaggggttccaaggaactcgattaaaatacga

SEQ ID NO: 38654 - DNA, 2863 bp, Homo sapiens
aggagtgtgggaggggcagtggaactggagtcagctaatggctgacgcactacgcgcagagggaaagacgggtcaccaatagcgacacggatatggccccgcgggcggggtttaggcccaaagtggtgtcggagcagcgcctattagtgtcatcctcaccgtcacggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcagttgtcacaggtagtactgatggaattggaaaatcatatgcagaagagttagcaaagcatggaatgaaggttgtccttatcagcagatcaaaggataaacttgaccaggtttccagtgaaataaaagaaaaattcaaagtggagacaagaaccattgctgttgactttgcatcagaagatatttatgataaaattaaaacaggcttggctggtcttgaaatcggcatcttagtgaacaacgtgggaatgtcgtatgagtatcctgaatactttttggatgttcctgacttggacaatgtgatcaagaaaatgataaatattaatattctttctgtttgtaagatgacacaattggtactgcctggcatggtggaaagatccaaaggggctattctgaacatttcatctggcagtggcatgctccctgtcccactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatgggctcgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactctttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcttataatgcatatttcttctcagtttattttttattttattttttttttttttgagacggagtctcgctctgtcgcccaggctggagtgcagtggcgggatctcggctcactgcaagctccgcctcccgggttcacgccattctcctgcctcagcctcccaagtagctgggactacaggcacccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatgaaaaacaca

SEQ ID NO: 38655 - DNA, 1681 bp, Homo sapiens
gtataatattgtcccccgacacacacctgcaaacaacgccccacgacaaaccttcaagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatgggctcgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactctttgtttttgacacttgaagaaatggagatcgatttgatttgtttataagcagacacactgcaatttacaaagatctctttacggttttataaaattatcttccagtttgtacatttatatggaattgttctttatcaagggtagctaatgacatgaaaataattgtgaaatatggaattatttctgacacatgaagcccactaaactatgctttcttataatgcatatttcttctcagtttaaatgtatgtaaatatcgaagctatatggtatgatttataaagataaatgggccaaagtgtacattgagactggcagccatctatggtaccactgaaaccctgacccagaaaagtggcttgcttggacacccagctgcctttgtttctgcattaaaccaatattgatcacacatatgacacaggctagtcctataaaagtaatgacttcatagaaatggcattataatttttaagttgatactctacaggtagctattgatataattagttttaataaaacatgctgcaaccatggtatacaacaaaaatacatttctttggtgattgaaattaaggccgtatttacaatgacttaatataagactgacttttatcctgcttcataacttgtatggagaactcaccaagaaagaattcaatactgtgaaatatgcagcaagaagattggtctttacctaggctgtgtttcctaagctctgagttttcagcaccagtagatttgtattaaaagaaaaaaaaatggggccttagcttctggcttttaattttgccagctaaggacataaaacaaaaataaacaaacaaaaacaaatagccatctgctatcagcatcattatgtaaaagaaaatatattttagcccctaaaattaggaagaatgtaatctcagaataaaggttgtcatttaagttgaataaatatatagctttatgaaaaacaca

SEQ ID NO: 38656 - DNA, 1743 bp, Homo sapiens
aggagtgtgggaggggcagtggaactggagtcagctaatggctgacgcactacgcgcagagggaaagacgggtcaccaatagcgacacggatatggccccgcgggcggggtttaggcccaaagtggtgtcggagcagcgcctattagtgtcatcctcaccgtcacggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcagttgtcacaggtagtactgatggaattggaaaatcatatgcagaagagttagcaaagcatggaatgaaggttgtccttatcagcagatcaaaggataaacttgaccaggtttccagtgaaataaaagaaaaattcaaagtggagacaagaaccattgctgttgactttgcatcagaagatatttatgataaaattaaaacaggcttggctggtcttgaaatcggcatcttagtgaacaacgtgggaatgtcgtatgagtatcctgaatactttttggatgttcctgacttggacaatgtgatcaagaaaatgataaatattaatattctttctgtttgtaagatgacacaattggtactgcctggcatggtggaaagatccaaaggggctattctgaacatttcatctggcagtggcatgctccctgtcccactcttgaccatctattctgcaaccaagacttttgtagatttcttctctcagtgcctccatgaggagtataggagcaagggcgtctttgtgcagagtgtcctgccatacttcgtagctacaaaactggctaaaatccggaagccaactttggataagccctctccggagacgtttgtgaagtctgcaattaaaacagtcggcctgcaatcccgaaccaatggatacctgatccatgctcttatgggctcgataatctcaaacctgccttcttggatttatttgaaaatagtcatgaatatgaacaagtctacacgggctcactatctgaagaaaaccaagaagaactaagcattgataactgcattgtaacttggccagatgctccagcatatgcacgttcactgcaaagcaccctactggttttgaaaatctgaccttgtcatttcaatagttattaacatgactaaatattatcttaattaagaggaaaatagaagttgcttttaggggtttctgacatatattctggatactatccgaggtaattttgaagtttaatataaatgctcatatcaaatgaatatagaactaatattgtcgggaacacctaatagaaaggaatactattatagcaaatcacagaatgatagactcaagcataaaacttggcagttttatctgcttcaaaatgccattgatcattattcctgtattttctctgaaactgattataaaaaccaatgtccagctactctttgtttttgacactttgcatccagagacactttgcatccagagacactttgcatccagagacactttgcatccagagacactttgcatccagagacacttgcatccagagacacttgcatccagagacacttgcatccgaggggatcctctgaacgcta

SEQ ID NO: 38657 - DNA, 1255 bp, Homo sapiens
aggagtgtgggaggggcagtggaactggagtcagctaatggctgacgcactacgcgcagagggaaagacgggtcaccaatagcgacacggatatggccccgcgggcggggtttaggcccaaagtggtgtcggagcagcgcctattagtgtcatcctcaccgtcacggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcagttgtcacaggtagtactgatggaattggaaaatcatatgcagaagagctactcaggaggctgaggcaggagaatcgcttgaacccaggaggtggaggttgcagtgagccgagatcacaccgtggcactccagcctgggtgacagagcaagactctgtctcaaaaaaattagcaaagcatggaatgaaggttgtccttatcagcagatcaaaggataaacttgaccaggtttccagtgaaataagcaattatacttgagacctgaattacaatatggcaaagactcttaactaacttctactcaatcaaccagatggataaaccaatgctgttcatttgtttgttctgtgtataatgcttatatacttttatcctcacaaatcaaattgtttacttattaagagtcaatttgtgtttgtttccaaacttatgttgggtatattttttattaaatattctgtaaaatgatgaactattagtgtaaaagctagagttagttctataaaaactaagttgaatgctctaaaaaaagtgagtaaaattacttctttgaaaaattggccgtcaaattagtgttgaacaaagacaaatgtaaaatattggaagaacttacaaaaaagaaatctgctctcctgattgtttcatatgtgttgaagtttgtgctgtactttactagaactgaaattgtaatcataaatgatagaatatgggtgtgatgcatgcaagaaagactggaattcaagtccgcagatccaatctcaaagacaaggtcttggccctacacagaggattggtgaatgaattacatttatacatggtttaagtgaaaataaaatgattaccatgtgtatttatctc

SEQ ID NO: 38658 - DNA, 1190 bp, Homo sapiens
aggagtgtgggaggggcagtggaactggagtcagctaatggctgacgcactacgcgcagagggaaagacgggtcaccaatagcgacacggatatggccccgcgggcggggtttaggcccaaagtggtgtcggagcagcgcctattagtgtcatcctcaccgtcacggccggcgcctcctcctggattcattcactcgctcttttcattcacgaaggtagtgaggcctagtggaaagccatggagagcgctctccccgccgccggcttcctgtactgggtcggcgcgggcaccgtggcctacctagccctgcgtatttcgtactcgctcttcacggccctccgggtctggggagtggggaatgaggcgggggtcggcccggggctcggagaatgggcagttgtcacaggtagtactgatggaattggaaaatcatatgcagaagagttagcaaagcatggaatgaaggttgtccttatcagcagatcaaaggataaacttgaccaggtttccagtgaaataagcaattatacttgagacctgaattacaatatggcaaagactcttaactaacttctactcaatcaaccagatggataaaccaatgctgttcatttgtttggtaaaacatactaactgatgtccccagttttgctgaccatttgtggccaggaagcttctgtgtataatgcttatatacttttatcctcacaaatcaaattgtttacttattaagagtcaatttgtgtttgtttccaaacttatgttgggtatattttttattaaatattctgtaaaatgatgaactattagtgtaaaagctagagttagttctataaaaactaagttgaatgctctaaaaaaagtgagtaaaattacttctttgaaaaattggccgtcaaattagtgttgaacaaagacaaatgtaaaatattggaagaacttacaaaaaagaaatctgctctcctgattgtttcatatgtgttgaagtttgtgctgtactttactagaactgaaattgtaatcataaatgatagaatatgggtgtgatgcatgcaagaaagactggaattcaagtccgcagatccaatctcaaagacaaggtcttggccctacacagaggattggtgaatgaattacatttatacatggtttaagtgaaaataaaatgattaccatgtgtatttatctc

SEQ ID NO: 38659 - DNA, 840 bp, Homo sapiens
  misc_feature (75)..(75): n is a, c, g, or t
  misc_feature (182)..(182): n is a, c, g, or t
  misc_feature (228)..(228): n is a, c, g, or t
  misc_feature (265)..(265): n is a, c, g, or t
gagactatgttgaagaagagtggtgagagtgggctcctcgtcttgttccagttctcaaagggaatgctttcaccntttccccattcagtattatgttggctgtgggttgtatagatggcttttattacattaagggatcatggcacaagttgcagtttccaccctgcccatggaagatgagnagtccatggaagatgaggagtccattgaagatgaggagtctgttgnagatgattccgtggagagcaggatggtggtgacattnctcatatcagctctcgagtccacgatgttggaattcctgatgaatctgcagtcagcattttgcatgaactgtgtgtggattcattgcctacattggatgatgaagacttgagtgttgctactaagtgtgtccccgagaaagtgtcagagcctttacgtggaccttctcatgaaaaaggaaacagaatagtcaatggaaaaggaaaagggctcctgcaaacattcttccttggaagcttagcactgaagtggaagatcctgtgtgaaaggagcagtaccacagaaagaatgtgcccgaccttggagaggcagaacaaagctttaccaggggccttcgagggaagagccagaacggtgtcgacacgaacagtggacaagaaagcactcccgggtgccaagcaaggggacttagttccaaaagccaaaagtcggcaccaattacgcacttagtccgaaacactgtgttctgttcctagtaccattcttactggatggctcgttggacaggattaacccaacggagaggacacggactgggggaaactttgtcctcgaggccaatttcccccaggaaag

SEQ ID NO: 38660 - DNA, 317 bp, Homo sapiens
agggggaagctggatataaactggcagttaaaaaaattgtaaagaaatcaacttgctcattttcattgtgtatttttgctctcaagcattttgcatgaactgtgtgtggattcattgcctacattggatgatgaagacttgagtgttgctactaaggtaaagtggtctcttgtaaaattaatcttctcactctgagtgtagttttgcatagtatttacttttcaaatttagcagtggtttacctatcattgttttatggtggtaatggaaagctggtcagagaaaaacatacacatggctagttgattcaaaaaatg

SEQ ID NO: 38661 - DNA, 1036 bp, Homo sapiens
  misc_feature (75)..(75): n is a, c, g, or t
  misc_feature (182)..(182): n is a, c, g, or t
  misc_feature (228)..(228): n is a, c, g, or t
  misc_feature (265)..(265): n is a, c, g, or t
gagactatgttgaagaagagtggtgagagtgggctcctcgtcttgttccagttctcaaagggaatgctttcaccntttccccattcagtattatgttggctgtgggttgtatagatggcttttattacattaagggatcatggcacaagttgcagtttccaccctgcccatggaagatgagnagtccatggaagatgaggagtccattgaagatgaggagtctgttgnagatgattccgtggagagcaggatggtggtgacattnctcatatcagctctcgagtccacgatgttggaattcctgatgaatctgcagtcagcattttgcatgaactgtgtgtggattcattgcctacattggatgatgaagacttgagtgttgctactaaggccctggtgtgtgatgttccccatcctgtgtccaagtgttctcattgttcagttcccacctatgagtgagaacatgtggtgtttggttttctgtccttgcaacagtttgctcagaatgatggtttccagcttcatccatgtccctacaaagtacatgaactcatcattttttatgctgcatagtattccatggtgttgtgtccccgagaaagtgtcagagcctttacgtggaccttctcatgaaaaaggaaacagaatagtcaatggaaaaggaaaagggctcctgcaaacattcttccttggaagcttagcactgaagtggaagatcctgtgtgaaaggagcagtaccacagaaagaatgtgcccgaccttggagaggcagaacaaagctttaccaggggccttcgagggaagagccagaacggtgtcgacacgaacagtggacaagaaagcactcccgggtgccaagcaaggggacttagttccaaaagccaaaagtcggcaccaattacgcacttagtccgaaacactgtgttctgttcctagtaccattcttactggatggctcgttggacaggattaacccaacggagaggacacggactgggggaaactttgtcctcgaggccaatttcccccaggaaag

SEQ ID NO: 38662 - DNA, 679 bp, Homo sapiens
tctttcatataatgttaaaaaggaaaggaaacagcctggaactggcaaaaatcattattagtggcagatccagaattttcatatagtagtttcatagaagcagtaatttgagtgggttatgggtggctaggaaacttgtcttgaagctgcatttattttgccaacactttgatgttactttgataccaagtgtatgggagtcattggggatgtggtagactgggattaagctgatggccacccctttacttgctggaaattaatgccggctattttttattttttccttaagtcccagtacccagatagaagtgatttgtgataataacatagggatagtgaaagaaatatcttaagggctcactgaggctcagtttactgcagtgtggcaaaagtcgtgaatgacaagttacgtgacaagctataaggatttgtattgctctttttgagcaaagattatggactgtcttgactataaagggtggatttgtaaactttcagttgatttttttagatgtcaatgaatgctttttgtatgatttttaaaagtatgattgtattctcataacgttcctgttaggtaattttggcaatcaccacccttatgtatagggaaatgtgtacacaaatctgttcgtgccccaaagcttctcaataaaaattggaattcaatttagat

SEQ ID NO: 38663 - DNA, 410 bp, Homo sapiens
aaaatgattgcattgtgtgacttatatcgttgtatttattggcttgagtgcagggagattttagaaaaagaatctggtttttgttatcaaagatcttggagtggggatgagagagtgctgggaaatttcggagctagactggaatgagtctaaggaaacttgccagtccattataccttcagttataaaaggagaaaactcatttggtttaaattcgtttgtttagaatagcattaaaaggcgattcttcctatttaaagaacagagttgtctgccattctctcgtttattcctcctccctcccgtgcccttgtatattttcttagtgactgagcacctgagccagcactgattttttgtgtgttttgttgtttttgttttgggagacggagtctcgctctgtcgcccag

SEQ ID NO: 38664 - DNA, 1006 bp, Homo sapiens
gagtgagaccccaaataaaaaaaaaaaaaacaaaaaacctcttatgactcatgggctagaaccacccacctcatgccaatccactgacactgagaatggcattgtgattggctttcaatagtattttcccccagagatgaggtcatcttccatgaaggtcagatatctacagaaataattgatgttagcaaggaagaagcagagaatgggtattgatagacaatgtctgctctagggatgggtcattctgccaacattcagcagatcccctatctactcccaaaatgcctggtaccagctaatagttaacatcttctgagagcattacttaaagtctttacatatcttcacttatttaacccacaaatcaacccttaaaggtaggttctgatgtagtgggttggtgcaaaagtaattggagttttgccattttaatgcaattacttttgcaccaatctaatatatccccattttctaggtggggaacatgaggcacagagtggttatgtcttacccacagtcatttgcaagggagtggcagagcctagatacaaaccatgtcaatctgcctctgagtctacgtagtatatccactatactaaactgcccttctaccttacaaagcagaacaagatcaggttctcacttttaaggagtctacagtctagtataggagccagcaaactttctctgtaaaggtctggagactaaatactaggttttgcagcagtatggtctctgttgtaactactcagcttttccactgtagcgtaaaaacagttgtagacaattcataaacaagtgtggctgtgttccaataaaacttgatttacaaaaataggcagctggccgggtttgtcccatgagtcagtttgtggacctgcggtctagtgagttagaatactgcttaccaaattttaatgtgtgtgtgattcacgtgggatcgggttaaaatgcaaattttgattcaataggtccggagtgaggcctagtaaaagtgtaagtg

SEQ ID NO: 38665 - DNA, 336 bp, Homo sapiens
ctctctctcctgccactttgtgaagagatctgccttgcttaccttcaccttccaccatgagagtgtttcccaaggcttccccaggcacacagaattgtgaatcaatcaaacctcttttcttcataaattacccagtctcaggtagtatctttatagcagcgtgagaacagactattacaatgggtatagagtttcaccttggactgatagaaaagttttggaaatagatagtggtgatggctgcaaaacattgtgaatgtatctaatgtcactgaattgtacacttaaaagtggttaaaatgataaatgttatgtatgttttaccacaaaaaaaaa

SEQ ID NO: 38666 - DNA, 3137 bp, Homo sapiens
cggtcccgtcgccgccgccccgcactcgggcgagcgcgggagccgcgcagtagacggagcgcgcccggccgagcgggccatggccgcgggggccgccgccgcaggtggtggcgcgcggtgaggagagcgcggcgccccctccggggcggatggaacgcggctcggcgggcgggcagtgccggcgtccgcggctggaatggtgctggctgtgttggtcggtgcctgcgttctgaagcccgagaggagccacaatggagacgccgccgctgcctcccgcatgcacaaagcagggtcatcagaagcctctcgattcaaaagatgataataccgaaaaacactgcccagtgacagtgaatccttggcatatgaagaaagctttcaaagtcatgaacgaattaagaagtcaaaatttgctgtgcgatgtcacaattgtggcagaagacatggaaatttctgctcatagagtggtgctggccgcctgtagtccttattttcatgccatgtttacaggtgagatgagtgagagccgagcaaagagagttagaataaaagaggtagatggctggaccctgaggatgctaattgattatgtttacactgcagaaattcaggttacagaagaaaatgtacaggtacttctcccagcagctggtctcttacagttacaggatgtgaagaagacttgttgtgaatttttggaatcccagcttcaccctgtcaactgcttaggaatccgggcttttgctgatatgcatgcatgtaccgaccttctgaacaaggccaacacctatgcagagcaacattttgcagatgttgtacttagtgaagaatttctcaatcttggcatcgaacaagtgtgcagcttaatctcaagtgacaaacttaccatttcttcagaagagaaggtatttgaagcagtaatagcatgggtgaaccatgacaaggatgtgaggcaagagtttatggcccgactgatggaacatgtacggttacctttgcttcctcgggaatatttagttcagagggttgaagaggaagcattggtcaagaatagcagtgcttgcaaagattacctcattgaagcaatgaagtaccatttgctgccaacagagcagcgtatattaatgaagagtgtccggacccggctgaggacacccatgaaccttcccaaattgatggtggtggttgggggccaagcaccaaaggctatccggagtgtggaatgctatgactttaaagaagaaaggtggcaccaagtagcagagttgccttccaggaggtgcagagcaggcatggtctacatggctggacttgtttttgctgttggtggctttaatggctcattaagagttcgcactgtagattcctacgaccctgtgaaggaccagtggaccagcgttgctaacatgagagaccggagaagcactttgggagctgctgtgttaaatggattattatacgctgtgggaggctttgatgggagtacaggtttgtcatctgtggaagcatacaacataaagtctaatgagtggtttcatgtagctcccatgaatacaaggaggagcagtgttggtgtgggtgttgttggaggtttgctctatgctgtaggaggttatgatggagcatcacgtcagtatcttagcacagtagaatgctataatgctacaacaaatgagtggacctatatagcagaaatgagcaccaggcggagtggagcaggtgttggtgtgttaaacaatttattgtatgctgtaggaggtcatgatggccctttagtacgaaaaagtgttgaagtatatgaccccaccactaacgcatggagacaggttgcagatatgaacatgtgcagaagaaatgcaggagtttgtgcagttaatggtctgttatatgttgttggaggggatgatggttcctgtaacttggcgtcagtagaatattataacccaacaaccgataaatggacagttgtgtcatcgtgtatgagcacagggagaagttatgcaggggtcacagttattgataaaccattatgagcctgaaggacattttcagcatatttatacatgagaaacagccttcaacaagtatttgtgaagtgactgagaatctagcacttctccacttgtagctgcactttaagtctcagcagaagatacgatcgtctgcctttataggcctcagatactgaagattatttttggtagaagcaccgtgtaggctttttctgcaatgagcagcagctgactgaattttcataagaaacttggactgcaggacttaatctgtagtctttagacaacagttgctttcataaagactagttcttatcaaccttgaatgactacagattattttgtgaaggaggatgaagtaatgtgtgttcttgtaaaattaaattttatctttatttcttctaaaaatctgtataccaggaactgaaaatctttgaacagatattaaaatctacgtaagtatacaaactagttgagggatacactgtttgcttttataaaataactttgattacatgaatataataaattatgtgcatataaatgtgtgtctatatgctttcctttaaatatgtttgaaaagatgtttgaaacttgattatactatttataattggcacagtactttgaattatgccagtactacattgtaaaacagagttgtattttttgatatttaacaatgcttaacactttaaatgccacttctgaggaatggacctggtgtaacacacttgaatatgtgtgatgccaaactttttaaaatacaatataaattatgcttatttattattttctttagtttaatcttggtcatgttttggtgtgtatttttaatttttttcttaaattaacactttggcatgaacattactgcaggtttttgatgaatataatgaatgtatggaattcaattgaatttgcatggtcttcggaattttttctgtgtgtataaatttagctgctattaacagaagagagaactttctgtgagtagccatgtgtgttgatcagatacagtttttctgagatcttcaattaatctcactttaaaaatgaccaaaacatgtctttcttgaattaactttgaataaaagtttgtatattatttgtttcacagtgttc

SEQ ID NO: 38667 - DNA, 3030 bp, Homo sapiens
cggtcccgtcgccgccgccccgcactcgggcgagcgcgggagccgcgcagtagacggagcgcgcccggccgagcgggccatggccgcgggggccgccgccgcaggtggtggcgcgcggtgaggagagcgcggcgccccctccggggcggatggaacgcggctcggcgggcgggcagtgccggcgtccgcggctggaatggtgctggctgtgttggtcggtgcctgcgttctgaagcccgagaggagccacaatggagacgccgccgctgcctcccgcatgcacaaagcagggtcatcagaagcctctcgattcaaaagatgataataccgaaaaacactgcccagtgacagtgaatccttggcatatgaagaaagctttcaaagtcatgaacgaattaagaaggtgagatgagtgagagccgagcaaagagagttagaataaaagaggtagatggctggaccctgaggatgctaattgattatgtttacactgcagaaattcaggttacagaagaaaatgtacaggtacttctcccagcagctggtctcttacagttacaggatgtgaagaagacttgttgtgaatttttggaatcccagcttcaccctgtcaactgcttaggaatccgggcttttgctgatatgcatgcatgtaccgaccttctgaacaaggccaacacctatgcagagcaacattttgcagatgttgtacttagtgaagaatttctcaatcttggcatcgaacaagtgtgcagcttaatctcaagtgacaaacttaccatttcttcagaagagaaggtatttgaagcagtaatagcatgggtgaaccatgacaaggatgtgaggcaagagtttatggcccgactgatggaacatgtacggttacctttgcttcctcgggaatatttagttcagagggttgaagaggaagcattggtcaagaatagcagtgcttgcaaagattacctcattgaagcaatgaagtaccatttgctgccaacagagcagcgtatattaatgaagagtgtccggacccggctgaggacacccatgaaccttcccaaattgatggtggtggttgggggccaagcaccaaaggctatccggagtgtggaatgctatgactttaaagaagaaaggtggcaccaagtagcagagttgccttccaggaggtgcagagcaggcatggtctacatggctggacttgtttttgctgttggtggctttaatggctcattaagagttcgcactgtagattcctacgaccctgtgaaggaccagtggaccagcgttgctaacatgagagaccggagaagcactttgggagctgctgtgttaaatggattattatacgctgtgggaggctttgatgggagtacaggtttgtcatctgtggaagcatacaacataaagtctaatgagtggtttcatgtagctcccatgaatacaaggaggagcagtgttggtgtgggtgttgttggaggtttgctctatgctgtaggaggttatgatggagcatcacgtcagtatcttagcacagtagaatgctataatgctacaacaaatgagtggacctatatagcagaaatgagcaccaggcggagtggagcaggtgttggtgtgttaaacaatttattgtatgctgtaggaggtcatgatggccctttagtacgaaaaagtgttgaagtatatgaccccaccactaacgcatggagacaggttgcagatatgaacatgtgcagaagaaatgcaggagtttgtgcagttaatggtctgttatatgttgttggaggggatgatggttcctgtaacttggcgtcagtagaatattataacccaacaaccgataaatggacagttgtgtcatcgtgtatgagcacagggagaagttatgcaggggtcacagttattgataaaccattatgagcctgaaggacattttcagcatatttatacatgagaaacagccttcaacaagtatttgtgaagtgactgagaatctagcacttctccacttgtagctgcactttaagtctcagcagaagatacgatcgtctgcctttataggcctcagatactgaagattatttttggtagaagcaccgtgtaggctttttctgcaatgagcagcagctgactgaattttcataagaaacttggactgcaggacttaatctgtagtctttagacaacagttgctttcataaagactagttcttatcaaccttgaatgactacagattattttgtgaaggaggatgaagtaatgtgtgttcttgtaaaattaaattttatctttatttcttctaaaaatctgtataccaggaactgaaaatctttgaacagatattaaaatctacgtaagtatacaaactagttgagggatacactgtttgcttttataaaataactttgattacatgaatataataaattatgtgcatataaatgtgtgtctatatgctttcctttaaatatgtttgaaaagatgtttgaaacttgattatactatttataattggcacagtactttgaattatgccagtactacattgtaaaacagagttgtattttttgatatttaacaatgcttaacactttaaatgccacttctgaggaatggacctggtgtaacacacttgaatatgtgtgatgccaaactttttaaaatacaatataaattatgcttatttattattttctttagtttaatcttggtcatgttttggtgtgtatttttaatttttttcttaaattaacactttggcatgaacattactgcaggtttttgatgaatataatgaatgtatggaattcaattgaatttgcatggtcttcggaattttttctgtgtgtataaatttagctgctattaacagaagagagaactttctgtgagtagccatgtgtgttgatcagatacagtttttctgagatcttcaattaatctcactttaaaaatgaccaaaacatgtctttcttgaattaactttgaataaaagtttgtatattatttgtttcacagtgttc

SEQ ID NO: 38668 - DNA, 1256 bp, Homo sapiens
cggtcccgtcgccgccgccccgcactcgggcgagcgcgggagccgcgcagtagacggagcgcgcccggccgagcgggccatggccgcgggggccgccgccgcaggtggtggcgcgcggtgaggagagcgcggcgccccctccggggcggatggaacgcggctcggcgggcgggcagtgccggcgtccgcggctggaatggtgctggctgtgttggtcggtgcctgcgttctgaagcccgagaggagccacaatggagacgccgccgctgcctcccgcatgcacaaagcagggtcatcagaagcctctcgattcaaaagatgataataccgaaaaacactgcccagtgacagtgaatccttggcatatgaagaaagctttcaaagtcatgaacgaattaagaagtcaaaatttgctgtgcgatgtcacaattgtggcagaagacatggaaatttctgctcatagagtggtgctggccgcctgtagtccttattttcatgccatgtttacaggtgagatgagtgagagccgagcaaagagagttagaataaaagaggtagatggctggaccctgaggatgctaattgattatgtttacactgcagaaattcaggttacagaagaaaatgtacaggtacttctcccagcagctggtctcttacagttacaggatgtgaagaagacttgttgtgaatttttggaatcccagcttcaccctgtcaactgcttaggaatccgggcttttgctgatatgcatgcatgtaccgaccttctgaacaaggccaacacctatgcagagcaacattttgcagatgttgtacttagtgaagaatttctcaatcttggcatcgaacaagtgtgcagcttaatctcaagtgacaaacttaccatttcttcagaagagaaggtatttgaagcagtaatagcatgggtgaaccatgacaaggatgtgaggcaagagtttatggcccgactgatggaacatgtacggttacctttgcttcctcgggaatatttagttcagagggttgaagaggaagcattggtcaagaatagcagtgcttgcaaagattacctcattgaagcaatgaagtaccatttgctgccaacagagcagcgtatattaatgaagagtgtccggacccggctgaggacacccatgaaccttcccaaattgatggtggtggttgggggccaagcaccaaaggctatccggagtgtggaatgctatgactatcagacgacacggtaatccttg

SEQ ID NO: 38669 - DNA, 3089 bp, Homo sapiens
cggtcccgtcgccgccgccccgcactcgggcgagcgcgggagccgcgcagtagacggagcgcgcccggccgagcgggccatggccgcgggggccgccgccgcaggtggtggcgcgcggtgaggagagcgcggcgccccctccggggcggatggaacgcggctcggcgggcgggcagtgccggcgtccgcggctggaatggtgctggctgtgttggtcggtgcctgcgttctgaagcccgagaggagccacaatggagacgccgccgctgcctcccgcatgcacaaagcagggtcatcagaagcctctcgattcaaaagatgataataccgaaaaacactgcccagtgacagtgaatccttggcatatgaagaaagctttcaaagtcatgaacgaattaagaagtcaaaatttgctgtgcgatgtcacaattgtggcagaagacatggaaatttctgctcatagagtggtgctggccgcctgtagtccttattttcatgccatgtttacaggtgagatgagtgagagccgagcaaagagagttagaataaaagaggtagatggctggaccctgaggatgctaattgattatgtttacactgcagaaattcaggttacagaagaaaatgtacagacttgttgtgaatttttggaatcccagcttcaccctgtcaactgcttaggaatccgggcttttgctgatatgcatgcatgtaccgaccttctgaacaaggccaacacctatgcagagcaacattttgcagatgttgtacttagtgaagaatttctcaatcttggcatcgaacaagtgtgcagcttaatctcaagtgacaaacttaccatttcttcagaagagaaggtatttgaagcagtaatagcatgggtgaaccatgacaaggatgtgaggcaagagtttatggcccgactgatggaacatgtacggttacctttgcttcctcgggaatatttagttcagagggttgaagaggaagcattggtcaagaatagcagtgcttgcaaagattacctcattgaagcaatgaagtaccatttgctgccaacagagcagcgtatattaatgaagagtgtccggacccggctgaggacacccatgaaccttcccaaattgatggtggtggttgggggccaagcaccaaaggctatccggagtgtggaatgctatgactttaaagaagaaaggtggcaccaagtagcagagttgccttccaggaggtgcagagcaggcatggtctacatggctggacttgtttttgctgttggtggctttaatggctcattaagagttcgcactgtagattcctacgaccctgtgaaggaccagtggaccagcgttgctaacatgagagaccggagaagcactttgggagctgctgtgttaaatggattattatacgctgtgggaggctttgatgggagtacaggtttgtcatctgtggaagcatacaacataaagtctaatgagtggtttcatgtagctcccatgaatacaaggaggagcagtgttggtgtgggtgttgttggaggtttgctctatgctgtaggaggttatgatggagcatcacgtcagtatcttagcacagtagaatgctataatgctacaacaaatgagtggacctatatagcagaaatgagcaccaggcggagtggagcaggtgttggtgtgttaaacaatttattgtatgctgtaggaggtcatgatggccctttagtacgaaaaagtgttgaagtatatgaccccaccactaacgcatggagacaggttgcagatatgaacatgtgcagaagaaatgcaggagtttgtgcagttaatggtctgttatatgttgttggaggggatgatggttcctgtaacttggcgtcagtagaatattataacccaacaaccgataaatggacagttgtgtcatcgtgtatgagcacagggagaagttatgcaggggtcacagttattgataaaccattatgagcctgaaggacattttcagcatatttatacatgagaaacagccttcaacaagtatttgtgaagtgactgagaatctagcacttctccacttgtagctgcactttaagtctcagcagaagatacgatcgtctgcctttataggcctcagatactgaagattatttttggtagaagcaccgtgtaggctttttctgcaatgagcagcagctgactgaattttcataagaaacttggactgcaggacttaatctgtagtctttagacaacagttgctttcataaagactagttcttatcaaccttgaatgactacagattattttgtgaaggaggatgaagtaatgtgtgttcttgtaaaattaaattttatctttatttcttctaaaaatctgtataccaggaactgaaaatctttgaacagatattaaaatctacgtaagtatacaaactagttgagggatacactgtttgcttttataaaataactttgattacatgaatataataaattatgtgcatataaatgtgtgtctatatgctttcctttaaatatgtttgaaaagatgtttgaaacttgattatactatttataattggcacagtactttgaattatgccagtactacattgtaaaacagagttgtattttttgatatttaacaatgcttaacactttaaatgccacttctgaggaatggacctggtgtaacacacttgaatatgtgtgatgccaaactttttaaaatacaatataaattatgcttatttattattttctttagtttaatcttggtcatgttttggtgtgtatttttaatttttttcttaaattaacactttggcatgaacattactgcaggtttttgatgaatataatgaatgtatggaattcaattgaatttgcatggtcttcggaattttttctgtgtgtataaatttagctgctattaacagaagagagaactttctgtgagtagccatgtgtgttgatcagatacagtttttctgagatcttcaattaatctcactttaaaaatgaccaaaacatgtctttcttgaattaactttgaataaaagtttgtatattatttgtttcacagtgttc

SEQ ID NO: 38670 - DNA, 2969 bp, Homo sapiens
cggtcccgtcgccgccgccccgcactcgggcgagcgcgggagccgcgcagtagacggagcgcgcccggccgagcgggccatggccgcgggggccgccgccgcaggtggtggcgcgcggtgaggagagcgcggcgccccctccggggcggatggaacgcggctcggcgggcgggcagtgccggcgtccgcggctggaatggtgctggctgtgttggtcggtgcctgcgttctgaagcccgagaggagccacaatggagacgccgccgctgcctcccgcatgcacaaagcagggtcatcagaagcctctcgattcaaaagatgataataccgaaaaacactgcccagtgacagtgaatccttggcatatgaagaaagctttcaaagtcatgaacgaattaagaagtcaaaatttgctgtgcgatgtcacaattgtggcagaagacatggaaatttctgctcatagagtggtgctggccgcctgtagtccttattttcatgccatgtttacaggtgagatgagtgagagccgagcaaagagagttagaataaaagaggtagatggctggaccctgaggatgctaattgattatgtttacactgcagaaattcaggttacagaagaaaatgtacagcattttgcagatgttgtacttagtgaagaatttctcaatcttggcatcgaacaagtgtgcagcttaatctcaagtgacaaacttaccatttcttcagaagagaaggtatttgaagcagtaatagcatgggtgaaccatgacaaggatgtgaggcaagagtttatggcccgactgatggaacatgtacggttacctttgcttcctcgggaatatttagttcagagggttgaagaggaagcattggtcaagaatagcagtgcttgcaaagattacctcattgaagcaatgaagtaccatttgctgccaacagagcagcgtatattaatgaagagtgtccggacccggctgaggacacccatgaaccttcccaaattgatggtggtggttgggggccaagcaccaaaggctatccggagtgtggaatgctatgactttaaagaagaaaggtggcaccaagtagcagagttgccttccaggaggtgcagagcaggcatggtctacatggctggacttgtttttgctgttggtggctttaatggctcattaagagttcgcactgtagattcctacgaccctgtgaaggaccagtggaccagcgttgctaacatgagagaccggagaagcactttgggagctgctgtgttaaatggattattatacgctgtgggaggctttgatgggagtacaggtttgtcatctgtggaagcatacaacataaagtctaatgagtggtttcatgtagctcccatgaatacaaggaggagcagtgttggtgtgggtgttgttggaggtttgctctatgctgtaggaggttatgatggagcatcacgtcagtatcttagcacagtagaatgctataatgctacaacaaatgagtggacctatatagcagaaatgagcaccaggcggagtggagcaggtgttggtgtgttaaacaatttattgtatgctgtaggaggtcatgatggccctttagtacgaaaaagtgttgaagtatatgaccccaccactaacgcatggagacaggttgcagatatgaacatgtgcagaagaaatgcaggagtttgtgcagttaatggtctgttatatgttgttggaggggatgatggttcctgtaacttggcgtcagtagaatattataacccaacaaccgataaatggacagttgtgtcatcgtgtatgagcacagggagaagttatgcaggggtcacagttattgataaaccattatgagcctgaaggacattttcagcatatttatacatgagaaacagccttcaacaagtatttgtgaagtgactgagaatctagcacttctccacttgtagctgcactttaagtctcagcagaagatacgatcgtctgcctttataggcctcagatactgaagattatttttggtagaagcaccgtgtaggctttttctgcaatgagcagcagctgactgaattttcataagaaacttggactgcaggacttaatctgtagtctttagacaacagttgctttcataaagactagttcttatcaaccttgaatgactacagattattttgtgaaggaggatgaagtaatgtgtgttcttgtaaaattaaattttatctttatttcttctaaaaatctgtataccaggaactgaaaatctttgaacagatattaaaatctacgtaagtatacaaactagttgagggatacactgtttgcttttataaaataactttgattacatgaatataataaattatgtgcatataaatgtgtgtctatatgctttcctttaaatatgtttgaaaagatgtttgaaacttgattatactatttataattggcacagtactttgaattatgccagtactacattgtaaaacagagttgtattttttgatatttaacaatgcttaacactttaaatgccacttctgaggaatggacctggtgtaacacacttgaatatgtgtgatgccaaactttttaaaatacaatataaattatgcttatttattattttctttagtttaatcttggtcatgttttggtgtgtatttttaatttttttcttaaattaacactttggcatgaacattactgcaggtttttgatgaatataatgaatgtatggaattcaattgaatttgcatggtcttcggaattttttctgtgtgtataaatttagctgctattaacagaagagagaactttctgtgagtagccatgtgtgttgatcagatacagtttttctgagatcttcaattaatctcactttaaaaatgaccaaaacatgtctttcttgaattaactttgaataaaagtttgtatattatttgtttcacagtgttc

SEQ ID NO: 38671 - DNA, 3002 bp, Homo sapiens
tcctccatgtggccacccatgtgacatgaagttggtgtcactaggtaccacgttgtctgtcccatccaacaggaaaaatagcctgttggccagtgaataaggtaggaatccaggtggtcccctgagggtcttctgacaggctcctttatcaggctcttctcatggtatgagcaccgcagcttgctgacagtggcaacgttctcaagcttcacagactccgtcacttggcctggaggggaattctaggtgtccagccccaggacaggcattttggcaccatgattgagcacgatatggtgagccatcctcacaggattaagaagaattctggacagaaatatagttgtaagtaagcatcagtcagcctgcactttgacccacttccttgtaaccaacagtgacgtagcactaggtaacatttgcatccccgttgttcctatagatacaatttctgaccttagaatcacaaggcttttgtttaaaatagatgggatctctgacattagaatcataagatttttgtttaagacttgcttaagatgtttttcagatcctgaattccagcaaaacagccgacaccaaccagtttgaagacccccacagaggaatgtgatcagcatgaaaatacagcttcgtctccctctcccatgactccaccctgcacacttcgaccaatcaaccatctccacactccagtctccactcccaaacccttaaaaaccccagccccaaactcctcagggagatggatttgacgtttcctcccatttcctccttcggtggccctacgatgaaacctctttctctgctacaaccctatgcctcggcgtattcactttctggtcccatccagcgatggacccatcgtggttaccgtggctggccaagcctgctgtgcttcacagaccccactcaggatcacaccacttcgttccactgtttggagatgccatgtttgcttatcccttcatcagctgatgagcatttgtgctgttttcactttttggctattacgaaaatgttgctacgagcatccatgatattcgcccatttaaaaaagtgtttttcaccattactgctgtgggaaatttctccctggctctgtcctttctttgtagcccagccttcccccaggttttggctctccctctctggctcaatgtcagctccttgtctcacctcctagagcaattccactctcccacctcctgctgcggcatttccaaagcctctgcttagcaagggaccacccattctgcacctctccccttagggctgcaagcacctgcacaaacttggtggttatcctatgcctcaactcaatcaaattctctcagttttccatcagcaatctttttaagccaaagggaaggcaaggacttgatcttcacatcacatgaatcatgacacctgccttagaaggcagaagcaactgtagttggaatagcaattgtttttcaacatatgggatgatatcaaggctctttcctccccatatgtcctgccctgttagtggctggggctgagggttttcccaggaagccagattgtcctcacaagttcctcaggaccctagggcttccacagatagtaggactgttatcagaaagaagtctcgatccagacgccgagagagggttcttggatatcgcccaagaaagaattcagggggagtccatagagtgaagtgaaagcaagtttgttaagaaaacaaaggagtaaagaatggctactccataggcagagcagctccgagggctgctggttgcccatttttttttttttttttctttgagatggagtctggctctgtcgcccaggctggagtgcggtggcacaatctcggctcactgcaagctccgcctcccgggttcacgccattctcctgcctcagcctcccgagtagctgggactacaggcgcccgccaccatgcccggctaattttttgtatttttagtagagatgaggtttcacatgttagccaggatggtctcgatctcctgacctcgtgatccacccgcctcggcctcccaaagtgctgggatgacaggcgtgactcgtgatccacccgcctcggcctcccaaagtgctgggattacaggcgtgagtcaccacgccgggccggttgcccatttttatgattatttcttgattatatgctaaacaagagctggattattcatgagggaaaggggtgggcaattcctggaacggagggttcctcccccttttagaccgtgtaggataacttcttgacattgccctggcatttgtaaactgtcatggcgcaggtgggagtgtctcttagcatgctaatgcattataattagcatataatgagcagtgaggtcgaccagaggccactctcatcaccattttgggtttggtgggttttggccacttatctactgcaacctgttttatcagtaaggtctttatgacctgtatcttgtggtgacctcctgtctcatcctgtgacttagaatgcctaacaggctggggacgcagcccagcagatctcagcctcattttactcagcccctcatcactctgattcaaatgcctctgacatgaccacgcagatttgagaaacaggccctcagccaaccagactctggctctacgacacacttaatactgtgaaaagaagattacgggtcatagtcacaaataccaggggtgcaaaacttcagattagaagacacttgtcagactcagaggctcatccaactccacggagatcattatcaccacaagttcttcagacaggtgtggaggttttctaagggatatttttattttctggattgcaattttgtttaggaagagatgaaagtgaggatcaactactttgaggattgtacaactttgtaaattgcacaaatatgacggcatatttatatctgcctgcatttgtgaaaacaaacttgtcaaggagcttatttctggaaagggtcaatgattctagaaaaaaaaaaaagataaatatgagacccttcag

SEQ ID NO: 38672 - DNA, 3104 bp, Homo sapiens
tcctccatgtggccacccatgtgacatgaagttggtgtcactaggtaccacgttgtctgtcccatccaacaggaaaaatagcctgttggccagtgaataaggtaggaatccaggtggtcccctgagggtcttctgacaggctcctttatcaggctcttctcatggtatgagcaccgcagcttgctgacagtggcaacgttctcaagcttcacagactccgtcacttggcctggaggggaattctaggtgtccagccccaggacaggcattttggcaccatgattgagcacgatatggtgagccatcctcacaggattaagaagaattctggacagaaatatagttgtaagtaagcatcagtcagcctgcactttgacccacttccttgtaaccaacagtgacgtagcactaggtaacatttgcatccccgttgttcctatagatacaatttctgaccttagaatcacaaggcttttgtttaaaatagatgggatctctgacattagaatcataagatttttgtttaagacttgcttaagatgtttttcagatcctgaattccagcaaaacagccgacaccaaccagtttgaagacccccacagaggaatgtgatcagcatgaaaatacagcttcgtctccctctcccatgactccaccctgcacacttcgaccaatcaaccatctccacactccagtctccactcccaaacccttaaaaaccccagccccaaactcctcagggagatggatttgacgtttcctcccatttcctccttcggtggccctacgatgaaacctctttctctgctacaaccctatgcctcggcgtattcactttctggtcccatccagcgatggacccatcgtggttaccgtggctggccaagcctgctgtgcttcacagaccccactcaggatcacaccacttcgttccactgtttggagatgccatgtttgcttatcccttcatcagctgatgagcatttgtgctgttttcactttttggctattacgaaaatgttgctacgagcatccatgatattcgcccatttaaaaaagtgtttttcaccattactgctgtgggaaatttctccctggctctgtcctttctttgtagcccagccttcccccaggttttggctctccctctctggctcaatgtcagctccttgtctcacctcctagagcaattccactctcccacctcctgctgcggcatttccaaagcctctgcttagcaagggaccacccattctgcacctctccccttagggctgcaagcacctgcacaaacttggtggttatcctatgcctcaactcaatcaaattctctcagttttccatcagcaatctttttaagccaaagggaaggcaaggacttgatcttcacatcacatgaatcatgacacctgccttagaaggcagaagcaactgtagttggaatagcaattgtttttcaacatatgggatgatatcaaggctctttcctccccatatgtcctgccctgttagtggctggggctgagggttttcccaggaagccagattgtcctcacaagttcctcaggaccctagggcttccacagatagtaggactgttatcagaaagaagtctcgatccagacgccgagagagggttcttggatatcgcccaagaaagaattcagggggagtccatagagtgaagtgaaagcaagtttgttaagaaaacaaaggagtaaagaatggctactccataggcagagcagctccgagggctgctggttgcccatttttttttttttttttctttgagatggagtctggctctgtcgcccaggctggagtgcggtggcacaatctcggctcactgcaagctccgcctcccgggttcacgccattctcctgcctcagcctcccgagtagctgggactacaggcgcccgccaccatgcccggctaattttttgtatttttagtagagatgaggtttcacatgttagccaggatggtctcgatctcctgacctcgtgatccacccgcctcggcctcccaaagtgctgggatgacaggcgtgactcgtgatccacccgcctcggcctcccaaagtgctgggattacaggcgtgagtcaccacgccgggccggttgcccatttttatgattatttcttgattatatgctaaacaagagctggattattcatgagggaaaggggtgggcaattcctggaacggagggttcctcccccttttagaccgtgtaggataacttcttgacattgccctggcatttgtaaactgtcatggcgcaggtgggagtgtctcttagcatgctaatgcattataattagcatataatgagcagtgaggtcgaccagaggccactctcatcaccattttgggtttggtgggttttggccacttatctactgcaacctgttttatcagtaaggtctttatgacctgtatcttgtggtgacctcctgtctcatcctgtgacttagaatgcctaacaggctggggacgcagcccagcagatctcagcctcattttactcagcccctcatcactctgattcaaatgcctctgacatgaccacgcagatttgagaaacaggccctcagccaaccagactctggctctacgacacacttaatactgtgaaaagaagattacgggtcatagtcacaaataccaggggtgcaaaacttcagattagaagacacttgtcagactcagaggctcatccaactccacggagatcattatcaccacaagttcttcagacaggtgtggaggttttctaagggatatttttattttctggattgcaattttgtttaggaagagatgaaagtgaggatcaactactttgaggattgtacaactttgtaaattgcacaaatatgacggcatatttatatctgcctgcatttgtgaaaacaaacttgtcaaggagcttatttctggaaagggtcaatgattctagaaaaaaaaaaaagataaatatgagacccttcagtaaaaagaaacttactctagggaagttttttgtttttttaaagaagcagtattcactcgtgtttttaaaaaggaacatggatttcaacaataatataatgag

SEQ ID NO: 38673 - DNA, 569 bp, Homo sapiens
tatgctgaagacctggcaggaggcaactcctgacacccccacagggttagactgtaaaacctcttccatgacttgctgactctataggataatagcaacaggaaaagaactgagggacgtgcagatgaggatgaatagggccccaacaccagtgcctgaggctgaggttagaactgactacaaagacacaggaaaccaagggcccagtctcccctccacgctgaaatacgcaccctcttgtctgggtcatgtctactatgtgaatacttgaccatggaggtctggggctctggtggcttccatagctggctagtctcttgatggagagaaatcagggcttctctcatccatgctggaatttcatttagatgtcaacttccaagtttccctttttccagatgggattatagtcctgcttctggaacagggtagctgtgtgtggtccaggatagttcaattatctggccctttgttcacttcttacaatcattgatacagtcaacaaaaattggttaaaaacaatatatgccagacatatatccctgagttctgggacaataaccaaaatt

SEQ ID NO: 38674 - DNA, 413 bp, Homo sapiens
atagattagatagatatggatagatggatatggatagataggatagattagatagatggattgatagataagatggatggatggatgaatggatggatctataggtagatggatagatggctagatggaggaatttctgtgtactgttcacatgttctttagtctgttcaaaaatgtactttgcattgggatgctgcccccagcctgcctacatcatgcctttttcctgatgacacgtgttcctgtcactgacgcccgggagctgtttttgagggcagcttgcccagcgtgctagtgacaggaggctggtgctaggaatgaaggttatttggtcttctcactggcatcactgtttggtattctaatcccatgagatcgttgtaaacaatagcaaagttgttcatgaactggca

SEQ ID NO: 38675 - DNA, 664 bp, Homo sapiens
tagctggccgtggtggcatgctcctgtagtcccagctactcaggaggctgaggcaggaaaatcacttgaacccaggaggtggaggttgcagtgaactgagaccgtgccactgcactccagcctgggtggcagagcgagactctgtctcaaaaaaaaaaaaagaaagttgtgaatttgatgtaagcttaggaaatgaataaaatttataggcatctgtataatgtacaacttgacacggactttcttttatccttagtttctttcacggactctagaacttttatcagaatatactgggtaaaacattggggggagggatcctgagtaggtgattgggtcagaaagatgccttcagttttggtcagtgtctaaaagttaagtctgtttaggccaagcatggtggctcacgcctgaaatcccagcactttgggaggccgaggcaagtggatcacaaggtcaggagatgagaccatcttagccaacatggtgaaaccccgtctctactaaaatacaaaaaaattagccaggcgtggtggtgcgtgcctataatcccagctacttgggaggctgaggcaggggaatcgcttgaacccgggaggcagaggtcacgccactgcactccagcctggcaacagagcaagactccgtctcaaaaaaaaaaaaa

SEQ ID NO: 38676 - DNA, 356 bp, Homo sapiens
cacctgcttggagaaaagtcaaatctccaggtaatttttgaaaagtcatgttctaactcagtatttttatttctcaaataacttattcaaatgtttctctgatttgttcaaaattgataattttatgttttaaatgtctcagggtctataaatgctaaccttaaaaaaactaacttgctgtaactgtggatattttctttggagcatggggatcattgtagggacaaatactggaatgagtctaattatatccaaaccactccactaaatcgctgctgaaagcacaagccaacgataccgtacatccgagttcaggaaatccatacccttagtttgctgagattggctgaggacaa

SEQ ID NO: 38677 - DNA, 355 bp, Homo sapiens
ttgctagtaagtggcagagctggctttgaacctggtcctaatgactctaatgcctcctctttcattctaactaatcagtgcttctcagtcttccgccccaatatttctaaggtccaaggagaatgtagagaacttcaggagttttggggtggtagaaaggggaggtggttagagaggagaatgttagcttgagatggttaaagactattgttttttcttaaaaagaaatggtttttggctgggcgcagtggctcacacctgtaatcccagcactttaggaggctcagacaagaggatcacttgagcccaggagtttgagatcagcctgggcaacctagtgagaccctgtctctac

SEQ ID NO: 38678 - DNA, 525 bp, Homo sapiens
cagtgccagactctcgggagaaggggcataaaggacagaaaataaaatgagttgatctttgagcacagcgacagggattttttgtacatcgtgccttacagagcgagcgctgggaggaggaatcatcaccctgctgagaagtaatgggtgcagaataaatcgagtaagaaggaatggacttttctggcggatgcttactgatctaacaactggatgactgaggaatgcggtcctaagtgaccccgggctggctgtggggccaacagcgtgcgggatctgactaacagcgtgtggcagccgagcgactgcagcagcggcggggaccccattgactgtccagccccgagagcggcaggagcgcggtggatcctggctcggaccaaggcctctcccctgcgccgactgcagaccaaccctccaccaggagcctcgcgggggggcgccgtgggcaccgcagccaggtgcaggcgcctccgcgccctcactccccacgccgaggaggtggccctggctccctgcggccgc

SEQ ID NO: 38679 - DNA, 207 bp, Homo sapiens
attatacttagcagtaagttgggttagcagcatggtgtaaaggtcaggtatgcaaggtgcccctgaatcctttctagttatttgcaggggtcccaaggtggttcaggatagtgtttaaagttctccccaaactgaacctttctgaaatcttcagactgtttagctaacttttttttcaccattatttttcattttgctcacctctgc

SEQ ID NO: 38680 - DNA, 326 bp, Homo sapiens
aactttaaattttgaaatgatttcagactcacagaaaagttgtaaaaatattacaggtaatttctgaatacacttcactcatatttaccacatttactttatctttctatctatatctgtatttactggaagcatttcagagtaagttgcaggcctagtggccctttactcctaaatatgtctgtacttcctaaaaacaagtaaattttcttatgtaactatagcaccataatcaaaatcaggatttggacattaacatattactgtcttccaatttagggactatattcaaatttccccagttgcctcattaatgccttttgtgg

SEQ ID NO: 38681 - DNA, 367 bp, Homo sapiens
ttttttcttttgtcctcctgactgtgctgtttttccctctactccaaattctcaaaggacttaaaagctagcattcagtaaacaacttatttttttctcaggaaaatatgtaagtgatcatacagctgaggagacatgggttattaaatattttgtattaatgattactctgacaatttagtatcaaaataagctcttatttatgccctaatcaacagcacaaatatgaataaatgctagcacagaaaatcagaaattcctgacaactatttaatcaatagttacttgctccttgtcggacatcagtgaatgagtgaaagcatcacagtgaccagtcctcagtcagacagattctcttccttcacaa

SEQ ID NO: 38682 - DNA, 132 bp, Homo sapiens
aattgtattccaaatcttttggaacagatgaccactgtagccacctattatgaatgttctgcgataagcacttgccgatatcagttctgtaaactacatttattgcaacaatgtttattataccaaaaagtc

SEQ ID NO: 38683 - DNA, 490 bp, Homo sapiens
gcggctactactactaaattcgcggccgctcgacagcctgagctctgagaatcattctcctcatcttattttccataactttgtcctggaaaatgcagtctgggggaaagcattttaaatagtaatcatctgagtctagtccagaatttggaatccaagggcaggcggatactttgtcataaacaggagcaataatacgtagataatgcagtcagtggaggaaaagtctggcgctgctgtggctctgactgctcctggattagttactagaccaaatgctgcaaactggtccattgctttgctttgagcaagcaccttattttatttaacccctgcatatacacttaagacattgtatccacatgtttctaattcatttacacttcactcatcagcatctgttgggtaagcaccctgtcacctccaagttttatgagctgtgtttactaggctgcaattcttgaacagggatatcgtatattccacaaaa

SEQ ID NO: 38684 - DNA, 884 bp, Homo sapiens
  misc_feature (1)..(2): n is a, c, g, or t
  misc_feature (6)..(6): n is a, c, g, or t
  misc_feature (8)..(8): n is a, c, g, or t
  misc_feature (10)..(10): n is a, c, g, or t
  misc_feature (13)..(13): n is a, c, g, or t
  misc_feature (16)..(16): n is a, c, g, or t
  misc_feature (18)..(18): n is a, c, g, or t
nnaggnantnggnacnanaatacaaggagctcatgtggttcaattagcttatttaaattcaaaagaagcccaaaagcctaatctgtcacttgccttagagtagagctatttcagtctcatagttaatgtcataaattaagccttgatgtaaataaccattttattcccctacacttttacttgcccatatccttctggaaatgtactgggaggaagaagaggaggttcaggccaaatgttagactcagccttggcctatgtgactgagacctgtataaatggactaataagaatcggctcacccactctaaccacagcctttattgcttccccactttcaaagaccttgagagcttttgaaactatggggaaactgaggctgggaacatctgatacacccagtcagcttagtcacttagtaaataactgctgaacaacttacgtggcacaaggacgaaaacagaggtctgtttgatcgaaattttcacttccaagctgtgtacactgtgggtacttaataaatcctcctagacttaattgattttgacttaattcaccacttctgctgaatctcctcaaacctcatcacgtagacgtctcataattctcagaacatacctggaccattgccaacatacatccctggtgtcactttttactgtaactgttgtttcatgtggctttccccttttactagattaggagcattcaaggagaaaatagatctggaaaaaatatagataacaatttacgtttcttcctgagcaactcctgctctaacaactgtcagaaggagttgagatataggaacaggatcacccctatttgacagatgagaaaattgaggcacaggcacagactattatacgttatttgtaaaaaaa

SEQ ID NO: 38685 - DNA, 821 bp, Homo sapiens
agccgagatcatgccattgcactccagcgtgggcaatcaagagtgaaactctgtctaaaaaaaaaaaaaaaaaaagtttcagaattaaagacttggggaaaaataaacctttcctggcaattctgatgtagcagcccatggagctgtattcaagattcattgaaagaacccccttgaagccagctgtcctctcttgcagcatgattttaaaggaagcatgttgatcaagaacccttcataccatcttaagggttctagtttgcaagtacgggaagagcccttcctatggcaaaggaaagatccccttagttgcaattaacaggtatcttcctggaatttaatctttaactgattacccaaagtctcaactgctctctcttctcttccataagtgacaagatacggggctgaaatgcttgctgcttacatgatcagtagcctggagaagtaacagaacatacacacgttataatactgattcttgtgatttcaaggtgatgaaaacctctctctttctggcctcaaatttctccttctggactcaaatcccttcagttttctatgggaggatactttaggagaccaaaccgtaaagaaaaacaagtatgtgattgtcaaaaaaacaaaaaaattgaccgctcctctttccgctgccccaatcagaaagaggagctgtgatgtggtagaggggcacatggagggcttctgagggctggcaatgttctttttttttttctcacctgagtggtagtaacataaggtttcattttacaataggttattaaactctacgatgagttttgtgcacttttaagggtgtg

SEQ ID NO: 38686 - DNA, 420 bp, Homo sapiens
tctgaaacccttaaagtaaggagcagcaaatttcctgtaataggccaaatagtaaatatttaggctatgtggactatatagtctactgccgactctgtcattgtatcatgaaagcagccatagactatatgtaaatgaatgggtgtggctgagcttcagtaaaactttatttgccaaaagtctgtgatcctggtttagccccttggctggagtttgctgatccctgcattgaaggaaaatctgaggtgaaaactcttagcttactaatagctatcttttgtcaactccatttatatggttgattataatattcctgtcattcttggtaatatttgatacatatatttgaaagaaatgcatgagtcacctgagaggaaggaggttgagaagtcagacatatggcctgatgaactgaaatgg

SEQ ID NO: 38687 - DNA, 414 bp, Homo sapiens
aggccctttttggaaggattttttaaagtacagtcctacatcactcaatcatggggacattctttctgagaaatgcatcatcagtcgatttcatcgaacacctagagtgccctcaaacccagatggtacagcctactgctacacacctaggctctgtggcatagcctattgctcctgggctgcaaacctgtacagcacgtgacagtgctgaacacggtagcaagtgtaacacaagtaggtatctgtatatctaaacatagaaaagctaagtcaaaatacagtgttgtcatcttatgggaccgctgtctcatgcagtgcatgactgtatacaacttcaaagctttgccgattgtcttggttttctttaaacagttttggagttttttttttttaataaagatttttaactaatga

SEQ ID NO: 38688 - DNA, 304 bp, Homo sapiens
cttgagcactgtattaagaagaaattctcctagtttcttccaagtaacagattcactttgttattgttgagagtccgttcagtcattacagcttctgtaacatcagtgactaaaataatgaaactattttctctataaaaatgtttaatttttgttacaacaggttagaggtttaatctgttgtttggcttagattcgagtcattgcctctgacactacctttttaatagcagctccatcccccaccaaccccaagcagatggcagttcccttacaagtctaaggatataggggaggaagacaa

SEQ ID NO: 38689 - DNA, 227 bp, Homo sapiens
tgtttattccatatgttgtcaacttactggcatagggtagtacatcatattcccttatctttttatatgtgtagcatctttgaggatataacctctctgattcctgatattggcaatttgtgttttttaatcctctctttttaaattttcagtttggctagagtttatcaattttatattttcaaagaaccatatatgcttttattattttctccattattttttct

SEQ ID NO: 38690 - DNA, 364 bp, Homo sapiens
acatacccgagactgattaatttataaagaaaagaggtttaattgacttatagttatgcatggctggggaggcctcaggaaacttacagtcatggcggaaggggaagaggcacgtcttacatggtggcaggcgagagagagaagagggaacaagggaggagcttccaaacagttataaaaccatcagatctcttgagaactcactcactatcatgagaacagcatgagggaaaccacctgcatgatccgatcacctcccacctggtccctccctcaataactggggattacaactcaagatgagatttgggtgggaatacaaagcctagccatatcaaatagtaaatatattttcttattatta

SEQ ID NO: 38691 - DNA, 997 bp, Homo sapiens
agaacacctgcacagaaacagacccacagaaacttgttttgtttgttctgacacttttttcacactgcactgtcatggcttgtctatgagtgctctggtcatctcgccagaccatgagctcaccacaggcagaacctggcacattttgtcctttgacacaggcttgcagggtgattaaaagatttttctcctgtgatacattttatttgcacaagttatctggtttgagtcaaaaaacctaattgtattgacaaacaggccccttggcaaagatgtttattggcataccttaaatttgccaaggttatctccttcctcatcttactgagctcctcacccttaatcttccctgatcatctccttccttaccccgttaagtgccccactcaccctaaaacacactggataatgatgtttattacccaacaatgaaaatattgttatttatggttataatcaggatgtcatcaaatatgaatgctcacatttggtgagggcctttcaactgattgtttatgtaaatgaaagtgttcgctcatcatcacatccattttgggaagaaacaatcagccaggcgggttgtttctctctataatatctttttagtattcagttcactgaaaaccaatctgcaacaaaagaaaaaaaaactacaaatttaaggttagatgtaaacctatagcaaatgttagcatgccctggaatgacacaggcagaagctcaattgcaattcctcttcactgggaaacttagaatgggcctccaatctggatgcagtttccaatagagaactagcctttccatcccagtttctcccacttagcatgaagtggacaaggccattatgcagtggatgtaaccaccccagccctggaattgggccatctatatgatctcaagtttgtcacatttacaagcaagtcttagttaacttatctgttgtattagtctgttctcacactgctaataaagacatacctgagactggtttatgaat

SEQ ID NO: 38692 - DNA, 998 bp, Homo sapiens
ttgcagtcttttactacaggaatgtgaagatatatttaaaaatagaatactttaaaatcaggaaatgtattttgctctcttgaagaaaatagatatgatttggcaaaggataaaattagccataaatgataaagatttttttaacatctgaacttgtcattagcactaagatgagctgcttaccaggaactaagaagaattaacatcatcaagtttaaaatcgatcattttaaatatgaaggagatttaaacatctcaaccccatgaatcaattgtgctgataactatccagtctcattggatagtgggctcatcaaattgaggatattcaggagttaaagagatcagcacagaagagtgagaccaaatgctttttcttcatttcatttactgttataatgactgatgagtataaagggatttataagggcttttcatttcaaattacatttttctttaaatatccaaagttcttatgtggaaacaactgcaatttttatgaataggctggtcttgcctttaaaaatatgtttttaaagagcaaattctgcagaattaattattaaaaagactatgggactttggagaggctttcattaacattgtccctaaactacccttagttctacccagtggctcagaacttggggcaattttttttcccaggttatatgtggcaatgtctggagacattggttgtcacaacttcgggggacagtaccggcatttatgcatagcggtcaggggtgcagctaaacatcctacagtacacaacccacacatcaggagcaagaacacatccaattcaaaatgtcagtaatgccaagactgagaacccctggagtaagcctcacaaaagctcttatgacctcacagggcagctgtcttattgtaatcccaaatctacctcagtgatttccttgacattcaaaacacctgtctctactgaactttagagttcttgatttaccaccactggaatttgctctaccaatggc

SEQ ID NO: 38693 - DNA, 944 bp, Homo sapiens
ttgcagtcttttactacaggaatgtgaagatatatttaaaaatagaatactttaaaatcaggaaatgtattttgctctcttgaagaaaatagatatgatttggcaaaggataaaattagccataaatgataaagatttttttaacatctgaacttgtcattagcactaagatgagctgcttaccaggaactaagaagaattaacatcatcaagtttaattgtgctgataactatccagtctcattggatagtgggctcatcaaattgaggatattcaggagttaaagagatcagcacagaagagtgagaccaaatgctttttcttcatttcatttactgttataatgactgatgagtataaagggatttataagggcttttcatttcaaattacatttttctttaaatatccaaagttcttatgtggaaacaactgcaatttttatgaataggctggtcttgcctttaaaaatatgtttttaaagagcaaattctgcagaattaattattaaaaagactatgggactttggagaggctttcattaacattgtccctaaactacccttagttctacccagtggctcagaacttggggcaattttttttcccaggttatatgtggcaatgtctggagacattggttgtcacaacttcgggggacagtaccggcatttatgcatagcggtcaggggtgcagctaaacatcctacagtacacaacccacacatcaggagcaagaacacatccaattcaaaatgtcagtaatgccaagactgagaacccctggagtaagcctcacaaaagctcttatgacctcacagggcagctgtcttattgtaatcccaaatctacctcagtgatttccttgacattcaaaacacctgtctctactgaactttagagttcttgatttaccaccactggaatttgctctaccaatggc

SEQ ID NO: 38694 - DNA, 406 bp, Homo sapiens
tgcggtcgctctagaggatcaccctctctagacgaggaagaaggcatacataattacttcagtgtaatcctttatatcagagtaatctttcaggaactaaaatagcaattgttaataaaatttagtttctcattatagtctaaaagcaaaataaattctgaagtagtccaataacagaactgtatgacccctttagaaataaaatttatcatgaaatgctagttcttttaagtttgtattaagtttaaatggtaaaatgcatataatttaaattttatgtatttttatttcagaacattttttaaaatattaaaaattattttttagtcttgtagtcattacaaaattataaacgagttgtatactggttcctttttgaggtctacaaacatgctcgtgtatcttc

SEQ ID NO: 38695 - DNA, 406 bp, Homo sapiens
gttcgacgtgagccgaaaaaactggccacgaagtgattgttaccttgataagttaccttttccattcctcttacactggtaagattctgtgaattcaaatgtttgcttaataactttctaaaggcacaataagaaagaagacattctgggaaatgaattgtgcactaattgtaagttgagctctggaagaaacagaaaagagtcatccacctgagctctctggaggtccctgctttttgctccaaggaagccactactgagaaagtaaggttagatcttttattcatttatatgaacagggcttatacatttctatcaggaagaatatcagaggattctcatccaagcaaacgttgatgaaacatcattgacagggtaatgacattctgaatggaaaaaacgtgaa

SEQ ID NO: 38696 - DNA, 367 bp, Homo sapiens
ccttccccagatatttgcgaggctttttctcccccaccctcttgaaatatcacctccccagtaaggtttactcccaggcaccttctgcagagtctcagcttcccacacccctcctgatgttcagtacagcagacggcttttcacataggctgtaatttcctgatgttctgcgcttgtttgtttactgtctgtgtctgtgaggaggatccaagtgcgcgaggatgttgtgatttgctttgctttgggaatcccaggtgtcagcagtcatcactggcccacagtgtgcgttcaagaagtcttacctgacccaggtgtggtgactcacacctgtaaacccagaatgttgggaagccgaggtgggaagatt

SEQ ID NO: 38697 - DNA, 475 bp, Homo sapiens
tcttcctccggcgcggggctaagtgcaggcccgggggtccctagagccgccggggccggcgcgtccggcgctgggggactgttgggtcagaaagtcttcagggagcagctgttgcgccctccctaggcccgccgcttggagacgccccgccccctgccttcaacggccgcccgccccgccccgcaccgccccggccccgccccctgtgaggaacttttatacagtaagtctgactcttactgcactggcagagctgagagaactgatatctggcatgggataacatggaaaggctgtaaacagattgcagaaacctggatccagacacctgggctgatgacttaacgcagggcaaccttaagattcactgcagggcatttagtactgctatgcagagggaaaaggtgctcctgaggcatttattatctgttttccaagaggtaggttagcataaaccaaaccagatgggcccagc

SEQ ID NO: 38698 - DNA, 551 bp, Homo sapiens
atctgagatatttaaaaaatatacattttctgttttttgagctttttttttttgcatttcttgaaaggctttttatttcaaagataaaatacagtcacaaaatacctaaataatccaacagcagcatgtgtatggaacaaaatgagcttctctaaatcctaaagtctagaaaacaaagtttttttaatgagaaaggggaaattataaacaaaaaatggccaaatgcaactatgaattgccactaaatattcagtgtgtatatatatgttcagcaaaaggcaaggacacttcatcttctactaatgagtttttaggactcggtactaggttaggacagcaatcaaacaaaggtctcacatgccttacaatgatgctgggtagatatatgtgctccttatgtaaccaagtaaaatgatctcagactgctaataactatagttaaataaatatgttattaacaaagggttgcaaaaacaagggtaagatggtatgaattgataacagtagcaataaaaaacttcctagaagttgtaagttgagctttcaaaaaa

SEQ ID NO: 38699 - DNA, 321 bp, Homo sapiens
ggtctttaacgtctgctcccaaaaaagttaataaaaatcaatgatataactgactaatccaaaaccagtggcaatagatgccctagaaggatatttaccatccgtctgttaatagctctgttgtgtgttttaaggagcactttagcaaagtgttgaatgttaatgattttcatatagtggtgtcttgaaaatatgtagtttgtggtcaggtgtggtagctcacacttgtaatcccagcactttgggaggcccaggagaatcacttgagcccaggagtttgcgaccagcctgggcatcatagcaagaccctgtctctaccaa

SEQ ID NO: 38700 - DNA, 420 bp, Homo sapiens
gtggctgttcaatgtcatttcaccttatgaattctgaagattttcaacgtgaaaaccaggctcccaaggccttcgtagttgttcactatttctcaaccttggttacacgttagaaatgcttggggaggttttaaaattctccatgcccagaccaattaaatcagaatctctgaacaggaaacccagacagcagaatttttaaggcttcccgggtgattccaatgtgtagaatcgctgctctaacaagacatgttagctccaccctcagactctaaagctgatcagctggggtataagcttttctgagtaggaaacagctgagtataagcaagggcatttctttgggtgcagcaaggtacaaaataaggttaagcagccacccagcagcgaataaagttacactttaatttcgaaataaag

SEQ ID NO: 38701 - DNA, 345 bp, Homo sapiens
aaataaaatctcagtggtataccattacatacctatcagattgcaaacattgagaagtctgtgataatatcagctgggtgacaatatcagctggtgagtatatggaccagcaggagctctaagattgggagtaaattggtactgtggaaaggtttttgaaattatctgataaagttgaaaataagtagtagcaattctagggatatacttgtgcacaaatatgctaagatacatgaatggaaatgtttcttgtaaaattgttcagatgaaacaggaactccattgtccattagtaaactataaagcaattaaaactaataatatatacaattgtatgtaaatcca

SEQ ID NO: 38702 - DNA, 93 bp, Homo sapiens
atcactaccacacacaatcactatgtgtgattttttttttccctcaagagaatgtattaaaaggaatgcttcggaattaaaaataaaaatttt

SEQ ID NO: 38703 - DNA, 661 bp, Homo sapiens
tgggcctaggaaaattttgttcagtgtaaactttcattgtattaacactgttctctttattactgattttaatattgttaataaaatacaaataattatagctgccacttgctgagtgcttaccctttgccaggcactgttgtacattttgcacgcattatctgaatttaatcctcatgagaggcgagtacttatattatcttcacttcagccctgaggaaattgaagcttgcaaggttaactttccctaagttcacgttttcatttttctaagaccttaagggaagagactgtgacattctggttttttgaaggcaaaatctgtctacaatcacggatttccaaatacacaaagccatattataatagaaatgtaaattagataatcagaacagcgttacaggaaatgatacactgcaatcattttctttagtttttttttgttgttgtttgtttgttttcattttgtcttaagcttactgagttttgcacagccaggggcttatactaattttgatgataatttaaaatattattggttgattaggattacaattttattgaaggaacagaaagacgttgccagctgaactgttcaatacagtagccactagttacatgtggctatttacatttaaatgtaatgaattaaaaaaaaaaa

SEQ ID NO: 38704 - DNA, 155 bp, Homo sapiens
actgttcacattttccctggtggaagtggatgcaaccactggtgagatatctctggcccttgagaagaatgtgggatatgtaaaataaaaggaattcctccagacaattgattgattgaagagagattataatcaggacagtcattcaacaattc

SEQ ID NO: 38705 - DNA, 389 bp, Homo sapiens
ggccaaggcaggaggattatatgaagccaggaatttgagacaagcctgagcatcaaagtgagaccctttctctaaataaataaataataataataatctatctgctatcttaattcctctttgccatttaacatgacatattcagagtttctggggattagaatgtggacctcttgatgagaaaggacattattctaccatattgccacagttttgactcaattatttctccaaggattgctgtttccttttattggagaattgtctctgcaatcaagatttgggcactgggtgtgcccattggtattggggtatagtttcttttaggccctctcaaatgaaaaagaaaatatatatatgtacactattccatggatacatatagaaat

SEQ ID NO: 38706 - DNA, 465 bp, Homo sapiens
agtaaatcatctgctattaaatttgaagtttatccaacatctctaattaaaaataattttgagggtcttgttgtgaaactgatcaatagatggatatacgatcttccaaaagatgcattttggtcatatttttcacaagcacaagaactcttttgggaatctacagactgtgttaataatctctgtaaagatgtagttttgaacaagaaaattacgacaaaactacaagagtcaaagtttgatgtcgttcttgcagatgcccttggtgcctgtggtgaactgctagctgagcatgttaaaggcatgttaaatacatgtcctttgttgacagtctcctggctacacacttgagaagtataatggaggacttccattccccatttcccgcatacctgctgttctgtctgaattaagtggtaaaatgacattcgtggagaggattaaaaatctaatacatgtgcttta

SEQ ID NO: 38707 - DNA, 439 bp, Homo sapiens
gtgctgtgggtgtttccaggtgagattagcatgtgaagggtggccctccccagggtggtgggcctcgtccaatcagttgggggcctacatagatccaaaggctgagtgagagggcctcctcctgtgacagctgcagctgggacctcggtcttttcctgcctttgggcttggactgaaatgccagctcttcttgggtcttcagccttcaggctggaacctgcagcagcatttctctggttcttgggccttcagactcagactggaccgaaaccatcagctctcctgggcctccagcttgccaacgacaggtctcgggacttgccccttccataagtgcttgagccaggtcttcaggataaatctctttccacctatcctgttggttgtgtttctctggataactcagactaatacaagccagtccttccatactttggta

SEQ ID NO: 38708 - DNA, 374 bp, Homo sapiens
gtgctgtgggtgtttccaggtgagattagcatgtgaagggtggccctccccagggtggtgggcctcgtccaatcagttgggggcctacatagatccaaaggctgagtgagagggcctcctcctgtgacagctgcagctgggacctcggtcttttcctgcctttgggcttggactgaaatgccagctcttcttgggtcttcagccttcaggctggaacctgcagcagcatttctctggttcttgggccttcagactcagactggaccgaaaccatcagctctcctgggcctccagcttgccaacgacaggtctcgggacttgccccttccataagtgcttgagccaggtcttcaggataaatctctttccaccta

SEQ ID NO: 38709 - DNA, 222 bp, Homo sapiens
gttctttggttttcctcatgttccaattgatagttccagaattactgagaaaaaagaagttgcgcatggtggctgatgtgtattttgcaatattaaacaatttacattacttgaattctgtatctgtgcaactatagatacaaaatggataaaccatgatgctgatcctttagactagcaattaaaatatgaacattaaatgctggaattatgaataatttt

SEQ ID NO: 38710 - DNA, 550 bp, Homo sapiens
aattttcaagatatttgttcttgccttagcacatgctttccaggtctaatttcagagctgtctcaatgcttttctaggaaagaatgagggtgtatgggaggaaattgtttgatctacaaggtctgccatcttaatgatcctcatgctaagaacactgcagatgtatgttttgccctcactcatggggaaagaatctatggttctccaattatgctgatgaagtagaagtcaagtaaaagtgaaggtgcgttcatttaaaacataaagattttcagtgactgttaacatctgtctttctgattataaataaaactaactgctgagattttcagatcttaatatgtatttatataacaaaaaccagtaagttaattgttttccatgattagtagcaggtatagaaagatcttcttcagattggtacatgtttaactggcacttgtgtataatatagtaattcccctctttctagaattcaagcctcaataaacccctaactaatcttatgtatttatttccactggtttataggtaagcaaaaataagaata

SEQ ID NO: 38711 - DNA, 793 bp, Homo sapiens
tatccaggtgttcaaatatacacagtgtgtatgcagggctcccaagagttccctggtttccccgatatcctcagacacaaagaccatgactctgctgttgtgggttgcacaggagtagggggcagatgatggacactgggatgggaatggttgtgaatgatctgcccccgcttccatatgtgagtgtaggcaagatacttcctctctctaggcctcagtttccctttttataaaacaatgcctaagactatgtcaagttctaagactctgtactctgggctggggctacaggtaatcgagacacttactttcacctgcttcagactctgaagaggctagatcggagggatgaggccactgcactctggtggaggctggaggcccaaactaaggggtcacatgaagatgctctgtggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatattta

SEQ ID NO: 38712 - DNA, 2934 bp, Homo sapiens
tttgcatatggatattcaattctcctagctccatttaatttgaaatgattgggcaggtacttttgagcagtgcaagtacagagcggcactgccagcagactacacgcggtagaaagccgaccttggtgagcgtgttggtgctcgacagtgagcagagaaaggatggacgattacggagcgccctcgtctccagttaccgctttctggaaacaccatccgccggggcggagctgttccgccccggtgcggtactacgactcccagcatgcacctcgcagtcggccctcggtggaagcgggaacccaggaggacctgggggtgtggcagcgaggaagggccgagccacggactgtggggccgaaactcgctcccgcccaccctttctcgaggctgtggcctccgcgagagccgagcgggccgcaccgccggccgtgcgactgccccagtcagacacgaccccggcttctagcccgcctaagcctgtttggggttgctgactcgtttcctccccgagtttcccgcgggaactaactcttcaagaggaccaaccgcagcccagagcttcgcagacccggccaaccagaggcgaggttgagagcccggcgggccgcggggagagagcgtcccatctgtcctggaaagcctgggcgggtggattgggaccccgagagaagcaggggagctcggcggggtgcagaagtgcccaggcccctccccgctggggttgggagcttgggcaggccagcttcacccttcctaagtccgcttctggtctccgggcccagcctcggccaccatgtcccgccagaccacctctgtgggctccagctgcctggacctgtggagggaaaagaatgaccggctcgttcgacaggccaaggtggctcagaactccggtctgactctgaggcgacagcagttggctcaggatgcactggaagggctcagagggctcctccatagtctgcaagggctccctgcagctgttcctgttcttcccttggagctgactgtcacctgcaacttcattatcctgagggcaagcttggcccagggtttcacagaggatcaggcccaggatatccagcggagcctagagagagtgctggagacacaggagcagcaggggcccaggttggaacaggggctcagggagctgtgggactctgtccttcgtgcttcctgccttctgccggagctgctgtctgccctgcaccgcctggttggcctgcaggctgccctctggttgagtgctgaccgtcttggggacctggccttgttactagagaccctgaatggcagccagagtggagcctctaaggatctgctgttacttctgaaaacttggagtcccccagctgaggaattagatgctccattgaccctgcaggatgcccagggattgaaggatgtcctcctgacagcatttgcctaccgccaaggtctccaggagctgatcacagggaacccagacaaggcactaagcagccttcatgaagcggcctcaggcctgtgtccacggcctgtgttggtccaggtgtacacagcactggggtcctgtcaccgtaagatgggaaatccacagagagcactgttgtacttggttgcagccctgaaagagggatcagcctggggtcctccacttctggaggcctctaggctctatcagcaactgggggacacaacagcagagctggagagtctggagctgctagttgaggccttgaatgtcccatgcagttccaaagccccgcagtttctcattgaggtagaattactactgccaccacctgacctagcctcaccccttcattgtggcactcagagccagaccaagcacatactagcaagcaggtgcctacagacggggagggcaggagacgctgcagagcattacttggacctgctggccctgttgctggatagctcggagccaaggttctccccacccccctcccctccagggccctgtatgcctgaggtgtttttggaggcagcggtagcactgatccaggcaggcagagcccaagatgccttgactctatgtgaggagttgctcagccgcacatcatctctgctacccaagatgtcccggctgtgggaagatgccagaaaaggaaccaaggaactgccatactgcccactctgggtctctgccacccacctgcttcagggccaggcctgggttcaactgggtgcccaaaaagtggcaattagtgaatttagcaggtgcctcgagctgctcttccgggccacacctgaggaaaaagaacaaggggcagctttcaactgtgagcagggatgtaagtcagatgcggcactgcagcagcttcgggcagccgccctaattagtcgtggactggaatgggtagccagcggccaggataccaaagccttacaggacttcctcctcagtgtgcagatgtgcccaggtaatcgagacacttactttcacctgcttcagactctgaagaggctagatcggagggatgaggccactgcactctggtggaggctggaggcccaaactaaggggtcacatgaagatgctctgtggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatattta

SEQ ID NO: 38713 - DNA, 935 bp, Homo sapiens
  misc_feature (16)..(16): n is a, c, g, or t
gcgggtggcggccaancttaggctaaggtacgaggctgggtggtgtgtgaggagttgctcagccgcacatcatctctgctacccaagatgtcccggctgtgggaagatgccagaaaaggaaccaaggaactgccatactgcccactctgggtctctgccacccacctgcttcagggccaggcctgggttcaactgggtgcccaaaaagtggcaattagtgaatttagcaggtgcctcgagctgctcttccgggccacacctgaggaaaaagaacaaggggcagctttcaactgtgagcagggatgtaagtcagatgcggcactgcagcagcttcgggcagccgccctaattagtcgtggactggaatgggtagccagcggccaggataccaaagccttacaggacttcctcctcagtgtgcagatgtgcccaggtaatcgagacacttactttcacctgcttcagactctgaagaggctagatcggagggatgaggccactgcactctggtggaggctggaggcccaaactaaggggtcacatgaagatgctctgtggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatattta

SEQ ID NO: 38714 - DNA, 2387 bp, Homo sapiens
ttacaactattgttctcatatttctcacactaaataaatctctatgagaaaaaaaaaaaaaaaaaaaaaaaaaaaaaaaaaaatgtcctggaaagcctgggcgggtggattgggaccccgagagaagcaggggagctcggcggggtgcagaagtgcccaggcccctccccgctggggttgggagcttgggcaggccagcttcacccttcctaagtccgcttctggtctccgggcccagcctcggccaccatgtcccgccagaccacctctgtgggctccagctgcctggacctgtggagggaaaagaatgaccggctcgttcgacaggccaaggtggctcagaactccggtctgactctgaggcgacagcagttggctcaggatgcactggaagggctcagagggctcctccatagtctgcaagggctccctgcagctgttcctgttcttcccttggagctgactgtcacctgcaacttcattatcctgagggcaagcttggcccagggtttcacagaggatcaggcccaggatatccagcggagcctagagagagtgctggagacacaggagcagcaggggcccaggttggaacaggggctcagggagctgtgggactctgtccttcgtgcttcctgccttctgccggagctgctgtctgccctgcaccgcctggttggcctgcaggctgccctctggttgagtgctgaccgtcttggggacctggccttgttactagagaccctgaatggcagccagagtggagcctctaaggatctgctgttacttctgaaaacttggagtcccccagctgaggaattagatgctccattgaccctgcaggatgcccagggattgaaggatgtcctcctgacagcatttgcctaccgccaaggtctccaggagctgatcacagggaacccagacaaggcactaagcagccttcatgaagcggcctcaggcctgtgtccacggcctgtgttggtccaggtgtacacagcactggggtcctgtcaccgtaagatgggaaatccacagagagcactgttgtacttggttgcagccctgaaagagggatcagcctggggtcctccacttctggaggcctctaggctctatcagcaactgggggacacaacagcagagctggagagtctggagctgctagttgaggccttgaatgtcccatgcagttccaaagccccgcagtttctcattgaggtagaattactactgccaccacctgacctagcctcaccccttcattgtggcactcagagccagaccaagcacatactagcaagcaggtgcctacagacggggagggcaggagacgctgcagagcattacttggacctgctggccctgttgctggatagctcggagccaaggttctccccacccccctcccctccagggccctgtatgcctgaggtgtttttggaggcagcggtagcactgatccaggcaggcagagcccaagatgccttgactctatgtgaggagttgctcagccgcacatcatctctgctacccaagatgtcccggctgtgggaagatgccagaaaaggaaccaaggaactgccatactgcccactctgggtctctgccacccacctgcttcagggccaggcctgggttcaactgggtgcccaaaaagtggcaattagtgaatttagcaggtgcctcgagctgctcttccgggccacacctgaggaaaaagaacaaggggcagctttcaactgtgagcagggatgtaagtcagatgcggcactgcagcagcttcgggcagccgccctaattagtcgtggactggaatgggtagccagcggccaggataccaaagccttacaggacttcctcctcagtgtgcagatgtgcccaggtaatcgagacacttactttcacctgcttcagactctgaagaggctagatcggagggatgaggccactgcactctggtggaggctggaggcccaaactaaggggtcacatgaagatgctctgtggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatattta

SEQ ID NO: 38715 - DNA, 3088 bp, Homo sapiens
tttgcatatggatattcaattctcctagctccatttaatttgaaatgattgggcaggtacttttgagcagtgcaagtacagagcggcactgccagcagactacacgcggtagaaagccgaccttggtgagcgtgttggtgctcgacagtgagcagagaaaggatggacgattacggagcgccctcgtctccagttaccgctttctggaaacaccatccgccggggcggagctgttccgccccggtgcggtactacgactcccagcatgcacctcgcagtcggccctcggtggaagcgggaacccaggaggacctgggggtgtggcagcgaggaagggccgagccacggactgtggggccgaaactcgctcccgcccaccctttctcgaggctgtggcctccgcgagagccgagcgggccgcaccgccggccgtgcgactgccccagtcagacacgaccccggcttctagcccgcctaagcctgtttggggttgctgactcgtttcctccccgagtttcccgcgggaactaactcttcaagaggaccaaccgcagcccagagcttcgcagacccggccaaccagaggcgaggttgagagcccggcgggccgcggggagagagcgtcccatctgtcctggaaagcctgggcgggtggattgggaccccgagagaagcaggggagctcggcggggtgcagaagtgcccaggcccctccccgctggggttgggagcttgggcaggccagcttcacccttcctaagtccgcttctggtctccgggcccagcctcggccaccatgtcccgccagaccacctctgtgggctccagctgcctggacctgtggagggaaaagaatgaccggctcgttcgacaggccaaggtggctcagaactccggtctgactctgaggcgacagcagttggctcaggatgcactggaagggctcagagggctcctccatagtctgcaagggctccctgcagctgttcctgttcttcccttggagctgactgtcacctgcaacttcattatcctgagggcaagcttggcccagggtttcacagaggatcaggcccaggatatccagcggagcctagagagagtgctggagacacaggagcagcaggggcccaggttggaacaggggctcagggagctgtgggactctgtccttcgtgcttcctgccttctgccggagctgctgtctgccctgcaccgcctggttggcctgcaggctgccctctggttgagtgctgaccgtcttggggacctggccttgttactagagaccctgaatggcagccagagtggagcctctaaggatctgctgttacttctgaaaacttggagtcccccagctgaggaattagatgctccattgaccctgcaggatgcccagggattgaaggatgtcctcctgacagcatttgcctaccgccaaggtctccaggagctgatcacagggaacccagacaaggcactaagcagccttcatgaagcggcctcaggcctgtgtccacggcctgtgttggtccaggtgtacacagcactggggtcctgtcaccgtaagatgggaaatccacagagagcactgttgtacttggttgcagccctgaaagagggatcagcctggggtcctccacttctggaggcctctaggctctatcagcaactgggggacacaacagcagagctggagagtctggagctgctagttgaggccttgaatgtcccatgcagttccaaagccccgcagtttctcattgaggtagaattactactgccaccacctgacctagcctcaccccttcattgtggcactcagagccagaccaagcacatactagcaagcaggtgcctacagacggggagggcaggagacgctgcagagcattacttggacctgctggccctgttgctggatagctcggagccaaggttctccccacccccctcccctccagggccctgtatgcctgaggtgtttttggaggcagcggtagcactgatccaggcaggcagagcccaagatgccttgactctatgtgaggagttgctcagccgcacatcatctctgctacccaagatgtcccggctgtgggaagatgccagaaaaggaaccaaggaactgccatactgcccactctgggtctctgccacccacctgcttcagggccaggcctgggttcaactgggtgcccaaaaagtggcaattagtgaatttagcaggtgcctcgagctgctcttccgggccacacctgaggaaaaagaacaaggggcagctttcaactgtgagcagggatgtaagtcagatgcggcactgcagcagcttcgggcagccgccctaattagtcgtggactggaatgggtagccagcggccaggataccaaagccttacaggacttcctcctcagtgtgcagatgtgcccaggtaatcgagacacttactttcacctgcttcagactctgaagaggctagatcggagggatgaggccactgcactctggtggaggctggaggcccaaactaaggggtcacatgaagatgctctgtggtgaggctcaggcctgctggcttggggctgaggggcagttggtgtcctagagtccttggacctattgtgggtggtgaacactgaaagcgggggtatggctgcccagctttctgccaatctttcacccttaggcatcatccttctttctctccaggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatattta

SEQ ID NO: 38716 - DNA, 3133 bp, Homo sapiens
tttgcatatggatattcaattctcctagctccatttaatttgaaatgattgggcaggtacttttgagcagtgcaagtacagagcggcactgccagcagactacacgcggtagaaagccgaccttggtgagcgtgttggtgctcgacagtgagcagagaaaggatggacgattacggagcgccctcgtctccagttaccgctttctggaaacaccatccgccggggcggagctgttccgccccggtgcggtactacgactcccagcatgcacctcgcagtcggccctcggtggaagcgggaacccaggaggacctgggggtgtggcagcgaggaagggccgagccacggactgtggggccgaaactcgctcccgcccaccctttctcgaggctgtggcctccgcgagagccgagcgggccgcaccgccggccgtgcgactgccccagtcagacacgaccccggcttctagcccgcctaagcctgtttggggttgctgactcgtttcctccccgagtttcccgcgggaactaactcttcaagaggaccaaccgcagcccagagcttcgcagacccggccaaccagaggcgaggttgagagcccggcgggccgcggggagagagcgtcccatctgtcctggaaagcctgggcgggtggattgggaccccgagagaagcaggggagctcggcggggtgcagaagtgcccaggcccctccccgctggggttgggagcttgggcaggccagcttcacccttcctaagtccgcttctggtctccgggcccagcctcggccaccatgtcccgccagaccacctctgtgggctccagctgcctggacctgtggagggaaaagaatgaccggctcgttcgacaggccaaggtaacacggttgctggcaccctcggtttgcagcctcaagatccctgaaagcgggtttgcagtggatttaccccaacagatggggagggactgagcttgaccaaagagccagaaatgactggagaatgcatcccttgccactgctgcaaggggagaaaaaaggattgatcctcagtgacaacccctccctcatgtggcaggtggctcagaactccggtctgactctgaggcgacagcagttggctcaggatgcactggaagggctcagagggctcctccatagtctgcaagggctccctgcagctgttcctgttcttcccttggagctgactgtcacctgcaacttcattatcctgagggcaagcttggcccagggtttcacagaggatcaggcccaggatatccagcggagcctagagagagtgctggagacacaggagcagcaggggcccaggttggaacaggggctcagggagctgtgggactctgtccttcgtgcttcctgccttctgccggagctgctgtctgccctgcaccgcctggttggcctgcaggctgccctctggttgagtgctgaccgtcttggggacctggccttgttactagagaccctgaatggcagccagagtggagcctctaaggatctgctgttacttctgaaaacttggagtcccccagctgaggaattagatgctccattgaccctgcaggatgcccagggattgaaggatgtcctcctgacagcatttgcctaccgccaaggtctccaggagctgatcacagggaacccagacaaggcactaagcagccttcatgaagcggcctcaggcctgtgtccacggcctgtgttggtccaggtgtacacagcactggggtcctgtcaccgtaagatgggaaatccacagagagcactgttgtacttggttgcagccctgaaagagggatcagcctggggtcctccacttctggaggcctctaggctctatcagcaactgggggacacaacagcagagctggagagtctggagctgctagttgaggccttgaatgtcccatgcagttccaaagccccgcagtttctcattgaggtagaattactactgccaccacctgacctagcctcaccccttcattgtggcactcagagccagaccaagcacatactagcaagcaggtgcctacagacggggagggcaggagacgctgcagagcattacttggacctgctggccctgttgctggatagctcggagccaaggttctccccacccccctcccctccagggccctgtatgcctgaggtgtttttggaggcagcggtagcactgatccaggcaggcagagcccaagatgccttgactctatgtgaggagttgctcagccgcacatcatctctgctacccaagatgtcccggctgtgggaagatgccagaaaaggaaccaaggaactgccatactgcccactctgggtctctgccacccacctgcttcagggccaggcctgggttcaactgggtgcccaaaaagtggcaattagtgaatttagcaggtgcctcgagctgctcttccgggccacacctgaggaaaaagaacaaggggcagctttcaactgtgagcagggatgtaagtcagatgcggcactgcagcagcttcgggcagccgccctaattagtcgtggactggaatgggtagccagcggccaggataccaaagccttacaggacttcctcctcagtgtgcagatgtgcccaggtaatcgagacacttactttcacctgcttcagactctgaagaggctagatcggagggatgaggccactgcactctggtggaggctggaggcccaaactaaggggtcacatgaagatgctctgtggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatattta

SEQ ID NO: 38717 - DNA, 1719 bp, Homo sapiens
cttgagctcaaggtctagccaggatagatggagataggagaagacggggaggttgtaggcttggagcttctggttgtccttctttccccagagtggagcctctaaggatctgctgttacttctgaaaacttggagtcccccagctgaggaattagatgctccattgaccctgcaggatgcccagggattgaaggatgtcctcctgacagcatttgcctaccgccaaggtctccaggagctgatcacagggaacccagacaaggcactaagcagccttcatgaagcggcctcaggcctgtgtccacggcctgtgttggtccaggtgtacacagcactggggtcctgtcaccgtaagatgggaaatccacagagagcactgttgtacttggttgcagccctgaaagagggatcagcctggggtcctccacttctggaggcctctaggctctatcagcaactgggggacacaacagcagagctggagagtctggagctgctagttgaggccttgaatgtcccatgcagttccaaagccccgcagtttctcattgaggtagaattactactgccaccacctgacctagcctcaccccttcattgtggcactcagagccagaccaagcacatactagcaagcaggtgcctacagacggggagggcaggagacgctgcagagcattacttggacctgctggccctgttgctggatagctcggagccaaggttctccccacccccctcccctccagggccctgtatgcctgaggtgtttttggaggcagcggtagcactgatccaggcaggcagagcccaagatgccttgactctatgtgaggagttgctcagccgcacatcatctctgctacccaagatgtcccggctgtgggaagatgccagaaaaggaaccaaggaactgccatactgcccactctgggtctctgccacccacctgcttcagggccaggcctgggttcaactgggtgcccaaaaagtggcaattagtgaatttagcaggtgcctcgagctgctcttccgggccacacctgaggaaaaagaacaaggggcagctttcaactgtgagcagggatgtaagtcagatgcggcactgcagcagcttcgggcagccgccctaattagtcgtggactggaatgggtagccagcggccaggataccaaagccttacaggacttcctcctcagtgtgcagatgtgcccaggtaatcgagacacttactttcacctgcttcagactctgaagaggctagatcggagggatgaggccactgcactctggtggaggctggaggcccaaactaaggggtcacatgaagatgctctgtggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatattta

SEQ ID NO: 38718 - DNA, 872 bp, Homo sapiens
gggtcgttctgggtaggatgggtgggggttgtattgatgagattagtagtatggaagtggtagtggtggaagtgggttccctttaatgtgtcccagcccaccaggagacttaagagaaagggactgtggacacaagaagaaatagaggaggatttggggttttggtgactgtgaggctgggaagacacttcttgactttgggagtggtccccaggggcagctttcaactgtgagcagggatgtaagtcagatgcggcactgcagcagcttcgggcagccgccctaattagtcgtggactggaatgggtagccagcggccaggataccaaagccttacaggacttcctcctcagtgtgcagatgtgcccaggtaatcgagacacttactttcacctgcttcagactctgaagaggctagatcggagggatgaggccactgcactctggtggaggctggaggcccaaactaaggggtcacatgaagatgctctgtggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatattta

SEQ ID NO: 38719 - DNA, 947 bp, Homo sapiens
tatccaggtgttcaaatatacacagtgtgtatgcagggctcccaagagttccctggtttccccgatatcctcagacacaaagaccatgactctgctgttgtgggttgcacaggagtagggggcagatgatggacactgggatgggaatggttgtgaatgatctgcccccgcttccatatgtgagtgtaggcaagatacttcctctctctaggcctcagtttccctttttataaaacaatgcctaagactatgtcaagttctaagactctgtactctgggctggggctacaggtaatcgagacacttactttcacctgcttcagactctgaagaggctagatcggagggatgaggccactgcactctggtggaggctggaggcccaaactaaggggtcacatgaagatgctctgtggtgaggctcaggcctgctggcttggggctgaggggcagttggtgtcctagagtccttggacctattgtgggtggtgaacactgaaagcgggggtatggctgcccagctttctgccaatctttcacccttaggcatcatccttctttctctccaggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatattta

SEQ ID NO: 38720 - DNA, 1256 bp, Homo sapiens
ggcccccgggtgtcgaatcggccgagggactctgaggcgacagcagttggctcaggatgcactggaagggctcagagggctcctccatagtctgcaagggctccctgcagctgttcctgttcttcccttggagctgactgtcacagcaagcaggtgcctacagacggggagggcaggagacgctgcagagcattacttggacctgctggccctgttgctggatagctcggagccaaggttctccccacccccctcccctccagggccctgtatgcctgaggtgtttttggaggcagcggtagcactgatccaggcaggcagagcccaagatgccttgactctatgtgaggagttgctcagccgcacatcatctctgctacccaagatgtcccggctgtgggaagatgccagaaaaggaaccaaggaactgccatactgcccactctgggtctctgccacccacctgcttcagggccaggcctgggttcaactgggtgcccaaaaagtggcaattagtgaatttagcaggtgcctcgagctgctcttccgggccacacctgaggaaaaagaacaaggggcagctttcaactgtgagcagggatgtaagtcagatgcggcactgcagcagcttcgggcagccgccctaattagtcgtggactggaatgggtagccagcggccaggataccaaagccttacaggacttcctcctcagtgtgcagatgtgcccaggtaatcgagacacttactttcacctgcttcagactctgaagaggctagatcggagggatgaggccactgcactctggtggaggctggaggcccaaactaaggggtcacatgaagatgctctgtggcatcatccttctttctctccaggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatattta

SEQ ID NO: 38721 - DNA, 247 bp, Homo sapiens
ggaggttgtaggcttggagcttctggttgtccttctttccccagagtggagcctctaaggatctgctgttacttctgaaaacttggagtcccccagctgaggaattagatgctccattgaccctgcaggatgcccagggattgaaggatgtcctcctgacagcatttgcctaccgccaaggtcagctagcaacctgactcatctcttctacctttaagtggtcctccagactcatgccctctctctt

SEQ ID NO: 38722 - DNA, 1225 bp, Homo sapiens
tttgcatatggatattcaattctcctagctccatttaatttgaaatgattgggcaggtacttttgagcagtgcaagtacagagcggcactgccagcagactacacgcggtagaaagccgaccttggtgagcgtgttggtgctcgacagtgagcagagaaaggatggacgattacggagcgccctcgtctccagttaccgctttctggaaacaccatccgccggggcggagctgttccgccccggtgcggtactacgactcccagcatgcacctcgcagtcggccctcggtggaagcgggaacccaggaggacctgggggtgtggcagcgaggaagggccgagccacggactgtggggccgaaactcgctcccgcccaccctttctcgaggctgtggcctccgcgagagccgagcgggccgcaccgccggccgtgcgactgccccagtcagacacgaccccggcttctagcccgcctaagcctgtttggggttgctgactcgtttcctccccgagtttcccgcgggaactaactcttcaagaggaccaaccgcagcccagagcttcgcagacccggccaaccagaggcgaggttgagagcccggcgggccgcggggagagagcgtcccatctgtcctggaaagcctgggcgggtggattgggaccccgagagaagcaggggagctcggcggggtgcagaagtgcccaggcccctccccgctggggttgggagcttgggcaggccagcttcacccttcctaagtccgcttctggtctccgggcccagcctcggccaccatgtcccgccagaccacctctgtgggctccagctgcctggacctgtggagggaaaagaatgaccggctcgttcgacaggccaaggtggctcagaactccggtctgactctgaggcgacagcagttggctcaggatgcactggaagggctcagagggctcctccatagtctgcaagggctccctgcagctgttcctgttcttcccttggagctgactgtcacctgcaacttcattatcctgagggcaagcttggcccagggtttcacagaggatcaggcccaggatatccagcggagcctagagagaggtgagggccagagattgtccctgattcccctgccatcttcagtctgggtttaagttattgcagggagatgggaggataaacaacatctgtcacctccatggagagaggtgcccttctctgtg

SEQ ID NO: 38723 - DNA, 2907 bp, Homo sapiens
tttgcatatggatattcaattctcctagctccatttaatttgaaatgattgggcaggtacttttgagcagtgcaagtacagagcggcactgccagcagactacacgcggtagaaagccgaccttggtgagcgtgttggtgctcgacagtgagcagagaaaggatggacgattacggagcgccctcgtctccagttaccgctttctggaaacaccatccgccggggcggagctgttccgccccggtgcggtactacgactcccagcatgcacctcgcagtcggccctcggtggaagcgggaacccaggaggacctgggggtgtggcagcgaggaagggccgagccacggactgtggggccgaaactcgctcccgcccaccctttctcgaggctgtggcctccgcgagagccgagcgggccgcaccgccggccgtgcgactgccccagtcagacacgaccccggcttctagcccgcctaagcctgtttggggttgctgactcgtttcctccccgagtttcccgcgggaactaactcttcaagaggaccaaccgcagcccagagcttcgcagacccggccaaccagaggcgaggttgagagcccggcgggccgcggggagagagcgtcccatctgtcctggaaagcctgggcgggtggattgggaccccgagagaagcaggggagctcggcggggtgcagaagtgcccaggcccctccccgctggggttgggagcttgggcaggccagcttcacccttcctaagtccgcttctggtctccgggcccagcctcggccaccatgtcccgccagaccacctctgtgggctccagctgcctggacctgtggagggaaaagaatgaccggctcgttcgacaggccaaggtggctcagaactccggtctgactctgaggcgacagcagttggctcaggatgcactggaagggctcagagggctcctccatagtctgcaagggctccctgcagctgttcctgttcttcccttggagctgactgtcacctgcaacttcattatcctgagggcaagcttggcccagggtttcacagaggatcaggcccaggatatccagcggagcctagagagagtgctggagacacaggagcagcaggggcccaggttggaacaggggctcagggagctgtgggactctgtccttcgtgcttcctgccttctgccggagctgctgtctgccctgcaccgcctggttggcctgcaggctgccctctggttgagtgctgaccgtcttggggacctggccttgttactagagaccctgaatggcagccagagtggagcctctaaggatctgctgttacttctgaaaacttggagtcccccagctgaggaattagatgctccattgaccctgcaggatgcccagggattgaaggatgtcctcctgacagcatttgcctaccgccaaggtctccaggagctgatcacagggaacccagacaaggcactaagcagccttcatgaagcggcctcaggcctgtgtccacggcctgtgttggtccaggtgtacacagcactggggtcctgtcaccgtaagatgggaaatccacagagagcactgttgtacttggttgcagccctgaaagagggatcagcctggggtcctccacttctggaggcctctaggctctatcagcaactgggggacacaacagcagagctggagagtctggagctgctagttgaggccttgaatgtcccatgcagttccaaagccccgcagtttctcattgaggtagaattactactgccaccacctgacctagcctcaccccttcattgtggcactcagagccagaccaagcacatactggcaggagacgctgcagagcattacttggacctgctggccctgttgctggatagctcggagccaaggttctccccacccccctcccctccagggccctgtatgcctgaggtgtttttggaggcagcggtagcactgatccaggcaggcagagcccaagatgccttgactctatgtgaggagttgctcagccgcacatcatctctgctacccaagatgtcccggctgtgggaagatgccagaaaaggaaccaaggaactgccatactgcccactctgggtctctgccacccacctgcttcagggccaggcctgggttcaactgggtgcccaaaaagtggcaattagtgaatttagcaggtgcctcgagctgctcttccgggccacacctgaggaaaaagaacaaggggcagctttcaactgtgagcagggatgtaagtcagatgcggcactgcagcagcttcgggcagccgccctaattagtcgtggactggaatgggtagccagcggccaggataccaaagccttacaggacttcctcctcagtgtgcagatgtgcccaggtaatcgagacacttactttcacctgcttcagactctgaagaggctagatcggagggatgaggccactgcactctggtggaggctggaggcccaaactaaggggtcacatgaagatgctctgtggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatattta

SEQ ID NO: 38724 - DNA, 2739 bp, Homo sapiens
tttgcatatggatattcaattctcctagctccatttaatttgaaatgattgggcaggtacttttgagcagtgcaagtacagagcggcactgccagcagactacacgcggtagaaagccgaccttggtgagcgtgttggtgctcgacagtgagcagagaaaggatggacgattacggagcgccctcgtctccagttaccgctttctggaaacaccatccgccggggcggagctgttccgccccggtgcggtactacgactcccagcatgcacctcgcagtcggccctcggtggaagcgggaacccaggaggacctgggggtgtggcagcgaggaagggccgagccacggactgtggggccgaaactcgctcccgcccaccctttctcgaggctgtggcctccgcgagagccgagcgggccgcaccgccggccgtgcgactgccccagtcagacacgaccccggcttctagcccgcctaagcctgtttggggttgctgactcgtttcctccccgagtttcccgcgggaactaactcttcaagaggaccaaccgcagcccagagcttcgcagacccggccaaccagaggcgagcctcggccaccatgtcccgccagaccacctctgtgggctccagctgcctggacctgtggagggaaaagaatgaccggctcgttcgacaggccaaggtggctcagaactccggtctgactctgaggcgacagcagttggctcaggatgcactggaagggctcagagggctcctccatagtctgcaagggctccctgcagctgttcctgttcttcccttggagctgactgtcacctgcaacttcattatcctgagggcaagcttggcccagggtttcacagaggatcaggcccaggatatccagcggagcctagagagagtgctggagacacaggagcagcaggggcccaggttggaacaggggctcagggagctgtgggactctgtccttcgtgcttcctgccttctgccggagctgctgtctgccctgcaccgcctggttggcctgcaggctgccctctggttgagtgctgaccgtcttggggacctggccttgttactagagaccctgaatggcagccagagtggagcctctaaggatctgctgttacttctgaaaacttggagtcccccagctgaggaattagatgctccattgaccctgcaggatgcccagggattgaaggatgtcctcctgacagcatttgcctaccgccaaggtctccaggagctgatcacagggaacccagacaaggcactaagcagccttcatgaagcggcctcaggcctgtgtccacggcctgtgttggtccaggtgtacacagcactggggtcctgtcaccgtaagatgggaaatccacagagagcactgttgtacttggttgcagccctgaaagagggatcagcctggggtcctccacttctggaggcctctaggctctatcagcaactgggggacacaacagcagagctggagagtctggagctgctagttgaggccttgaatgtcccatgcagttccaaagccccgcagtttctcattgaggtagaattactactgccaccacctgacctagcctcaccccttcattgtggcactcagagccagaccaagcacatactagcaagcaggtgcctacagacggggagggcaggagacgctgcagagcattacttggacctgctggccctgttgctggatagctcggagccaaggttctccccacccccctcccctccagggccctgtatgcctgaggtgtttttggaggcagcggtagcactgatccaggcaggcagagcccaagatgccttgactctatgtgaggagttgctcagccgcacatcatctctgctacccaagatgtcccggctgtgggaagatgccagaaaaggaaccaaggaactgccatactgcccactctgggtctctgccacccacctgcttcagggccaggcctgggttcaactgggtgcccaaaaagtggcaattagtgaatttagcaggtgcctcgagctgctcttccgggccacacctgaggaaaaagaacaaggggcagctttcaactgtgagcagggatgtaagtcagatgcggcactgcagcagcttcgggcagccgccctaattagtcgtggactggaatgggtagccagcggccaggataccaaagccttacaggacttcctcctcagtgtgcagatgtgcccaggtaatcgagacacttactttcacctgcttcagactctgaagaggctagatcggagggatgaggccactgcactctggtggaggctggaggcccaaactaaggggtcacatgaagatgctctgtggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatattta

SEQ ID NO: 38725 - DNA, 2957 bp, Homo sapiens
tttgcatatggatattcaattctcctagctccatttaatttgaaatgattgggcaggtacttttgagcagtgcaagtacagagcggcactgccagcagactacacgcggtagaaagccgaccttggtgagcgtgttggtgctcgacagtgagcagagaaaggatggacgattacggagcgccctcgtctccagttaccgctttctggaaacaccatccgccggggcggagctgttccgccccggtgcggtactacgactcccagcatgcacctcgcagtcggccctcggtggaagcgggaacccaggaggacctgggggtgtggcagcgaggaagggccgagccacggactgtggggccgaaactcgctcccgcccaccctttctcgaggctgtggcctccgcgagagccgagcgggccgcaccgccggccgtgcgactgccccagtcagacacgaccccggcttctagcccgcctaagcctgtttggggttgctgactcgtttcctccccgagtttcccgcgggaactaactcttcaagaggaccaaccgcagcccagagcttcgcagacccggccaaccagaggcgaggttgagagcccggcgggccgcggggagagagcgtcccatctgtcctggaaagcctgggcgggtggattgggaccccgagagaagcaggggagctcggcggggtgcagaagtgcccaggcccctccccgctggggttgggagcttgggcaggccagcttcacccttcctaagtccgcttctggtctccgggcccagcctcggccaccatgtcccgccagaccacctctgtgggctccagctgcctggacctgtggagggaaaagaatgaccggctcgttcgacaggccaaggtggctcagaactccggtctgactctgaggcgacagcagttggctcaggatgcactggaagggctcagagggctcctccatagtctgcaagggctccctgcagctgttcctgttcttcccttggagctgactgtcacctgcaacttcattatcctgagggcaagcttggcccagggtttcacagaggatcaggcccaggatatccagcggagcctagagagagtgctggagacacaggagcagcaggggcccaggttggaacaggggctcagggagctgtgggactctgtccttcgtgcttcctgccttctgccggagctgctgtctgccctgcaccgcctggttggcctgcaggctgccctctggttgagtgctgaccgtcttggggacctggccttgttactagagaccctgaatggcagccagagtggagcctctaaggatctgctgttacttctgaaaacttggagtcccccagctgaggaattagatgctccattgaccctgcaggatgcccagggattgaaggatgtcctcctgacagcatttgcctaccgccaaggtctccaggagctgatcacagggaacccagacaaggcactaagcagccttcatgaagcggcctcaggcctgtgtccacggcctgtgttggtccaggtgtacacagcactggggtcctgtcaccgtaagatgggaaatccacagagagcactgttgtacttggttgcagccctgaaagagggatcagcctggggtcctccacttctggaggcctctaggctctatcagcaactgggggacacaacagcagagctggagagtctggagctgctagttgaggccttgaatgtcccatgcagttccaaagccccgcagtttctcattgaggtagaattactactgccaccacctgacctagcctcaccccttcattgtggcactcagagccagaccaagcacatactagcaagcaggtgcctacagacggggagggcaggagacgctgcagagcattacttggacctgctggccctgttgctggatagctcggagccaaggttctccccacccccctcccctccagggccctgtatgcctgaggtgtttttggaggcagcggtagcactgatccaggcaggcagagcccaagatgccttgactctatgtgaggagttgctcagccgcacatcatctctgctacccaagatgtcccggctgtgggaagatgccagaaaaggaaccaaggaactgccatactgcccactctgggtctctgccacccacctgcttcagggccaggcctgggttcaactgggtgcccaaaaagtggcaattagtgaatttagcaggtgcctcgagctgctcttccgggccacacctgaggaaaaagaacaaggggcagctttcaactgtgagcagggatgtaagtcagatgcggcactgcagcagcttcgggcagccgccctaattagtcgtggactggaatgggtagccagcggccaggataccaaagccttacaggacttcctcctcagtgtgcagatgtgcccaggtaatcgagacacttactttcacctgcttcagactctgaagaggctagatcggagggatgaggccactgcactctggtggaggctggaggcccaaactaaggggtcacatgaagatgctctgtggcatcatccttctttctctccaggtctctccccctgtacctagaaagctatttgagctggatccgtccctctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatattta

SEQ ID NO: 38726 - DNA, 2798 bp, Homo sapiens
tttgcatatggatattcaattctcctagctccatttaatttgaaatgattgggcaggtacttttgagcagtgcaagtacagagcggcactgccagcagactacacgcggtagaaagccgaccttggtgagcgtgttggtgctcgacagtgagcagagaaaggatggacgattacggagcgccctcgtctccagttaccgctttctggaaacaccatccgccggggcggagctgttccgccccggtgcggtactacgactcccagcatgcacctcgcagtcggccctcggtggaagcgggaacccaggaggacctgggggtgtggcagcgaggaagggccgagccacggactgtggggccgaaactcgctcccgcccaccctttctcgaggctgtggcctccgcgagagccgagcgggccgcaccgccggccgtgcgactgccccagtcagacacgaccccggcttctagcccgcctaagcctgtttggggttgctgactcgtttcctccccgagtttcccgcgggaactaactcttcaagaggaccaaccgcagcccagagcttcgcagacccggccaaccagaggcgaggttgagagcccggcgggccgcggggagagagcgtcccatctgtcctggaaagcctgggcgggtggattgggaccccgagagaagcaggggagctcggcggggtgcagaagtgcccaggcccctccccgctggggttgggagcttgggcaggccagcttcacccttcctaagtccgcttctggtctccgggcccagcctcggccaccatgtcccgccagaccacctctgtgggctccagctgcctggacctgtggagggaaaagaatgaccggctcgttcgacaggccaaggtggctcagaactccggtctgactctgaggcgacagcagttggctcaggatgcactggaagggctcagagggctcctccatagtctgcaagggctccctgcagctgttcctgttcttcccttggagctgactgtcacctgcaacttcattatcctgagggcaagcttggcccagggtttcacagaggatcaggcccaggatatccagcggagcctagagagagtgctggagacacaggagcagcaggggcccaggttggaacaggggctcagggagctgtgggactctgtccttcgtgcttcctgccttctgccggagctgctgtctgccctgcaccgcctggttggcctgcaggctgccctctggttgagtgctgaccgtcttggggacctggccttgttactagagaccctgaatggcagccagagtggagcctctaaggatctgctgttacttctgaaaacttggagtcccccagctgaggaattagatgctccattgaccctgcaggatgcccagggattgaaggatgtcctcctgacagcatttgcctaccgccaaggtctccaggagctgatcacagggaacccagacaaggcactaagcagccttcatgaagcggcctcaggcctgtgtccacggcctgtgttggtccaggtgtacacagcactggggtcctgtcaccgtaagatgggaaatccacagagagcactgttgtacttggttgcagccctgaaagagggatcagcctggggtcctccacttctggaggcctctaggctctatcagcaactgggggacacaacagcagagctggagagtctggagctgctagttgaggccttgaatgtcccatgcagttccaaagccccgcagtttctcattgaggtagaattactactgccaccacctgacctagcctcaccccttcattgtggcactcagagccagaccaagcacatactagcaagcaggtgcctacagacggggagggcaggagacgctgcagagcattacttggacctgctggccctgttgctggatagctcggagccaaggttctccccacccccctcccctccagggccctgtatgcctgaggtgtttttggaggcagcggtagcactgatccaggcaggcagagcccaagatgccttgactctatgtgaggagttgctcagccgcacatcatctctgctacccaagatgtcccggctgtgggaagatgccagaaaaggaaccaaggaactgccatactgcccactctgggtctctgccacccacctgcttcagggccaggcctgggttcaactgggtgcccaaaaagtggcaattagtgaatttagcaggtgcctcgagctgctcttccgggccacacctgaggaaaaagaacaaggggcagctttcaactgtgagcagggatgtaagtcagatgcggcactgcagcagcttcgggcagccgccctaattagtcgtggactggaatgggtagccagcggccaggataccaaagccttacaggacttcctcctcagtgtgcagatgtgcccaggtaatcgagacacttactttcacctgcttcagactctgatcgtgacgccttccttgaagaatttcggacatctctgccaaagtcttgtgacctgtagctgccacgttttgaagagcttgagctgggtccccagtgggctgtctctctgtggggagggctttctgcttcaccatcattaggaatgtgaccattcctatataattcctggactggtgagattggtggtaggcctgtgaaatttgccctagttactaccattctcgttttggaggaaacaatctctgccaccaccaagtcattgactttgctcgaggcaccttttttcctgtttctccttttctgttgtcgagtaaaatttcatattta

SEQ ID NO: 38727 - DNA, 982 bp, Homo sapiens
taattagagacggggtcttgttttgttgcccaggctggtctcaaactcccgagctcaagtgatcctcctgccttggcctccaaaagtgctgggattacatgcatacctggcctactgagcatttttatcttgaatgagtgttggattttgtcaaatgctttttctgtacctattaatacaatcatgattttttcctctttagtatgttgatatgatgggttacattaattgattttcaaatgttgaatcagtcttgcatacctggaataaatcccacttggtcataatatatcattctttttacacattattgcatttgatttgctaatattttgttaaggatttttgcatctatgtttatgagagactgtagttttccctttcttgtcatgtctttatctgattttagtattagagtaatgctggtctcctagagtcagttagggtgtgttcccttagcttctatttttttggaagctattgtagagaattggtatgatttctttcttagaaaaaaaattttaaggaaatatttctgggtcaaagatttatttcttaaatgtttgatcaatcatcagtgaacccatctaagcctggtgctttctattatagaaggttattagttatgatttagtttaacaggtataggcctattcaaattttctatttctccttgtgtgagttatggaacactattcctttcaaagaactggcccattgcatgggtttgggccataatcccaaaagacacaatcttgaatgttataatcccaaatgatgaaatcctgaaagatcaaaatccctgaagtccaaaatccccaaaattccaatcccaaatgattaaaatcctggaaaatataattcttggacaaaataattttaaaaattctttaaaattctttatttatattttttaaggggatttgagaaacataaaaacacaacagagcacttcatagaccattttagacaataaaacagg

SEQ ID NO: 38728 - DNA, 820 bp, Homo sapiens
tgatcatccaattctagtcatggcatatatgaagtattccaaagcacccttccttccttgtgcttgtgcttcttgggcttttttctttttgtttcttttcttccatctcatatctggtctgagatggcatgattacacacattccaccttttttctacccctatttgtgtctcaaacctttataataagtgacttcttgtagtctgcagcttggctttttcaagttgggaagagctttgcttagcccattgctagactgctgccagctagatcttcaagatcaaattaaatgatatgtacagttggaatagtattctgtgagtacttatgaagaaagcagtcctggttcctcccgttagagatttttaaagtcaccagttatatagtgtaaattggccattttaaacttcagtaaacctgatccagttttattacccatatatccattttgagatgactttcaggtgttaaaagcttctttcaaagaaaggataacagggatatttgtgactttgaatgtaataatgaaccattataaacagtaggaactggaaccatttttaccttaataatctgaagctcaaaattgtactaaaaatgttttggaatgtcttaatttttacttctatatagccatcacatctctgtaattatcttttattgctactaaagtggttaaatctataaattattaatattaagggtttgaaattcttttggagagatttatctggatgttcgcctcagacaacaccatctaaaactaggcagtcaggtagattatttatgggattttactgttaaataattaagttccaga

SEQ ID NO: 38729 - DNA, 744 bp, Homo sapiens
tgatcatccaattctagtcatggcatatatgaagtattccaaagcacccttccttccttgtgcttgtgcttcttgggcttttttctttttgtttcttttcttccatctcatatctggtctgagatggcatgattacacacattccaccttttttctacccctatttgtgtctcaaacctttataataagtgacttcttgtagtctgcagcttggctttttcaagttgggaagagctttgcttagcccattgctagactgctgccagctagatcttcaagatcaaattaaatgatatgtacagttggaatagtattctgtgagtacttatgaagaaagcagtcctggttcctcccgttagagatttttaaagtcaccagttatatagtgtaaattggccattttaaacttcagtaaacctgatccagttttattacccatatatccattttgagatgactttcaggtgttaaaagcttctttcaaagaaaggataacagggatatttgtgactttgaatgtaataatgaaccattataaacagtaggaactggaaccatttttaccttaataatctgaagctcaaaattgtactaaaaatgttttggaatgtcttaatttttacttctatatagccatcacatctctgtaattatcttttattgctactaaagtggttaaatctataaattattaatattaaggtcgacgcggccgcgaatttagtagtagtagtaggcggccga

SEQ ID NO: 38730 - DNA, 446 bp, Homo sapiens
tgtatagggccctgcttgcagttctgtagactagcctgtgttgttagatcagggatggtctttagagagatgttccaagtggttttatgatactgagccgccttgtttggtgaccagggtagatgtgtgtggtagggagggaaagtggattttacaaaatcattacagttcagaaacgtctacctcagccaggagcaggaagccttaactcgttatttattatgccatggcacataggcataaaccagcccttctgtgaataagcaaacagaacctgcccaggtgcaagagaagcttgattcaggcttttttttttaaagccaaaaatttaaaaacagtatcgaattggagaagagtttgtttcaagcaagttactgtaattttcaaaagcccattttgtggaactaatacagtgtattaaaatgaattgaacaagcaaacttaaa

SEQ ID NO: 38731 - DNA, 347 bp, Homo sapiens
gatttgggggagcctgttaaatatgttagcggttcaaagcacttgatattatgaagtacaattacggattactataaactatttattttagccaaagtcatgaccaaaacattctaaaacaaggcaaaaaccttcactcattaagagggaggacttagcttccaaacaatctgtctttaatgttacatgaaaatcctgtgcaagaggagaaagccaaatttcacccttgcgttagtctactattaatgtcaaccccaacttttttaatgaaaccttagagataattctatcaaatcttacccagtttgatcatgaggtgagattcttgtaaaccttttataactctc

SEQ ID NO: 38732 - DNA, 823 bp, Homo sapiens
ctcaggccctcccctgagcgcaggccggtcagccccaggtcagtcccctccctgcattagggagactgcaggcagggccctgtggcctgcgggccactccttcctcagccctgggactggccagcccggtgcatggcgcttctggggagacactggctgggacctcacttgagcacagccgtgggcagcttgctggcctgcctaggaaaagccagccaagacaggcacagtcctttcctggcactggcctggggcacacagatctgtacctccatgacagggaaaagtagcctcaggttctgagtgtgccacggctgggctcctggggctggaaggccagctggagggtgtgggttccccaccagtgagggctgaagtcctgccgcccaccaggcccttgccgtggggggcccggctcccccacctcccgtggccagaccatcaccctctgccatctcatccaggccgcctcgaagcctgtgctggcccagcctctccactcaccctgccctgctcagctctgtctcctcctcagggccccaggtgtctcctcccatcctgggctgcctgggccccatcctgggatccacccacactcagccctggaagatgagggtcctggaaacctggggggcaggtgtggcggcgccaggactttaggccaggggccccgtgccacgtggtcctgtcgccttcacacctgctgtgcctccccctgagaagctgcaagtcctgcctttctgtttctgttgtagtgaaaccttccaccgtttccttctcggaccatgaagggcaaaaacaaaaaaacaaaaaaaatcacaaa

SEQ ID NO: 38733 - DNA, 752 bp, Homo sapiens
cagccgctccacccctccgaccctacagagaagcagcagcccaagcggctacacgtctccaacatccccttccggttcagggaccccgacttgcggcaaatgttcgggcaattcggaaaaattttagacgtggagatcatttttaacgagcggggctccaagggttttgggtttgtaacttttgaaactagctcagatgctgaccgagcccgggagaagctgaatgggacgatcgtagagggacggaaaattgaggtcaataatgccacggcccgagtgatgaccaacaagaagacggggaacccctacaccaacggctggaagctaaatccagtggtcggcgcagtctacgggcctgaattctatgcagtgacggggttcccctaccccaccaccggcacagccgttgcctaccggggcgcacatcttcggggccggggccgggccgtgtataatacatttcgggctgcgccacccccaccccccatcccgacttacggagcggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatgtgaaaccttccaccgtttccttctcggaccatgaagggcaaaaacaaaaaaacaaaaaaaatcacaaa

SEQ ID NO: 38734 - DNA, 1378 bp, Homo sapiens
cagccgctccacccctccgaccctacagagaagcagcagcccaagcggctacacgtctccaacatccccttccggttcagggaccccgacttgcggcaaatgttcgggcaattcggaaaaattttagacgtggagatcatttttaacgagcggggctccaagggttttgggtttgtaacttttgaaactagctcagatgctgaccgagcccgggagaagctgaatgggacgatcgtagagggacggaaaattgaggtcaataatgccacggcccgagtgatgaccaacaagaagacggggaacccctacaccaacggctggaagctaaatccagtggtcggcgcagtctacgggcctgaattctatgcagtgacggggttcccctaccccaccaccggcacagccgttgcctaccggggcgcacatcttcggggccggggccgggccgtgtataatacatttcgggctgcgccacccccaccccccatcccgacttacggagcggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatggctagcctctgccgaggagggtacagccgcttcaccccctactagcaagagacccagcccctaacagcattcacactgactgcctattacacaccaaacccaacagcccaaaaccaggcacagccaccagaagacagtgcacccctcccggtcagcgacacgcacggctggccccctgcaactctaaaatctatagattatttctctccagccagttggtctccccaccccacctgtgctggtgtgtgtgtctttgaccctggtttttcctgtatgtctgcaaccgtgatttcctattttgactttgttgatgttgtactacccaagccattgcaggtacggtgtgcacaccgtggggtccaggctgggccaggagaccaggcagcccccaacctgggagtagcggtagcgccctatgagggcaagagccacatttcctggcctcccaggctgcacagaacaacagaaacgcctggcagggcctcccccaaagccacccgaccagccccgtgccatggccctagtgtccagcaccctgacgcagggagggaggggctccaggcacccagtgtgggtctccccggcctgagggtgctcccgcaggccttcacccagccaaccacaggagtagccactgcccctcctcgccccattcagctgaaactaatatttttcattaaattttattgacgat

SEQ ID NO: 38735 - DNA, 801 bp, Homo sapiens
cagccgctccacccctccgaccctacagagaagcagcagcccaagcggctacacgtctccaacatccccttccggttcagggaccccgacttgcggcaaatgttcgggcaattcggaaaaattttagacgtggagatcatttttaacgagcggggctccaagggttttgggtttgtaacttttgaaactagctcagatgctgaccgagcccgggagaagctgaatgggacgatcgtagagggacggaaaattgaggtcaataatgccacggcccgagtgatgaccaacaagaagacggggaacccctacaccaacggctggaagctaaatccagtggtcggcgcagtctacgggcctgaattctatgcagtgacggggttcccctaccccaccaccggcacagccgttgcctaccggggcgcacatcttcggggccggggccgggccgtgtataatacatttcgggctgcgccacccccaccccccatcccgacttacggagcggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatgtgaaaccttccaccatcggcccgcggcgacctacagcattggaaccatgtgaaaccttccaccgtttccttctcggaccatgaagggcaaaaacaaaaaaacaaaaaaaatcacaaa

SEQ ID NO: 38736 - DNA, 528 bp, Homo sapiens
cacgaggatttttaacgagcggggctccaaggtcaataatgccacggcccgagtgatgaccaacaagaagacggggaacccctacaccaacggctggaagctaaatccagtggtcggcgcagtctacgggcctgaattctatgcagtgacggggttcccctaccccaccaccggcacagccgttgcctaccggggcgcacatcttcggggccggggccgggccgtgtataatacatttcgggctgcgccacccccaccccccatcccgacttacggagcggtcgtgtatcaggatggattttatggtgctgagatttatggaggctacgcagcctacagatacgctcagcccgctgcagcggcggcagcctacagcgacagttacggcagagtctacgcagctgccgacccgtaccatcacaccatcgggcccgcggcgacctacagcattggaaccatgtgaaaccttccaccgtttccttctcggaccatgaagggcaaaaacaaaaaaacaaaaaaaatcacaaa

SEQ ID NO: 38737 - DNA, 356 bp, Homo sapiens
ctgtgtgtgtgctgctggcctgggagacggcacccactgacctcctctggcctctcagtcacacttgggccagattaattcattctgcaaacttttcttgcctgcccatggaatgccaggtactgagctagggttcgcagacacatgctaagcagcagtaaaaagagcttattttgtataatactcagctactactgagctaaaactaggagagcatattagaaatgacagacttaggctgggcgcggtggctcatgcctgtaattccagcattttgggaggccgaggcgggcggatcacctgaggtcaggaattcaagaccagccttaccaacatggagaaaccccgtctccact

SEQ ID NO: 38738 - DNA, 782 bp, Homo sapiens
ggcgcctgaccgcggcagctcccaccatggcggagaccaagctccagctgtttgtcaaggcgagtgaggacggggagagcgtgggtcactgcccctcctgccagcggctcttcatggtcctgctcctcaagggcgtacctttcaccctcaccacggtggacacgcgcaggtccccggacgtgctgaaggacttcgcccccggctcgcagctgcccatcctgctctatgacagcgacgccaagacagacacgctgcagatcgaggactttctggaggagacgctggggccgcccgacttccccagcctggcgcctcgttacagggagtccaacaccgccggcaacgacgttttccacaagttctccgcgttcatcaagaacccggtgcccgcgcaggacgaagccctgtaccagcagctgctgcgcgccctcgccaggctggacagctacctgcgcgcgcccctggagcacgagctggcgggggagccgcagctgcgcgagtcccgccgccgcttcctggacggcgacaggctcacgctggccgactgcagcctcctgcccaagctgcacatcgtcgacacggtgtgcgcgcacttccgccaggcgcccatccccgcggagctgcgcggcgtacgccgctacctggacagcgcgatgcaggagaaagagttcaaatacacgtgtccgcacagcgccgagatcctggcggcctaccggcccgccgtgcacccccgctagcgccccaccccgcgtctgtcgcccaataaaggcatctttgtcggg

SEQ ID NO: 38739 - DNA, 898 bp, Homo sapiens
ggcgcctgaccgcggcagctcccaccatggcggagaccaagctccagctgtttgtcaaggcgagtgaggacggggagagcgtgggtcactgcccctcctgccagcggctcttcatggtcctgctcctcaagggcgtacctttcaccctcaccacggtggacacgcgcaggtccccggacgtgctgaaggacttcgcccccggctcgcagctgcccatcctgctctatgacagcgacgccaagacagacacgctgcagatcgaggactttctggaggagacgctggggccgcccgacttccccagcctggcgcctcgttacagggagtccaacaccgccggcaacgacgttttccacaagttctccgcgttcatcaagaacccggtgcccgcgcaggacgaagccctgtaccagcagctgctgcgcgccctcgccaggctggacagctacctgcgcgcgcccctggagcacgagctggcgggggagccgcagctgcgcgagtcccgccgccgcttcctggacggcgacaggctcacgctggccgactgcagcctcctgcccaagctgcacatcgtcgacacggtgtgcgcgcacttccgccaggcgcccatccccgcggagctgcgcggcgtacgccgctacctggacagcgcgatgcaggagaaagagttcaaatacacgtgtccgcacagcgccgagatcctggcggcctaccggcccgccgtgcacccccgctagcgccccaccccgcgtctgtcgcccaataaaggcatctttgtcggggaaaaacaaaaacataaaaaccaatccacaacaaacaggggggcgccataaaaaccccagagggcacaataagagacaccagttttttaacaaggggcccaagagggggacaaacc

SEQ ID NO: 38740 - DNA, 814 bp, Homo sapiens
ggcgcctgaccgcggcagctcccaccatggcggagaccaagctccagctgtttgtcaaggcgagtgaggacggggagagcgtgggtcactgcccctcctgccagcggctcttcatggtcctgctcctcaagggcgtacctttcaccctcaccacggtggacacgcgcaggtccccggacgtgctgaaggacttcgcccccggctcgcagctgcccatcctgctctatgacagcgacgccaagacagacacgctgcagatcgaggactttctggaggagacgctggggccgcccgacttccccagcctggcgcctcgttacagggagtccaacaccgccggcaacgacgttttccacaagttctccgcgttcatcaagaacccggtgcccgcgcaggacgaagccctgtaccagcagctgctgcgcgccctcgccaggctggacagctacctgcgcgcgcccctggagcacgagctggcgggggagccgcagctgcgcgagtcccgccgccgcttcctggacggcgacaggctcacgctggccgactgcagcctcctgcccaagctgcacatcgtcgacacggtgtgcgcgcacttccgccaggcgcccatccccgcggagctgcgcggcgtacgccgctacctggacagcgcgatgcaggagaaagagttcaaatacacgtgtccgcacagcgccgagatcctggcggcctaccggcccgccgtgcacccccgctagcgccccaccccgcgtctgtcgcccaataaaggcatctttgtcgggagtgagggtgtcctgacatctgaagggccaga

SEQ ID NO: 38741 - DNA, 854 bp, Homo sapiens
gctccagctgtttgtcaaggcgagtgaggacggggagagcgtgggtcactgcccctcctgccagcggctcttcatggtcctgctcctcaagggcgtacctttcaccctcaccacggtggacacgcgcaggtgaggccccatcctgtggacccccgcctggcctcgcacactggtgggccggcctcctcccaccccgctgctgcccgcaggtccccggacgtgctgaaggacttcgcccccggctcgcagctgcccatcctgctctatgacagcgacgccaagacagacacgctgcagatcgaggactttctggaggagacgctggggccgcccgacttccccagcctggcgcctcgttacagggagtccaacaccgccggcaacgacgttttccacaagttctccgcgttcatcaagaacccggtgcccgcgcaggacgaagccctgtaccagcagctgctgcgcgccctcgccaggctggacagctacctgcgcgcgcccctggagcacgagctggcgggggagccgcagctgcgcgagtcccgccgccgcttcctggacggcgacaggctcacgctggccgactgcagcctcctgcccaagctgcacatcgtcgacacggtgtgcgcgcacttccgccaggcgcccatccccgcggagctgcgcggcgtacgccgctacctggacagcgcgatgcaggagaaagagttcaaatacacgtgtccgcacagcgccgagatcctggcggcctaccggcccgccgtgcacccccgctagcgccccaccccgcgtctgtcgcccaataaaggcatctttgtcgggagtgagggtgtcctgacatctgaagggccaga

SEQ ID NO: 38742 - DNA, 963 bp, Homo sapiens
ggcgcctgaccgcggcagctcccaccatggcggagaccaagctccagctgtttgtcaaggtgcagggcggactcagctgcggggagggtgtctgggaggaagcgcttttctgggctttgctttctgtggcaggctgtggggtgggcctcccagtaatgtctgagccccttcctgtgggtggctagggggactcaggcagccctacagaggctgagtaaagtgggacccagcgagtcactgcccctcctgccagcggctcttcatggtcctgctcctcaagggcgtacctttcaccctcaccacggtggacacgcgcaggtccccggacgtgctgaaggacttcgcccccggctcgcagctgcccatcctgctctatgacagcgacgccaagacagacacgctgcagatcgaggactttctggaggagacgctggggccgcccgacttccccagcctggcgcctcgttacagggagtccaacaccgccggcaacgacgttttccacaagttctccgcgttcatcaagaacccggtgcccgcgcaggacgaagccctgtaccagcagctgctgcgcgccctcgccaggctggacagctacctgcgcgcgcccctggagcacgagctggcgggggagccgcagctgcgcgagtcccgccgccgcttcctggacggcgacaggctcacgctggccgactgcagcctcctgcccaagctgcacatcgtcgacacggtgtgcgcgcacttccgccaggcgcccatccccgcggagctgcgcggcgtacgccgctacctggacagcgcgatgcaggagaaagagttcaaatacacgtgtccgcacagcgccgagatcctggcggcctaccggcccgccgtgcacccccgctagcgccccaccccgcgtctgtcgcccaataaaggcatctttgtcgggagtgagggtgtcctgacatctgaagggccaga

SEQ ID NO: 38743 - DNA, 862 bp, Homo sapiens
ggcgcctgaccgcggcagctcccaccatggcggagaccaagctccagctgtttgtcaaggcgagtgaggacggggagagcgtgggtcactgcccctcctgccagcggctcttcatggtcctgctcctcaagggcgtacctttcaccctcaccacggtggacacgcgcaggtccccggacgtgctgaaggacttcgcccccggctcgcagctgcccatcctgctctatgacagcgacgccaagacagacacgctgcagatcgaggactttctggaggagacgctggggccgcccgacttccccagcctggcgcctcgttacagggagtccaacaccgccggcaacgacgttttccacaagttctccgcgttcatcaagaacccggtgcccgcgcaggacgaaggtgaagcggggtcagggggtcgggtgcccaggcgggagggcgccctgggcctggtcctcaccgcgccgcctgccccctagccctgtaccagcagctgctgcgcgccctcgccaggctggacagctacctgcgcgcgcccctggagcacgagctggcgggggagccgcagctgcgcgagtcccgccgccgcttcctggacggcgacaggctcacgctggccgactgcagcctcctgcccaagctgcacatcgtcgacacggtgtgcgcgcacttccgccaggcgcccatccccgcggagctgcgcggcgtacgccgctacctggacagcgcgatgcaggagaaagagttcaaatacacgtgtccgcacagcgccgagatcctggcggcctaccggcccgccgtgcacccccgctagcgccccaccccgcgtctgtcgcccaataaaggcatctttgtcggg

SEQ ID NO: 38744 - DNA, 116 bp, Homo sapiens
ctacgtcactctaaaatgttacaaataggtcatcttcttagtatgcattgccttgtaaaaacattggtcaagtcgggatgtagtcggccaccaactagaaatgtgttaagattttt

SEQ ID NO: 38745 - DNA, 159 bp, Homo sapiens
taccttcaatcatgttctgtggaatttctcatccctaccccttcacattgcattctggtccatgcctctgggctgattttcagttgctagtcatgctgggtacactctcacatcccccgcactcctccctcctgttcaggcaggatatccagcccctct

SEQ ID NO: 38746 - DNA, 313 bp, Homo sapiens
  misc_feature (13)..(13): n is a, c, g, or t
ccatgttggcagnactggtctcaaactcctgacctcaggtgatccgcccacttcggcctcccaaagtgctgggattacaggcataaaccaccaggcccagcctacttgacccattgttaaccagcttgcttaaccaatcttggctagaaagaccttttttcccctgtgaaggcaactttgttagatgattatcagtttcacaatgagaagacccagatgaaggaggagcctcaatactgattgatttcctaaaacatgttcctaaaacagcccaggaccaaagaacccaagtattaactggaaggattccaac

SEQ ID NO: 38747 - DNA, 322 bp, Homo sapiens
taccagtggaggtacaaaataaaaaaaaaaaaaaagaccacagaataaatgaagatgaaggttgtattagaactagacatgaagacttttttttgcatctgaaatcaaagcagtggcttttgagataaattttaaatttatctaaattatgcaggattccttcaagataaatattgtttactaggagttgacaatgttggaaacatagatggatatagtattaaaatcttacaaatgtttgtgttataagacttaaaatatggtaagtatataactgtggctaatgatttagaatactcatagccagcctttaactttattg

SEQ ID NO: 38748 - DNA, 441 bp, Homo sapiens
gtatccatgtctgttctatgattttaactgaaattagtactgtgccacttaaaataataattgtgggtagtttggggtaaatttagtttatgtctttaatttccttttcttactattattagctagtacttcagtattatgttaaataacagtgatgggtccaagcactgtggcgtaggcctatagttccagcactttgggagtctgagattggagaatctcttgaggccagatgtttgagaccagcctaggcaacgtagtgagaacttgtctctacaaaaaacacaaaaatttagcttgtgcagtggcatgtgcctatagtcctgcctacttgggagactgaggtgggagagtcacttgagcccaaaaggttgaggctgcaatgaactgtgctagtgccaccccactccagcctgggtacagagtcagaccctgtttcaa

SEQ ID NO: 38749 - DNA, 515 bp, Homo sapiens
tttgtcaaaaactatgcaagccagaaggcaatggtacaacatagtactaaaagtgccaaaagtagccgggcacagtggtttacaactgtaatcccaacactttaggaggctgagccaccacgcctggccacataaaaattatttttttttaatttaagaaaaattattttgaggaatatcaataaatttgataacatactgcaacactgaaagcataggaaaccagatactctcatacatttccaggatgaatgtaaattagtacaatctttatgacaggcaattttacgttatctgttaaaatttaaatgcctatattctttgacatagtaatgtgttccagtaaacagtcactgtgtcattacactagcaaacaattggaaaactaaaggtattggaatatttcttgaggggagcgctgggaaaataaataaataaatgtatagaaatagtcaacttattaaattatgtcatattaatatattggaacagcatgcaaatgtgaaaaaaattag

SEQ ID NO: 38750 - DNA, 1311 bp, Homo sapiens
gtaagcactcaaggacagataggatccctgtagggagctacttgtaaaagatgctttgttttattagtagaggttgcttttatgggaaaagttgggggaagaggtggatggggaaggccacggttagcaaagcttacccgcgtccccattctttcagttttcttgggaatcttacagcttaggataattttcatatcacagaacaagagaagtagaaccaggtgcagtggctcacgcctgtaatcccagcactttgggaggcggagatgggcagatcacctgaggccaggagttcaggaccaccctggccaacatggcaaaaccctatctccacaaaaaaataaaaaaaattagccgggcgtggtggcaggtgcctgtaatcccagctactcaggaggctgaggcaggaaaatcacttgaacccaggaggcggaggttgcagtgagccaagattgcgccactgcactccagcctgggcgacaaagcgagtctccatctcaaaaaagaaaagacagaacaagagaagtagagggtcagttgcttctgtctcctctttacagtcttttctagaaaagtcagctttatttttgcttcatgaaggaaagaaaccaatcatttaaatttataattttgtagtaaatacctaatttttttctcaagttctggcttaaattgatactaaccaacatgcacattgttcttgagattcatctacaaaagtagcctaaaaaaaacttttgaggccggggcagtggcttgcttgtaatccctgcactgggaggctgaggtgagaggaatgcttgagcctgggagtttgagaccggcctgggcaagatagtgtgagatcctgtcccttccaaaaaaaaaaattagccgggcatggtggggagcacctatagtcccagctactcgataggctgaggcaggaggattgcttgagccaggaggctgagaaatcagacaaccatttcagggtcatagttgcatagtatagaggataaaactaatattttagcttgtagggaacaataattcaataattaattgtagatgaatattaaaaatactactttagaataattttaaagtcactttcccatccttattagtatgtttagttattggtactaattttttcatcataattattcattattaattggctaaaaaaaggaaaagatacaaatgaaaccaatagttctctatttctcaaaaatatggaaaaatatattttatggggattctttgtctaaaatgtatctttcaaaattaggagcaattcattaaaataaaatagaggccaggtgtggt

SEQ ID NO: 38751 - DNA, 356 bp, Homo sapiens
tgtgggggggtatccttatttttaaaatatctaaatgtcattatttataattcaaaataataatttttattagtgatgattttgtttgaaaatagaatgatctgataaatttttttcacttttaacctattcagtcaaaatatataaaaagctagatttgccagcagaatattgtaactactttttaatgagataaaaatgtataacaacatcactattattgtacagagaaaaaagtgaacataaaaaggaatttaaaaagacaatatgacaatatgactatcatatacatacatgaactgacagactaaaatctcctactggagattatgttaggacttgagcaaaagcttcta

SEQ ID NO: 38752 - DNA, 239 bp, Homo sapiens
tggtgtttatagttaatgttttaataagtaggctaatggcaaacataatacgcagtaatatttaagtcggaactacaaagtaagttttgtagcatgtgtccttttaagaaaaatattaatcttttgctttttaatattcatttgtatcccctaagatgtatcaatttatgataacccataaaaaacagaagtaaaccactatgggatttaaatgttttctctaccttgtccatatgaag

SEQ ID NO: 38753 - DNA, 412 bp, Homo sapiens
ttctgcagtagactctgagttcattggtgacaggtgtcatttctcatgtattctctagctccagtctctagcatagggtctgatgagtgcatggcattggaaaaatagctgtgaaaaatattgtgatctgataacagactgcagcaagatggtctagttacagcaagaggcttggggagggcttcggatgagaagggtgaagagggttcaggtgagcttccccagtgtgcatttttctgaactcttttactccaagacagtagttctcaaactttcatcttaaggccctgttacaattgtaataattattgtgaacctcaaataactttcatttaaggaggttatatctattgttttttattgtattagaaattaaggccgggcgtggtggctcacgcaagactccgtctca

SEQ ID NO: 38754 - DNA, 427 bp, Homo sapiens
actcatctaaactaagggagctgggagtaggtggccataccttggccctatgtgagtgactgtgatggaaatatcagtaggtaaccaagcttatgggtctgtgcatcagtgatccacacacaacacacatcttggctgtcggctgcagcagccatgtgtcccctgaatggggaagggcaaaaggagctatggctatgtgcctgggaggtggtcttcccaacgggatgatgatgctgtgtttcctgtctgagccttctagatgctaagtaaatgtgctcttagattaaagcctgttgcatctcaggtgactgccagttcaaacccacttctgctgctcaaccaatgcatgcgccgggcaaacggtggtgctgctgatattggaagcaggcagtggatcccagcttcaaccagggaggccttccagact

SEQ ID NO: 38755 - DNA, 461 bp, Homo sapiens
ttccatatacaataatattattatctatggtgtcaaaatcttcacagaaaaaagaaaattataatgatattcatgtgctgaatacctaccacgtgcctgtcattgggttaatcatctaaccatcacaataaccccccctgcagctagacagagatttctacctccatttaaaattgaacaggctggtcatagtgcctcacgcctgtaatcccagaactttgggaggccaaggcgggtggatcacctgaggtcaggagttcgaaacctgcctggccaacatggcgaaaccccgaatctactaaaaatacaaaaattagccaggcgcggtagtggatgcctgtaatcccagctactccggaggctgaggcaggagaattgcttgaaccgggaggcagaggttgcagtaagccaagatcgtgccactgcacgccaacctaggcgacagagcgagactctatctc

SEQ ID NO: 38756 - DNA, 193 bp, Homo sapiens
gactgatgttctcctagcaccttgttgtttaactatcagtctgggcaacagcaatcaaggtcaggttgtctaagttgttttagcagcagctgctttggttctctcgctgcaccttgaaaaaaatatttatggtatttacctgatcagaatagcctaaacataccctttggctttactgtgaacaacactgaga

SEQ ID NO: 38757 - DNA, 815 bp, Homo sapiens
acaagatctgagacttggcgagtctattgccataattggaaaggagttagggttatctcctctgaggagcattattattttccccaattatttgctggctctctcgatgagagaattctaattccccacccagtgacatctagcttggctgtgtgacttcctttgtctaatgaaatgtaaacaaaagggatggatgtcacctcaaaacagaatccttaagaaacatttttctgccatggctgtcatccctctgccatgaaagctgctgtgctagaagaggggtgcatcttcagcttgactgacagctgacgtgtaacattagcaagaaataaacccttgtagttgtaagtcacagtgatttgggaatttttgttactgcagcataacctaatttaaactgcctgataagtcactaccgtattggtcaaagtttgtgtattcatctctagaatcctgaagaagataagccttcaagctttcttagaaatcactttttctctgcactttaataatgaagatataatgtaaataaatccattactgctatttggcactattccatatatactatatatactatgtgtaccatgatcataatcgctttgtgatgaggtcaatgcatagtcagaaatttcactttgtgctgcctattcttcctcattaatgaggaaaagcagtgttccatcaacagtgttattcagttggcttttatgcttgcatggttaaatctagtagaatcttggatctaagtccgatcatcacactttggacactgtgagacagctgtagcatctgtttgtgattgagtacactct

SEQ ID NO: 38758 - DNA, 396 bp, Homo sapiens
acagccagaagtgggaaaaacacaattggaacctatgcattgcgatcctaatgcccacgcttctaatcatcctgtgagacactctcagggaggctcaaggaggccaaagaactctaccaagtcacagagctgatatttagccacctacattgttgcttccaaaatcttgctcttaaccaccagttaaggtgtgactgtaaagtaaaaatatttgtttttcacaagtggttcatttagcaccatctcgatcattgcatccacacacatgtgctccacagtgtctgtggaaggtacttagcttgatagtgtaggcagacagaaaggaggatcatggggtcatcctcaggagctatgattatttagttttgctatagtggttcctcctctcctttttgt

SEQ ID NO: 38759 - DNA, 162 bp, Homo sapiens
agtcctcaccctctagaagcctacatctgttggatgcaaaccccttcccttctctgggcctcagtttcctcacctgaacaaaaaagtgtttgctctagataaactctagggccctttctgctttttctcttttcgatactcaggatggttagggtccccagg

SEQ ID NO: 38760 - DNA, 782 bp, Homo sapiens
gtcacattatttattttgtaatttgatatctgaatattaaaaacttacactttctaatgttctataataaattctaaagtgcagatataactcccatgaatgttgacacactaagtaacagtaaaatacattaagcaaattagaactgtaagaaaaaggaaagcaacacagaataaaaacaagactcagtaggtgatctttatctagaatcagaacaattaaaataaaataatgactggagaaaaactgaagtaagtactatgtttaatgcctgtaagcaaatatacgtattttgaattgtgacatgattaaaagagaatgtatgattttcaagtgttcatacaacacattgaaaaattaagcataaactccccgaaattcttatacctaaatgtcataaaataagtaccaatcataccaactacttttctgaacataatgcaatgaaatctataaaacaactgatattttgtggctgttttttactgcatcaaaagaagactaataaagcaatgtatttaccctgtgaatgtatatgttcaaataatttatatagactgtacacataatattcttttaattttctttatatttcttcttatatatccattttctaaaatagtgagttatgcttttattcactagattttttctgtttaaatttgtttaggtattatatttgatattttattaatttccgtattgatgtttatcatttacttcttacagttttcaaatattttatgattaaaattatagatcattgttttaaggccatctta

SEQ ID NO: 38761 - DNA, 359 bp, Homo sapiens
ggagctcatccaggaggggcacatgggcaagggcaagaggctctgttggggagacctgactggacactggggctgctccacagcatagggaacacgccaagtgctgcaaaaacaaaaatgaggcaagaaaaacagcctaaacctggacagagggtgccaggacaggcaggggggcaacagtggaccgagtgacgttgctgccccgggttgagggagggcagagtgagcagggggcaggcattgcagttcaggggaccaggaccaagcagccacaggtgcacagggcaggtgggaggcaggaagaacagggggcagctcctggagctcaggggaccacgggagagcatctgaaggtgaac

SEQ ID NO: 38762 - DNA, 329 bp, Homo sapiens
aataaccataagcttgaacatcatgaatacatatagtatcagtcctatagattgtattttcaaggttttatttctttgattcttgctatctctctgatttattttgaggctaacctcatttctttaacttcctactctgtgaacccataccactttgtatttctttttcagcttacagcacttagaaattgttgatggccggtatctcttaagtaagaatagcctagggaaattttggataccagtttaattcttgaacaagacagcttggtaaggacattgtaattcacttgactaaggtgaaatttgtaaatttcaagacataacct

SEQ ID NO: 38763 - DNA, 327 bp, Homo sapiens
agtttctgtgttcaagtttgaatactcttgaagtcttatttttttcattttcagattttaaaattttcaaagaaaaggcgttgctgatgtctgaaatctcagatgcctgaaattcaattgacaattactgaacaacagtctcttatttacataaaggtggggttgtcaatcttgggctctcaggaattttctcttgtagggcactgtgtaggctaaaggttatttaaggtgatttcagaggtaggataggattactcagtggattactaccctgttgccaaaggataatgcggtaggaggtaaccccagtatcagttacgttagatt

SEQ ID NO: 38764 - DNA, 1086 bp, Homo sapiens
gggccggcactgctcacctctcgtccagggacatgacgggcacgccaggcgccgttgccacccgggatggcgaggcccccgagcgctccccgccctgcagtccgagctacgacctcacgggcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggcggtctgaattcctgactcagcacctgcggctggctccaaagtacgggaataaggagaaggccaagccaggtaaggtttatcaatcttggaggctgagtccagggcatcatcaacagctacaggtatccaccgggtagagccgaaaggaaacccaacggatagatgagtgcaagcgagaccgccctgacaggagcaagatgcacacgacgtcaaccacagcacagcgcagacaaacaacaggaagacagccgagcggcgaccccagagagcggagaagaacgacaggcagagaacaatcgaa

SEQ ID NO: 38765 - DNA, 749 bp, Homo sapiens
gggccggcactgctcacctctcgtccagggacatgacgggcacgccaggcgccgttgccacccgggatggcgaggcccccgagcgctccccgccctgcagtccgagctacgacctcacgggcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaagtgagagctgggcagggaagggaagtgtgcggggcagggcggcacactccaggaatccagtagggcccggcccctggcccagcccctggacacacctgcattctgcaggctgaggtccatttgctctgggagcactgggccactgggaaga

SEQ ID NO: 38766 - DNA, 3032 bp, Homo sapiens
gggccggcactgctcacctctcgtccagggacatgacgggcacgccaggcgccgttgccacccgggatggcgaggcccccgagcgctccccgccctgcagtccgagctacgacctcacgggcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttgtgaaaaaaaagagaaatccctggctcctggagctggtgggagacaagattaagcaaacctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctctgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagcaaaaaaaaaaaaaaacaaaaaaaaaaaaaaaaaaaaaaaaaacaaaaaaaaaaaaacactagaacacgaagcggcgggacgcgcacagagacatcgtcccgcgggggccccaaaataaacaggcgaaacgaacgtaagtaagaacaaagaggggcccccaccataaagagggcctagcacatcacactgacagcgagcgcggccggccgcgtatcacaccccgcgacgtcgagtggcaaaaacaagacacaaggatcacatgagcagagcacaccaaccaggtggagcaaacaatacggaggcaaccaccgcgagaacttcccgcgagacgaacagtaagctcccgccgatcgacacaacagcaggataccagcgcgaaatgcccgcccaccgaagacatcaacg

SEQ ID NO: 38767 - DNA, 2973 bp, Homo sapiens
gggccggcactgctcacctctcgtccagggacatgacgggcacgccaggcgccgttgccacccgggatggcgaggcccccgagcgctccccgccctgcagtccgagctacgacctcacgggcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttctcccctgacatgtatccctttgaccccaagctctgcctcctccctgaccacccatgccctttcctttaacttctcaaacagataccagggcctaaactgctttacctcccctcctactgagtcaggttaggtggtgggaggtcacccatttccgagttaaaccaatgcaatatgagtaaaacaaagtcatgtgggtatgtctggggtagagagaggggtagcaagttcatgtgtcctccttggtcacatatctcccaaagctctgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagcaaaaaaaaaaaaaaacaaaaaaaaaaaaaaaaaaaaaaaaaacaaaaaaaaaaaaacactagaacacgaagcggcgggacgcgcacagagacatcgtcccgcgggggccccaaaataaacaggcgaaacgaacgtaagtaagaacaaagaggggcccccaccataaagagggcctagcacatcacactgacagcgagcgcggccggccgcgtatcacaccccgcgacgtcgagtggcaaaaacaagacacaaggatcacatgagcagagcacaccaaccaggtggagcaaacaatacggaggcaaccaccgcgagaacttcccgcgagacgaacagtaagctcccgccgatcgacacaacagcaggataccagcgcgaaatgcccgcccaccgaagacatcaacg

SEQ ID NO: 38768 - DNA, 2710 bp, Homo sapiens
gggccggcactgctcacctctcgtccagggacatgacgggcacgccaggcgccgttgccacccgggatggcgaggcccccgagcgctccccgccctgcagtccgagctacgacctcacgggcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcaggcatgcagctccacaggcgatttcttcaagcagctgaagtgtttagccctcctgggttaagagccagataaggagaaatccctttcctaggtttggaatgtgttctcccctgacatgtatccctttgaccccaagctctgcctcctccctgaccacccatgccctttcctttaacttctcaaacagataccaggggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagcaaaaaaaaaaaaaaacaaaaaaaaaaaaaaaaaaaaaaaaaacaaaaaaaaaaaaacactagaacacgaagcggcgggacgcgcacagagacatcgtcccgcgggggccccaaaataaacaggcgaaacgaacgtaagtaagaacaaagaggggcccccaccataaagagggcctagcacatcacactgacagcgagcgcggccggccgcgtatcacaccccgcgacgtcgagtggcaaaaacaagacacaaggatcacatgagcagagcacaccaaccaggtggagcaaacaatacggaggcaaccaccgcgagaacttcccgcgagacgaacagtaagctcccgccgatcgacacaacagcaggataccagcgcgaaatgcccgcccaccgaagacatcaacg

SEQ ID NO: 38769 - DNA, 2003 bp, Homo sapiens
gggccggcactgctcacctctcgtccagggacatgacgggcacgccaggcgccgttgccacccgggatggcgaggcccccgagcgctccccgccctgcagtccgagctacgacctcacgggcaaggtgatgcttctgggagacacaggcgtcggcaaaacatgtttcctgatccaattcaaagacggggccttcctgtccggaaccttcatagccaccgtcggcatagacttcaggaacaaggtggtgactgtggatggcgtgagagtgaagctgcagatctgggacaccgctgggcaggaacggttccgaagcgtcacccatgcttattacagagatgctcaggccttgcttctgctgtatgacatcaccaacaaatcttctttcgacaacatcagggcctggctcactgagattcatgagtatgcccagagggacgtggtgatcatgctgctaggcaacaaggcggatatgagcagcgaaagagtgatccgttccgaagacggagagaccttggccagggagtacggtgttcccttcctggagaccagcgccaagactggcatgaatgtggagttagcctttctggccatcgccaaggaactgaaataccgggccgggcatcaggcggatgagcccagcttccagatccgagactatgtagagtcccagaagaagcgctccagctgctgctccttcatgtgaatcccagggggcagagaggaggctctggaggcacacaggatgcagccttccccctcccaggcctggcttattccaagaggctgagccaatggggagaaagatggaggactcactgcacagccgcttcctagcagggagctatactccaactcctacttgagttcctgcggtctccccgcatccacagggagggtaaaacacttagcttttattttaatagtacataatttaataccaaaaaaggcgcctggatccccaaaaaaccgaggctgggagctagtggcccttttgctttctaggacttggggggccggccctccctcctaagcataacaaaggtggtgttgctccagctcagccccaggggacacagatgcactttgggggtgagggcaggtaatgactccatcgcaccctcagttcagctggacagaggctcaggtgaccccagccttcactgtctcccgctctccaggagcttatcttcgccccatctcccaaataagtgggcccttgtgctgtgaggaagaccaaagcctcagggaagataagagatatggagatgggagggggaggacaaggggcagagagtagggtctagctggctatctctggccttactaacacccccctggaggcatgccccttttctccagcacacaagcacattggggcacctggaaatattggttccaggctcctgttctctggacttcagatcctgggggagcccctcccccccctgaatccctggcttagctaccttcctgcctgtgcacctaaaaacctcaggtcagaactaggaaaagagttttgtttttatttttttgaaatggagtctcgttctgtcgcccaggctgaggtgcagtagtgcaatctccgctcactacaacctccactccctggggctcaagcgatcctcccacctcagccgccgaagtagctgggactataggtgtgtaccatcacacctggctaatttttgtattttttgtagacacagggtttcgccatgttgcccaggctggtcttgaattcctgagctcaagcaacctgccggcctcggcctcccaaagtactgggattacacgcagaaggcaccatgcccaggctagatgtgtcttatcccaatcctttggcagtctcttctggggcccaaggcaggttgcaggagatccaatcccatagacagctctgggcctcttgcatttgagtttttcagaattaaactgcagtattttggaaagcaaaaaaaaaaattacaactagctgagtaagtgcgatcgggggcggttggga

SEQ ID NO: 38770 - DNA, 1050 bp, Homo sapiens
  misc_feature (10)..(10): n is a, c, g, or t
  misc_feature (24)..(24): n is a, c, g, or t
  misc_feature (84)..(84): n is a, c, g, or t
  misc_feature (100)..(100): n is a, c, g, or t
  misc_feature (117)..(117): n is a, c, g, or t
  misc_feature (262)..(262): n is a, c, g, or t
  misc_feature (265)..(265): n is a, c, g, or t
  misc_feature (269)..(269): n is a, c, g, or t
ttaagtgccntaattcataaactnaatcacaggagacatccactggggtctggttttagatatccactgtatcccctgtggatnagggggtaactgctgnatcttttagtagaagcnagagcagccccatgtgggggctaacactggacactggtcagtttcagctcctcatgcaaagtgagggtatccttgtggctccagccctggggccccctgcggtcacctttggctccacagtctggttcttgaacccaagggcagncancctngtgccgaattcggcacgagctctgatccctgccatgggaagtggacaggaaacatgaggtcatgacctgcaggcatctttactgcagctctgccggcctggagggggagagggggaggaagaagtatgcgctgcacatttctgaggctactgcatttgctttcaaggcagaaatcttgctctgagcagtcagcggctccagtttgggcccgataaggaagttctccgtggcctccctcaggcagagcagggaggaggctgacattgccagtctcttctggggcccaaggcaggttgcaggagatccaatcccatagacagctctgggcctcttgcatttgagtttttcagaattaaactgcagtattttggaaagcaaaaaaaaaaaaaaacaaaaaaaaaaaaaaaaaaaaaaaaaacaaaaaaaaaaaaacactagaacacgaagcggcgggacgcgcacagagacatcgtcccgcgggggccccaaaataaacaggcgaaacgaacgtaagtaagaacaaagaggggcccccaccataaagagggcctagcacatcacactgacagcgagcgcggccggccgcgtatcacaccccgcgacgtcgagtggcaaaaacaagacacaaggatcacatgagcagagcacaccaaccaggtggagcaaacaatacggaggcaaccaccgcgagaacttcccgcgagacgaacagtaagctcccgccgatcgacacaacagcaggataccagcgcgaaatgcccgcccaccgaagacatcaacg

SEQ ID NO: 38771 - DNA, 750 bp, Homo sapiens
atcccagggtttcctgccttggtgtacgggaagagcccgctcacagcctgggcttggagaatgagtgcaaggtttattagtagaagtagctctcagcagatgggggaaccagaagggagatggttttctcctggagttgggccgcttggtggccaggctctcctccgtctgccccagccaaactccgcgtcgttgtcgttctgtcgacggcctgccggcgtgcgggtgcctatcgttgtgctcttctgctggcgtgctcctctcgacgaccagccactttcttccgccgatgtgctcctctttacgtctggccgcctgtgtgtctgcctgctagggtctcgggtttttataggcccaggatggggacatggcgggtccgggtggtcttggaaatgcaacatttggacgggaaagcaggagtgcctgtcctcacctaggtctgttggggtggagccctagtcagggacgcacctttctctacccattacttacctccccacttccgtgtcatttaaggagggcacactgttcccttcccagcactataacatgtttaaaatgttttaaaacttttttcattctctccaatatatgaattaataatccatttcagattttgaattaatgaatgtttaatgtaaaagttttgttaaattttcttttataaatttgagaataaaagcaaagaatgctgagccttcaaaaaactgtatgagaagactcattatacagagttttggaagtaggagg

SEQ ID NO: 38772 - DNA, 2419 bp, Homo sapiens
acctggccgccatgcgcctctcctcctccccacctcgtggcccgcagcagctctccagctttggctccgtggactggctctcccagagcagctgctcagggccgacccacacccccaggcctgccgacttctccctggggagcctccctggcccgggccagacatccggcgcccgggagccccctcaggccgtcagcatcaaggaggccgccgggtcctcaaatctgcctgcgccggagaggaccatggccgggttgagtaaggagccaaataccttgcgggccccccgtgtccgcacagccttcaccatggagcaggtccgcaccttggagggcgtcttccagcaccaccagtacctgagccctctggagcggaagaggctggccagggagatgcagctctcagaggtccagataaaaacctggtttcagaatcgccgcatgaaacacaaacggcaaatgcaggacccccagctgcacagccccttctcggggtctctccatgcgcccccagctttctactcaacgtcttctggccttgccaatggcctgcagctgctgtgcccttgggcacccctgtccgggccccaggctctgatgctgccccctggctccttctggggtctctgccaagtggcacaagaggccctggcatctgcgggagcttcctgctgcgggcagcctctggcgtcccacccccctaccccaggccggccttcgctgggaccagccctgtccacggggccccggggcctgtgtgctatgccacagacgggggatgcattttgaggaggcacctctgactcccacactcgcggtcttgctgatcgcacctggctcctacctggaggactcagttgttctgtttacatcctggtggcacctctcaccctgacccacacaaaggttctggagattactggagaatatatataaatatatatatgtacgtatatatgtaaatacacatatacgtatatataaatatatatatacatatatgtgtgtgtgtatatatatatatatatatattttttttttttttttttttgagacggagtgttgctctgtcacccaggctggagtgcaatgacgcaatctcggctcactgcaacctccgcctcctgggttcaagcaattctccagcctcagcctcccaagtagctaggattacagacacccgccaccacgcccggctaattttttctatttttagtagaaatggggtttcaccatgttagccaggctggtctcaaactcctgaccctgtgatccgcccgcctcggcctcccaaagtgctgggattacgggcatgagccactgcacccggccctgagaatatatttattaaagccacctcttcactgaaagttaccgaaagagtcggtttaggaaggaaacgaagggtcagtgaacagagtcaaatgcagaagtgggcttgtcatgggtagggctttcggcgtacgataaaaggatcatttgttttttaaaaggggttggaaaaactgattttccagttggaaacagtaaaggttgtaagctttgtgtgtacaaaagaaaacagggaatgcaggtgtgtttatagcgttgtggttcaagtccctcttaacaagaactccaaagctggaaagcaggagggaacaaaggtgaacatgaaggcgaggatgctggggccctgcagtgcgctctaggctgtgcgtgagccgggactgtacccacagcttgctgagggctgctcttcttgggccagggaaagcagggcagccgggacctgcggctgtgcctggactgaagctgtcccgcaggtccccaccctccaacacgtgctcacctgtccccctcctcgcagcagcctcgggacaaaacaatgactcaaggacagcacttctcgcagaaggtctggaagtgcccagaatgggaggcacggaagcccctcccggggaggactcccgcgttgatggaccgttcttggtgcagactcctgactgcgtgcatgaaacctgagacaagtgcaattccttccatgtcgccccagagtgcccaggaggcaggcagtgcggggtgcccaggcagacgggttcagcctgcagaactggaggcgacctgtgaaacccacccgggcaccccaacaggaacagaagcgtggtcctgcggctgcgtccccagcgagtttcactttccccttgctcgtttctcccttgttgtaagtgtttacaactggcatgtgcttttaaacgtcaggtaagaggggaacagctgctgtacatcgtcctggcgagtgacaatgtgacagaagcctgggcgaggccctcggagggcagcagctggacaggggctactgggtttggcctggacagcactgatttgtggatgtggatgggggcacgttgtccgtgataaaagtacaagtgccctcaccg

SEQ ID NO: 38773 - DNA, 285 bp, Homo sapiens
gatgaagcctttgggaggtgatgagggtttcatgaggtcatgagggcaggctctggtctgttaggattagtgcccttataagaagaaacagcgatcttgcttgctttctccccaccacataaggacacagcaagaaggcggctgtctctaggccgggaaaagcgccctcaccagtcaccaaccatgctggcgtccgaatctcagactgccagccttcaggactgtgagaaaacaaacgtctgtttaagtcacgaagtccacagtattttgttatggcagctcaag

SEQ ID NO: 38774 - DNA, 622 bp, Homo sapiens
gagccaccacacccagccaggatgtattcattttctacctgatgagtccctttccagagcactgtccatcatagtcctttggacatttattttcatggctgccttctcacctgtctcagcctaagaagaaggatgaagaaagctgataatgatctcttaaaggggagaaagataatggtctctttaaaggggagctgatagtggtctctttaaaggggagaaaatctggaataattctactgagtaagacatcatgaatgtatctgctacctctccccgttcttgttcaagccccaggggtgttaaaaaggagtgtgtgtgacagttacacactcctgactttacatttagattttgtcttcctttgatatcaaatgttagcacggtaatagtgcctgtgcctccagtattgagctgccacttctgttctcagcctgtttattcccctttgctcaccacttatttttattgctttgtcccttctttccatttagccctgctccacccaaatgccccactccttcactttccctgccaccttgagctttcctctagcccccaacaccaagttgaatgctcttcactgacatcatctgatgtaaaaacacagtgttgtcacaac

SEQ ID NO: 38775 - DNA, 242 bp, Homo sapiens
gtaattgctttgcttcctctacctgcctttaccaagagatgcctggccagaagagcgaggaattaaagtacctgtggaggctgcccaccgagtgaagctgcaggctgcccatcccatcgcagtagctccttagttgtcacttgcactctatcctgccacccttgtgaagaaggtgcctgcttctcctttaccttgcgccatgattgtaagttacctgtggcctccccagcaatacacaactg

SEQ ID NO: 38776 - DNA, 500 bp, Homo sapiens
agtctggctctgtttagggaaaaactctctcaagctatgtttttcctctgctctcctaataatgcaacaatcgtcaacacagaagaagacttctgtgaccaaatgtgggcagtttttcccacacaccaagcagcggacaccagctgggtgtcctccaattcaattccggcatcatctacctggagatagtgtcagatttcacaggttgggcctcagtccccaagactgctctttgctcttcagacaccagtcacaagtctgggcctccagaatttcttttttatttttatttttattttcgagatggagtctcactctgtcacccaggctggaatgcagtggcgcaatctcggctcactgcaacctccacctccgaggttcaagcaattctcttgcctcagcctcccaagtagctgagattacaggtgcatgccaccacacctggttaattttttgtatttttagtagaggcagggtttcaccatgttggccaggctggt

SEQ ID NO: 38777 - DNA, 389 bp, Homo sapiens
aagtaattcttatacttagtaagtattcaaaattttgttgaatgaataataaatgtatttatattaatttacatgagttagaatagtcaactgcctcaatgtcaggaaaaaaaatccattcattttgctaaataaaaaagatagggagaagtacacgccacctacaaactcaagagtaatgttgctttatctagcctcagggaaagtattttgaagtcaggcagtctggtttcaggccttgattacaccaccactgggctgggacttcttccttagctgaaagtacctttgggctgctagaggcaggaggcagaagtgaagaggagggaggtgtcaagtccctttaccagtctgcttcatacagagcaatctacttttatgtatttaat

SEQ ID NO: 38778 - DNA, 402 bp, Homo sapiens
tgcactccagcctgggagacacagcgagactccgactcaaaaaaaaaaaagaaaagaaaaaagtgacatttaagcaaggacttaggaaagtgaatcatgtggacatgtagggaaagaatgttttaggcagaggaaacagccattgcaaaggcctggaagcaggagctgtctgtctggcatgttgggaggaaaagtaaggaagcccatgtggctggagtagagtgagcaaggggacagtagatgagacaagagtagagaaatcatagaagtcacgattatataggatcttgtgggatgttttaaggacttgggtttcactctgagcaaaataggaaaccattaaaaatttgagaagaggtgtaatgtgatctaacatatttcagaaggtcaaccagggctagg

SEQ ID NO: 38779 - DNA, 410 bp, Homo sapiens
ctaaaagtcttaaagataaagctttacatacttgaagttactcagtcagaaaatcacaacactttatatttctttggaaggaccaattgaattacaagatcataactaaaaacagatgaattttcttacctctatgctgtaaaaatcagggactatttctttaataatggacagaaaggccatgtcttagacaaaggggaaagtgggggataagataagaaatatctcatgttccattttttaacattaggtgtatgtgtgtatgcatacatgttattttttgtgacacagatgttctctgtttacattagatttttccaaactgttagcagtcaggtgcggtgattcacacctgtaatcccagcacattgggaggccaaggccagaggctcatttgagcccataagttc

SEQ ID NO: 38780 - DNA, 104 bp, Homo sapiens
acatgtgcaaagtaactagcttagtgctaggcacatagacggggctcagtcaatttggcatattaagcattatgatctttatttttcatctccaaatatttatt

SEQ ID NO: 38781 - DNA, 725 bp, Homo sapiens
gggaaactggggagtttacccagcttaaggaactcaacattcagggcaactgctgacccttctgctcccagaactaggaaacttatatttaactggtcagaagaaggtatgcaaagtggagaacagcccctgggttaccccaattgctggccagttccagcttgatgtgtcctgtgtgtctgaatgtgtctgttctgagacatatgagtacctctatggcagcacatgcaggcaaatccagaaccaccaaaacataataatcacaaatcagaaaagatgagctgggaaacacctgacagacagtaacaaataagagggtggggcattgggctggggcctctggcctcttctctcaccaacatttctgtcctttcttgctctgtctctcaaataaatgcaatgtgcgtgtgaaaaataaagacatacaataaaaggcaaaatgtattttataactcaacattctatccttaaatacttgggaattactcttttaacaagttcagttactagcataagtgatttaacaaggaatcaagtataattggattctaagtaccttcaggtacaatttgacccaaattgttttattcagtaacagaagaaaacactgcaccttatttgtaacttgactgcattttctaggaagcagataaggtcagatacttcagaagaactatttatctgcaaggagatatccttgtaccacacagagatttagaggaatt

SEQ ID NO: 38782 - DNA, 353 bp, Homo sapiens
gatataagggggaaaaaaagcaaactgcatgctgcatgaaaaatcatagccatccaatagctaatggctatcatgttgaaagtcaagtaaatgcttccactgagccccagtcaaatgtttggggttgattatagtaagatgaaagggttagttgaaattgcaagtagatgtagcacaattgggtattaattttttttaacgtttgttgaaaatggaaaccatcattctcagcaaactgtcacaaggacaaaaaaccaaacactgcatgttctcactcataggtgggaattgaacaatgagaacacttggacacagtaaggggaacatcacacaccggggcctgttgtggggtg

SEQ ID NO: 38783 - DNA, 311 bp, Homo sapiens
acagagcctggccaccgggagacagtgggcttgcccttgtcaaccagctcactgcagctgcagacttggggttcagggacactaagaggaagactgagggaagaagagacgaggcctctgggacctcctctggaaaacgtggtccagggaccaggggcactgtcccatgctccctcccgttggctctgagcctcacatggcatgctgagtgctgggcacagaggcctcagtggcactcgggagaacgagtcaggagacacaattccgtcccacctgcccttgccccacacgtgcacctgagatgcacccca

SEQ ID NO: 38784 - DNA, 478 bp, Homo sapiens
gcatttaacagattactgcttcagtgtcatcagtggtggcactgtgatgtaaattaatagttctgcactcatgggtgttcattaatacttacagaatagttggcaatgcttgctgacagactgctctcaagtctgcctttctaatttctgggaaatagtttgtctaccatgagactctaagtccaaatcaagtatacttttgaagcaatttctaatcacagtgaaaattccccaagcagcatattttattttaaacttgctttatgtagcagcaacatatttacctgtgcctttgaaaaatatagtatcggggagtctttgaaagattattatcaaatgtaggctggacggggtggctcatgcctgtaatcccagcactttgtggaggctgaggtgagcccaagagttcaagagctgcctgggcaacacaggaagaccctgtctctacaaaataatagtaataataacaataaaaaaa

SEQ ID NO: 38785 - DNA, 456 bp, Homo sapiens
atggcaaaaagggactttgcaggtgcgattacggacctggagatggagagaatgtcaggcgttcaggggttatccaggtgggctcaatataatcatgagtccttaagagtaaaagatgaccaaagaaggtaggtcagagagatacaccatgaggagccctccacccgcttgtgctgactttgaagatggaggaaggggccacgagctgaggaatgcagtggcctctagaatctgggatcaacagctcttttacagctaccaagaaaatgagggcctcagtcctgcaatcagaggaactgaattctgtccacactgtgagcgagcaggaaatagaccctctcctaaagcttccaggaaggaacatggcctgctggcaccttggcttcagcctcgtgaaacccatgccagacttctgaccttcaggactgtcagataataaatttgtgctgtttgaag

SEQ ID NO: 38786 - DNA, 300 bp, Homo sapiens
gtcttctccttcactgatcaactgcttattttcatcagtcattgtaatagttccaggatagttcattttcagttcatattggacatgactgaagtttttccactgaagcccttgcttcgtaactcttttatattatattattgtcaacaactttatcttcctggccttttcagtcatgtaacaaagttggcatgatttttattgctttttcttgtagttaatctcaagttgccctttttttataacctctttttagacttctaacttttgattggctagtgtttgctttttaaaaaaaaa

SEQ ID NO: 38787 - DNA, 4110 bp, Homo sapiens
caccgggcagcgccgagggttgccggccggcgcgcggggagtagagggcgcgggccgcagtgccgggttccagagggagctctgcgccgggtccttccctgtggtagccccaggacacccccagcctcaacatcccattctgggactcctgccctgttcccacattcgttctacctcgagtctccaggagcttccagtggcttggtcaccgccaactctcgtccatgcctcttagagcccctttcccggcctcaccgggtgtcgcttaatagtcttgggaccttaaggagcaagtcagcccctgcggaccctcccagtgaagagaaagagctggctgtgcggtggaatttggaagagacgacgtttgggagcctttgctgagtccagggagagaggcgtcccccaccgtgccgctgcagctcgggcagagccgccaagctttggggtgctgaggaacctctaatcatctcccatggatttgtgatcagcgttgcagctctcccagcagccctggacagtggcccccagcagtcagcatgtggctgccgcgcgtctccagcacagcagtgaccgcgctcctcctggcgcagaccttcctcctcctctttctggtttcccggccagggccctcgtccccagcaggcggcgaggcgcgcgtgcatgtgctggtgctgtcctcgtggcgctcgggctcgtccttcgtgggccaactcttcaaccagcaccccgacgtcttctacctaatggagcccgcgtggcacgtgtggaccaccctgtcgcagggcagcgccgcaacgctgcacatggctgtgcgcgacctggtgcgctccgtcttcctgtgcgacatggacgtgtttgatgcctatctgccttggcgccgcaacctgtccgacctcttccagtgggccgtgagccgtgcactgtgctcgccacccgcctgcagtgcctttccccgaggcgccatcagcagcgaggccgtgtgcaagccactgtgcgcgcggcagtccttcaccctggcccgggaggcctgccgctcctacagccacgtggtgctcaaggaggtgcgcttcttcaacctgcaggtgctctacccgctgctcagcgaccccgcgctcaacctacgcatcgtgcacctggtgcgcgacccgcgggccgtgctgcgctcccgggagcagacagccaaggctctggcgcgtgacaacggcatcgtgctgggcaccaacggcacgtgggtggaggccgaccccggcctgcgcgtggtgcgcgaggtgtgccgtagccacgtacgcatcgccgaggccgccacactcaagccgccaccctttctgcgcggccgctaccgcctggtgcgcttcgaggacctggcgcgggagccgctggcagaaatccgtgcgctctacgccttcactgggctcagtctcacgccacagctcgaggcctggatccataacatcacccacggatctggacctggtgcgcgccgcgaagccttcaagacttcgtccaggaatgcgctcaacgtctcccaggcctggcgccatgcgctgccctttgccaagatccgccgcgtgcaggaactgtgcgctggtgcgctgcagctgctgggctaccggcctgtgtactctgaggacgagcagcgcaacctcgcccttgatctggtgctgccacgaggcctgaacggcttcacttgggcatcatccaccgcctcgcacccccgaaattagtggaggccacagttgtagcaggcgctaggcccgggaggagagtgcatggtgcagagggggctggggcgcacggagaagcaggtccctatattgaccaaggagtttgtggtacgacccctccccctccccaagtaggcaaggactgcacgtttctttctctcttgattcttggttttcctttgagtcctctggagctgccttctcatcaggtgcactcttcatggaaagcaactcttgcccctcctcctctgggcacagggtgtgcgttcagatgacttggctcctactcaagggctttcttcccctttaactctctccttctggtgacacatcctgcagcagctgagggggtgccctggcactggctgggagtggagaggcactgtggtgaaatggctccagaggtctgtacatcacatacatatgcacacaggcacacatggcaaaactcggaagtgaaaggacttgtctgaaatcacatggtgagaaggaggatgaagggaggagagagcttttgctctgggtctccagtggataggagaggacctgcctcctgggtgagaagggtcagattttcctattttaattgctttagggaagagcaagcagagtcatgaccagggacacagctgagagatagaggaggctgtgaatgctgagaccagagtttatcatgctggacaagcctggaaggaggcaataagtgggaaaggtaggaggagagaaggctggggagggctgggcagcaagccaggcacagtgagtggcagagcaagagggggaaagcaggatcagtgcctggaaggcaggtgtgcccgtcagcggggagtggaactcatcaggcttgccaagaggttggaagggaaatggctctgggctggaactgtcttcccttggtccttctggtccaggccttggaggaaagcagaggatgatccctgcctgtgagccacacctcctagctctgggggcaaaggggcttagtaaaggaatgctggatgtgtagagggtttagtcccgagctcaggaaatgagagcctataagtgcccagtacatgtttaaaagaagagctcatggaacctctggaaaggacagggaagttgagttagccacataaatgaacccaagtcacattggaacacagagctggtctgggaactgtgttggctgccaacagaacttctgaccctgttacctgtgaaatgaggcagtttccctcacgttgccatcagctaccaggagcgatgctggtggtcactagcttctgatcctcatcctgggtgtggccacagattgggggaacctggattgtggagtcacatcctccctgcaaagcaagcagggcaagggagatctggcattttctgctttacgtggagggagaacaggcacattagccttgaagctgaagctcattttaggttccttccaggtttagaagcttcaaccaaatgaaacttgaatctgtccctcgtgacaattataggaggaaggtatttaaaaccccagatttatgaatgtgtactacatggcttagagaatgtctttgttcttgttcaggtggttataacaaaataccttaagagtgggattacaggcatgagccactgtacctggcgaaaaacagtttgttaacacaggcagccaacatcactcaggataagcctcaatgaaaagtaacaaagtgatggcttggaacactgtcttacacagcatttttaaaaaatacaataaatttgtagagataggatgaccaaggacaacagttttaggcttccaaaggtggtaaactatgggatggtaaatatccgagaggaagctgatgcaacaggatttgtctgcagcagcctctggtaccacctctgagtcaagggttgtgtccagtgatggagagtttatatcgtgcctttaggcagaaaaggggagggaaacctgaacttttcctgcactttctgcttcttaattgccttcagctgaaaatcattttttatgtgaaaaaggcatagtctgagctgacgcctctgctttcctccacctgaagagaacctgcgtgctgctcctttgcttcggacctccgcctctgcccgggagaaagcccaggccagcctgctggacaagcagagaccatgagaaggagagttcaggggtcccaatccaggccatcctagaccagccagctccagctgatccgcacgcagccacttcggctaccttctactggccaaagggagtcccagggctcacccagattcagaggtggggaaactgagtccaccacttgagaagagtagctataaagacatatgagcgagaccagctgagcccagcactgcggccaagtcgaagactttaggagcaataaaagtgcttattgtgtttcagtca

SEQ ID NO: 38788 - DNA, 4471 bp, Homo sapiens
caccgggcagcgccgagggttgccggccggcgcgcggggagtagagggcgcgggccgcagtgccgggttccagagggagctctgcgccgggtccttccctgtggtagccccaggacacccccagcctcaacatcccattctgggactcctgccctgttcccacattcgttctacctcgagtctccaggagcttccagtggcttggtcaccgccaactctcgtccatgcctcttagagcccctttcccggcctcaccgggtgtcgcttaatagtcttgggaccttaaggagcaagtcagcccctgcggaccctcccagtgaagagaaagagctggctgtgcggtggaatttggaagagacgacgtttgggagcctttgctgagtccagggagagaggcgtcccccaccgtgccgctgcagctcgggcagagccgccaagctttggggtgctgaggaacctctaatcatctcccatggatttgtgatcagcgttgcagctctcccagcagccctggacagtggcccccagcagtcagcatgtggctgccgcgcgtctccagcacagcagtgaccgcgctcctcctggcgcagaccttcctcctcctctttctggtttcccggccagggccctcgtccccagcaggcggcgaggcgcgcgtgcatgtgctggtgctgtcctcgtggcgctcgggctcgtccttcgtgggccaactcttcaaccagcaccccgacgtcttctacctaatggagcccgcgtggcacgtgtggaccaccctgtcgcagggcagcgccgcaacgctgcacatggctgtgcgcgacctggtgcgctccgtcttcctgtgcgacatggacgtgtttgatgcctatctgccttggcgccgcaacctgtccgacctcttccagtgggccgtgagccgtgcactgtgctcgccacccgcctgcagtgcctttccccgaggcgccatcagcagcgaggccgtgtgcaagccactgtgcgcgcggcagtccttcaccctggcccgggaggcctgccgctcctacagccacgtggtgctcaaggaggtgcgcttcttcaacctgcaggtgctctacccgctgctcagcgaccccgcgctcaacctacgcatcgtgcacctggtgcgcgacccgcgggccgtgctgcgctcccgggagcagacagccaaggctctggcgcgtgacaacggcatcgtgctgggcaccaacggcacgtgggtggaggccgaccccggcctgcgcgtggtgcgcgaggtgtgccgtagccacgtacgcatcgccgaggccgccacactcaagccgccaccctttctgcgcggccgctaccgcctggtgcgcttcgaggacctggcgcgggagccgctggcagaaatccgtgcgctctacgccttcactgggctcagtctcacgccacagctcgaggcctggatccataacatcacccacggatctggacctggtgcgcgccgcgaagccttcaagacttcgtccaggaatgcgctcaacgtctcccaggcctggcgccatgcgctgccctttgccaagatccgccgcgtgcaggaactgtgcgctggtgcgctgcagctgctgggctaccggcctgtgtactctgaggacgagcagcgcaacctcgcccttgatctggtgctgccacgaggcctgaacggcttcacttgggcatcatccaccgcctcgcacccccgaaattagtggaggccacagttgtagcaggcgctaggcccgggaggagagtgcatggtgcagagggggctggggcgcacggagaagcaggtccctatattgaccaaggagtttgtggtacgacccctccccctccccaagtaggcaaggactgcacgtttctttctctcttgattcttggttttcctttgagtcctctggagctgccttctcatcaggtgcactcttcatggaaagcaactcttgcccctcctcctctgggcacagggtgtgcgttcagatgacttggctcctactcaagggctttcttcccctttaactctctccttctggtgacacatcctgcagcagctgagggggtgccctggcactggctgggagtggagaggcactgtggtgaaatggctccagaggtctgtacatcacatacatatgcacacaggcacacatggcaaaactcggaagtgaaaggacttgtctgaaatcacatggtgagaaggaggatgaagggaggagagagcttttgctctgggtctccagtggataggagaggacctgcctcctgggtgagaagggtcagattttcctattttaattgctttagggaagagcaagcagagtcatgaccagggacacagctgagagatagaggaggctgtgaatgctgagaccagagtttatcatgctggacaagcctggaaggaggcaataagtgggaaaggtaggaggagagaaggctggggagggctgggcagcaagccaggcacagtgagtggcagagcaagagggggaaagcaggatcagtgcctggaaggcaggtgtgcccgtcagcggggagtggaactcatcaggcttgccaagaggttggaagggaaatggctctgggctggaactgtcttcccttggtccttctggtccaggccttggaggaaagcagaggatgatccctgcctgtgagccacacctcctagctctgggggcaaaggggcttagtaaaggaatgctggatgtgtagagggtttagtcccgagctcaggaaatgagagcctataagtgcccagtacatgtttaaaagaagagctcatggaacctctggaaaggacagggaagttgagttagccacataaatgaacccaagtcacattggaacacagagctggtctgggaactgtgttggctgccaacagaacttctgaccctgttacctgtgaaatgaggcagtttccctcacgttgccatcagctaccaggagcgatgctggtggtcactagcttctgatcctcatcctgggtgtggccacagattgggggaacctggattgtggagtcacatcctccctgcaaagcaagcagggcaagggagatctggcattttctgctttacgtggagggagaacaggcacattagccttgaagctgaagctcattttaggttccttccaggtttagaagcttcaaccaaatgaaacttgaatctgtccctcgtgacaattataggaggaaggtatttaaaaccccagatttatgaatgtgtactacatggcttagagaatgtctttgttcttgttcaggtggttataacaaaataccttaagagtgggattacaggcatgagccactgtacctggcgaaaaacagtttgttaacacaggcagccaacatcactcaggataagcctcaatgaaaagtaacaaagtgatggcttggaacactgtcttacacagcatttttaaaaaatacaataaatttgtagagataggatgaccaaggacaacagttttaggcttccaaaggtggtaaactatgggatggtaaatatccgagaggaagctgatgcaacaggatttgtctgcagcagcctctggtaccacctctgagtcaagggttgtgtccagtgatggagagtttatatcgtgcctttaggcagaaaaggggagggaaacctgaacttttcctgcactttctgcttcttaattgccttcagctgaaaatcattttttatgtgaaaaaggcatagtctgagctgacgcctctgctttcctccacctgaagagaacctgcgtgctgctcctttgcttcggacctccgcctctgcccgggagaaagcccaggccagcctgctggacaagcagagaccatgagaaggagagttcaggggtcccaatccaggccatcctagaccagccagctccagctgatccgcacgcagccacttcggctaccttctactggccaaagggagtcccagggctcacccagattcagaggtggggaaactgagtccaccacttgagaagagtagctataaagacatatgagcgagaccagctgagcccagcactgcggccaagtcgaagactttaggagcaataaaagtgcttattgtgtttcagtcaaaaaaaaaaaaaaaaaaaaaaaaaaaaatcttggggggcgcgccgcgggccccccggaaaaacgttctccaaacacacttgggtggaggagccgccgggagcccccaaggatggtgaaggcggcaacaagcgggtcactgagctgcgggttcccacaaggagaacacccggggacacgtagcaacaaggggctaggacgtactctcccacccagtataaacaaaagccgccgcgggggggcaacacaacagcgtgttagaggacccaaacttcacaaagggaggctactacggcgagcacacaaagggagacactaccaacagggggactccacaggaacgtcaacataaaatatacgccg

SEQ ID NO: 38789 - DNA, 2515 bp, Homo sapiens
caccgggcagcgccgagggttgccggccggcgcgcggggagtagagggcgcgggccgcagtgccgggttccagagggagctctgcgccgggtccttccctgtggtagccccaggacacccccagcctcaacatcccattctgggactcctgccctgttcccacattcgttctacctcgagtctccaggagcttccagtggcttggtcaccgccaactctcgtccatgcctcttagagcccctttcccggcctcaccgggtgtcgcttaatagtcttgggaccttaaggagcaagtcagcccctgcggaccctcccagtgaagagaaagagctggctgtgcggtggaatttggaagagacgacgtttgggagcctttgctgagtccagggagagaggcgtcccccaccgtgccgctgcagctcgggcagagccgccaagctttgggttctctagggtgtgtacccaggagtggatctgctgtatcatatggtcactctattcaacctttcgagaaaccaccaaattgtttcttcaggaaatgcaccatctgacatccccattttatgaggatccccacgtctctgtcatctcaccaacacttgtgctgaggaacctctaatcatctcccatggatttgtgatcagcgttgcagctctcccagcagccctggacagtggcccccagcagtcagcatgtggctgccgcgcgtctccagcacagcagtgaccgcgctcctcctggcgcagaccttcctcctcctctttctggtttcccggccagggccctcgtccccagcaggcggcgaggcgcgcgtgcatgtgctggtgctgtcctcgtggcgctcgggctcgtccttcgtgggccaactcttcaaccagcaccccgacgtcttctacctaatggagcccgcgtggcacgtgtggaccaccctgtcgcagggcagcgccgcaacgctgcacatggctgtgcgcgacctggtgcgctccgtcttcctgtgcgacatggacgtgtttgatgcctatctgccttggcgccgcaacctgtccgacctcttccagtgggccgtgagccgtgcactgtgctcgccacccgcctgcagtgcctttccccgaggcgccatcagcagcgaggccgtgtgcaagccactgtgcgcgcggcagtccttcaccctggcccgggaggcctgccgctcctacagccacgtggtgctcaaggaggtgcgcttcttcaacctgcaggtgctctacccgctgctcagcgaccccgcgctcaacctacgcatcgtgcacctggtgcgcgacccgcgggccgtgctgcgctcccgggagcagacagccaaggctctggcgcgtgacaacggcatcgtgctgggcaccaacggcacgtgggtggaggccgaccccggcctgcgcgtggtgcgcgaggtgtgccgtagccacgtacgcatcgccgaggccgccacactcaagccgccaccctttctgcgcggccgctaccgcctggtgcgcttcgaggacctggcgcgggagccgctggcagaaatccgtgcgctctacgccttcactgggctcagtctcacgccacagctcgaggcctggatccataacatcacccacggatctggacctggtgcgcgccgcgaagccttcaagacttcgtccaggaatgcgctcaacgtctcccaggcctggcgccatgcgctgccctttgccaagatccgccgcgtgcaggaactgtgcgctggtgcgctgcagctgctgggctaccggcctgtgtactctgaggacgagcagcgcaacctcgcccttgatctggtgctgccacgaggcctgaacggcttcacttgggcatcatccaccgcctcgcacccccgaaattagtggaggccacagttgtagcaggcgctaggcccgggaggagagtgcatggtgcagagggggctggggcgcacggagaagcaggtccctatattgaccaaggagtttgtggtacgacccctccccctccccaagtaggcaaggactgcacgtttctttctctcttgattcttggttttcctttgagtcctcatttcagggttcacttcaggggctcccaaagcgacaagatcgttagggagagaggcccagggtggggactgggaatttaaggagagctgggaacggatcccttaggttcaggaagcttctgtgcaagctgcgaggatggcttgggccgaagggttgctctgcccgccgcgctagctgtgagctgagcaaagccctgggctcacagcaccccaaaagcctgtggcttcagtcctgcgtctgcaccacccaatcaaaaggatcgttttgttttgtttttaaagaaaggtgagattggcttggttcttcatgagcacatttgatatagctctttttctgtttttccttgctcatttcgttttggggaagaaatctgtactgtattgggattgtaaagaacatctttgcactcagacagtttacagaaataaatgttttttttgtttttc

SEQ ID NO: 38790 - DNA, 3601 bp, Homo sapiens
caccgggcagcgccgagggttgccggccggcgcgcggggagtagagggcgcgggccgcagtgccgggttccagagggagctctgcgccgggtccttccctgtggtagccccaggacacccccagcctcaacatcccattctgggactcctgccctgttcccacattcgttctacctcgagtctccaggagcttccagtggcttggtcaccgccaactctcgtccatgcctcttagagcccctttcccggcctcaccgggtgtcgcttaatagtcttgggaccttaaggagcaagtcagcccctgcggaccctcccagtgaagagaaagagctggctgtgcggtggaatttggaagagacgacgtttgggagcctttgctgagtccagggagagaggcgtcccccaccgtgccgctgcagctcgggcagagccgccaagctttggggtgctgaggaacctctaatcatctcccatggatttgtgatcagcgttgcagctctcccagcagccctggacagtggcccccagcagtcagcatgtggctgccgcgcgtctccagcacagcagtgaccgcgctcctcctggcgcagaccttcctcctcctctttctggtttcccggccagggccctcgtccccagcaggcggcgaggcgcgcgtgcatgtgctggtgctgtcctcgtggcgctcgggctcgtccttcgtgggccaactcttcaaccagcaccccgacgtcttctacctaatggagcccgcgtggcacgtgtggaccaccctgtcgcagggcagcgccgcaacgctgcacatggctgtgcgcgacctggtgcgctccgtcttcctgtgcgacatggacgtgtttgatgcctatctgccttggcgccgcaacctgtccgacctcttccagtgggccgtgagccgtgcactgtgctcgccacccgcctgcagtgcctttccccgaggcgccatcagcagcgaggccgtgtgcaagccactgtgcgcgcggcagtccttcaccctggcccgggaggcctgccgctcctacagccacgtggtgctcaaggaggtgcgcttcttcaacctgcaggtgctctacccgctgctcagcgaccccgcgctcaacctacgcatcgtgcacctggtgcgcgacccgcgggccgtgctgcgctcccgggagcagacagccaaggctctggcgcgtgacaacggcatcgtgctgggcaccaacggcacgtgggtggaggccgaccccggcctgcgcgtggtgcgcgaggtgtgccgtagccacgtacgcatcgccgaggccgccacactcaagccgccaccctttctgcgcggccgctaccgcctggtgcgcttcgaggacctggcgcgggagccgctggcagaaatccgtgcgctctacgccttcactgggctcagtctcacgccacagctcgaggcctggatccataacatcacccacggatctggacctggtgcgcgccgcgaagccttcaagacttcgtccaggaatgcgctcaacgtctcccaggcctggcgccatgcgctgccctttgccaagatccgccgcgtgcaggaactgtgcgctggtgcgctgcagctgctgggctaccggcctgtgtactctgaggacgagcagcgcaacctcgcccttgatctggtgctgccacgaggcctgaacggcttcacttgggcatcatccaccgcctcgcacccccgaaattagtggaggccacagttgtagcaggcgctaggcccgggaggagagtgcatggtgcagagggggctggggcgcacggagaagcaggtccctatattgaccaaggagtttgtggtacgacccctccccctccccaagtaggcaaggactgcacgtttctttctctcttgattcttggttttcctttgagtcctctggagctgccttctcatcaggtgcactcttcatggaaagcaactcttgcccctcctcctctgggcacagggtgtgcgttcagatgacttggctcctactcaagggctttcttcccctttaactctctccttctggtgacacatcctgcagcagctgagggggtgccctggcactggctgggagtggagaggcactgtggtgaaatggctccagaggtctgtacatcacatacatatgcacacaggcacacatggcaaaactcggaagtgaaaggacttgtctgaaatcacatggtgagaaggaggatgaagggaggagagagcttttgctctgggtctccagtggataggagaggacctgcctcctgggtgagaagggtcagattttcctattttaattgctttagggaagagcaagcagagtcatgaccagggacacagctgagagatagaggaggctgtgaatgctgagaccagagtttatcatgctggacaagcctggaaggaggcaataagtgggaaaggtaggaggagagaaggctggggagggctgggcagcaagccaggcacagtgagtggcagagcaagagggggaaagcaggatcagtgcctggaaggcaggtgtgcccgtcagcggggagtggaactcatcaggcttgccaagaggttggaagggaaatggctctgggctggaactgtcttcccttggtccttctggtccaggccttggaggaaagcagaggatgatccctgcctgtgagccacacctcctagctctgggggcaaaggggcttagtaaaggaatgctggatgtgtagagggtttagtcccgagctcaggaaatgagagcctataagtgcccagtacatgtttaaaagaagagctcatggaacctctggaaaggacagggaagttgagttagccacataaatgaacccaagtcacattggaacacagagctggtctgggaactgtgttggctgccaacagaacttctgaccctgttacctgtgaaatgaggcagtttccctcacgttgccatcagctaccaggagcgatgctggtggtcactagcttctgatcctcatcctgggtgtggccacagattgggggaacctggattgtggagtcacatcctccctgcaaagcaagcagggcaagggagatctggcattttctgctttacgtggagggagaacaggcacattagccttgaagctgaagctcattttaggttccttccaggtttagaagcttcaaccaaatgaaacttgaatctgtccctcgtgacaattataggaggaaggtatttaaaaccccagatttatgaatgtgtactacatggcttagagaatgtctttgttcttgttcaggtggttataacaaaataccttaagagtgggtaacttggctggatgcagtggctcatgcctgtaatcccagcactgtgggaggccgagggggatgaatcacctgaggtcaggcattcaagaacagcctggccaacatggcgaagcccctcctctactaaaaatacaaaattagcgaggcatggtcgcacatacctgtaatcccagctcctcgggaggctgaggcaggagaatcgcttgaacccaggaggcggaggttgcagtgagccaagatcacgccattgcactccagcctgggtgacagagcaagactccatct

SEQ ID NO: 38791 - DNA, 381 bp, Homo sapiens
gtggagattagatcttaaatgagtgaatttgaatcccactaatttgtacctttgtaaaatgggttgggaatgagctgtttccttgtgaaggaaagattagttaagcaaatttctgtgtagggaagctttttctgtaatgagaataaactcttccagtgctctcaggtaagccagagccttcctttgtaggtcagttgtgcctgcttctctcactttactgtagtgtgactttagtctaaaacatgtctttagtaacaggtttctgcctttcttgagataatttggggagcttttgtttaaatgctatcaagtttgaataattttgggggaagtatttttgcttctccctggtttgcttactgatttcgctgttgaaggaga

SEQ ID NO: 38792 - DNA, 319 bp, Homo sapiens
tttccgtgggacgcagaggcggcagagaggaacgtcgatgatcctgaccctgtgcgggcctaggctcatgtctgtgtcgttgtcttcattgttatcaaaaaatgttttaagattttgaaatattaaatataaagaataggcaaaaagtttatagaatatataaacaatattttatacagctatacaatgtgttttaagccaagtactatttgacaaaagagtgaaaaagttgaaaaatgttaaagtttataaagtaaaaaagttacaataagttaaggttaacttattacgagaaaatacatttcagtacattatgtta

SEQ ID NO: 38793 - DNA, 414 bp, Homo sapiens
caggaggaggaggggcctggaaaagtgtagtgggtgccactgaaagatcctaagcaggagaggaaggtgatgtgatttaagaggacagtggctgttgtgtggaggacagatcggagagaagcaaaaggaaacgggaagacttaatggacagaggctactgtagtcctgaactgagacaagactgccttggccagtggagatggagaaaaacagtaaaagatacctgggagtagtagaaacagttaagttccagatcacgcatgcccgttgcgcggcaccctggccaaagagggacagctccccaagcgcagggactcagcttcctgtgcactgtcatgacgcactgcctgacccaggggtgcagtaagtccctgctgactggatgtctgaatgcagcacttgcagaactttgtc

SEQ ID NO: 38794 - DNA, 1412 bp, Homo sapiens
aacctccacttggctcagatctaccccctctcacccccaacactggcagtggcatctcaggaggcccctgccactgttctcaaaacgaaattttcttctgtgattcctttgtgttccgcatgcgtcattcatgagacaggcaagagccccggtttgcagagaaagaagtgaagtggtgtacccactgtcatacagaacgctgacgctctccaggtttcttcaggccagacctcatattctttttggtgaccctgccaggtcctggttcaggtagggctggggtcttacctgagggtggctgtcagtacggggcagcacagagatgtcataggcagccgtgaaggggttccgcccctcctggatcttcccataacgctcgcgcttccgccacttggctctgcggttctggaaccagacctgggggcaggttgtgggggtttgagggggtgatagggcagccctgaggaaaggagcctgctagggagagctgatggttgtgtcctcttgtgggatggggagcaggctccaggatggaggatctcaactgttaatccacactgttctccaggccagggaagcctgggaggaagcctgggagaggcccaagcccacagtgggtaattggccccatgggcctccagctgtcactccccaggttgaatcactgtggtcctccagcctggctgtgtctagtaagggtgttgtgggggcatctgtgggcctcaggggccctaggtacttcctgggtatactgtgtacatgtgttgggtttctagtctccctgcctcatctccttttccaggctacccacctcatagcatccgaggaatcttagacatttctgttcaggtcatggtcctgtttaaaccctcagtgactccctggagaccttggtccagagcatagcttcttaacaaggcccctgcctctctgcacagcctcatatcctgccaggcaaacacatttattcttctggttgcctcccaagctcccgcccagctcttctgaaacactgctatcttgctccttccatcttttgcttaggttttctcttcctgggctactcatcccctcaacacatacatccacactgggcatcctccacaggacttccaaaataccctggacctctctttgtactcaccccattccattaccatgatctgttttggaatctgtttctcccatttatttgtgagcccttggcagataggggtggcacatctgtgtgttgtgcacatctgtgtacatatctgtgatgaattcgttgtttggtatatgtgctgtgactgttacatttaactgtattggtatatatgttttgtatttctatcatttaatcaacatttatgtgtcagcctctaagctaaatttaacaatgtcaaaataaaaccaaccaaacaaaacaaaaa

SEQ ID NO: 38795 - DNA, 379 bp, Homo sapiens
acagttttgatttctcttattcagtagctcactaaatcccatcagcaattctttctcagaatacttcaataacatcagatcatcagagtaggtttttctcattaagattggaaatatatgatgtaagcaacctaaaattatcatccttctgtgaaaaacactcgataggaatttattttgtaagctggttcttgctatcccactgttacttttcagttcacatagctcagggtgcatgaaagttctgtgggaggctttttggtataatgaattttacttcatgaattttacttcatgtatacctgtaatcaaaatgagctgcttattgagatcgcaccattgctctctaccctgggcaacaacagcgaaactccatctc

SEQ ID NO: 38796 - DNA, 1080 bp, Homo sapiens
aaagtaagcacttttacacaagataaactttctgccctcaagaataaacaatcaagtgaaggaagaaatacaagtttgtggattatagcaatataattcaattttatagtgccaaataatgctatttctccctaatagtattctgcgataagagatccttggagatgttaagaggtgacaagaaaaagttaaataattttacacaatggaaagcatattctcttctcagagacattcacattgttatataaaaggctctggaaggtttgtcagaagaaacgtatattaaagtttttctaacccaacattttacaagtaatttgagcagagaacgattctctcacaacaagatcaagatgtggtggctcattaaatcagaaataaatgtattaaataatttaatttccactgaaagatgagaatacgcataaagagagaaattcgaattttaagtggacattataaaatggggaatattttgccgtagaggaatgtggatggaaaccaccaaaggtataagaaataccaagattagaaaatgctggtcaggctgggcactgtggttcattcctgtaatcccaacactgggaggccaaggagggatgatcacttgggcccggaagttcaggatcatcctggaaaatatgtcaagacttcacctctaccagaaatttacaaattagctgggcatggtagaatgtacctgtagacctagctacttaggtggaagaatcacttgagcccagcagttcaaggtgacagtgaactacgatcaggccacttgattccagtcttggcaacagggtaagaccttgtctttaaaaaaataaaaagcaaaaaataaaatgctagttatattaggaaaaagcctgactgaggtccaaatgcatgcggaagactgtttcagcaaaggtaacatccctctatgccacagcttgattgaattttaaataaagatgatgataaaatgtacatttattaaggagataattgatgtaatgtgctcagtacaagttttggcatattacaagcattcaataaaccctacatcttattatcattaaaatattaatacatatt

SEQ ID NO: 38797 - DNA, 441 bp, Homo sapiens
ggtcagaagtataattcaggatctaggttctttagcctggttatcctattggccttcaagtattagaaagctttaataaccagtttttattttccctttggttgtcttaaaactcaaccaagaaaaagcaaataaactcacttcaggaattaaagaaaaaaggaaaacaaacttcaacccacatctacacttaactctagttccttcatctctgaaaatctgttaaagatcctttttttttcctagataggtttctgttataattaatgataaaattttgttaaactgaatatcctatcctgggtcttgttgtgttgtgaattccattttttttggtggtggtggttgtgaagagccacttttaaaatccaaaaaaaggaaaaaaacacagtagtttcttttctttttcattgaataaagaaaatttacagattttcaaat

SEQ ID NO: 38798 - DNA, 427 bp, Homo sapiens
ggccgctgtctcagagatatcaggtggaagaagtttctggtccctgtgcctcaccctgcaccctgcctctgatgggctgtgtgaccttaagcaactttctcaggctctttgtgtctcagtttcttctaagaaaatgggaggtgggctgggcgcggtgctcacgcctgtaatcccagcactttgggaagccgaggtgggcggatcacctgaggtcaggagttcaagactggcctggccaacatggtgaaacccggtctctacaaaaatacgaaaattagccgggcatgatggcgggtccctgtagtcccagctacttgggaggctgaggcgggagaatcatttgaacccaggaggcagaggttgcagtgagccgaaattgggccattgcaccccagcctgggtgacagagtgagactccatctcaaaa

SEQ ID NO: 38799 - DNA, 1131 bp, Homo sapiens
gaggaaaatagagcaggtaaaagtgattgggaaacctaggcatcattgagaaggtgacatttgggcaaaatgtcacttgaagagtgagaaggagtgagccacgtatttatatctaggggaagagcatttggggcagagagaaaaccagtacaaagactctgaagcagaagcatcagacctagtatgttcaaggatcttaagaagaccagtgtagcgggagtggagtgaccagtggagagaagagtagtagataaggtcagccaggaaattgaggaggatatttaaaaggaaaaggttatttctggttattgtgttgagcatatgccatcagtagaaaccagaagaacagttaaaaagctatggcagtaagaaaggtgagaggtggtggtggcttagacaaggatgggagcagtggaggtggtttaaaaaaaaaaaaagtgatgggattctagatatatatttgaaggtgcagccagtaggactttataagtcttagtgcctgaccatttaaaaattgtgatgtttgtggccctttttcttaatacataatttaagatgacagtaggtcatcgtacttatcacgtcttttccattctcatgtttctgtacacaaggagctggcatcttctgaagaatcttatctaaactttttgggctttttttttttttagagaaaatcattagtcccattcttcttttgaatgctacttttccttctctaaaaactgaccatgaattatattctcattcatcaatttcttatttctttgtcagaaaagcagttagcattttttattattatgcaagtattcaacattcattgtaaaaaaaaaaaaaaaaccaaacaggcagaacttaaaaaaaaaaagtatacagactttttcatctatatcaggattgtctcttgcttttattttagtttctttggcaacagatgaggcaatagaacatgctaagagcttggactgaaattgacaagtttttgaatctctctaaatctcagttttctcccttgaaaacgggcatgtttaatagaacctacttcataggtttagtatgaagatttaatgagatcatgcagagaaagtacgtagcacttactagcacattgattggcacctgagaaggccc

SEQ ID NO: 38800 - DNA, 387 bp, Homo sapiens
tcagaaagcttatactcacagcagaagatgaacggtagccagcatatcacatgctgagagtgtgagcaagagagagagaaggaggtgccaggctcttttaaacatccagctctccttgtgaattaacagagtgagaactcactcattatcaaggggatggtgctaagccattcatgagggatctgccccatggacacacatctcccagtaggccacacctccaacattggggaatcacatttcaacataaaatttggaaaggacacacatgtaaaccatatcattcttcctctggatgcccaaatttcatgtccctctgacattgcaacatcatcccttctcaatagtcccccaaagtcttaattcgtttcagcattaactcaaaac

SEQ ID NO: 38801 - DNA, 455 bp, Homo sapiens
aaaaattgttcacattttcaatgcataggcaaaggcatgtcgaaatattcattatgtgtgtacagaattccctgagttagtagggctctacagagccagttagtaagtgaatgcattatgctatcaatattaggacttttttcctaaaggatgatgaaactatcatgtatgatactcaagtgatggatacacaacagcatgcatttgtcaagacccatacaatttatagcacaaaaactgactttaatatacgcaaatttaaaaaattatttgaaaggttgggagttctcagaatgaaatgcatactgtgacaaaagaatctaactgcataacatgtacaaaacaatctcactaaaaaaataaggagaaaaggttctggcttaagaaagtttgaaaatgagtggagtctgtaagactaacagcaaataaacttcatgtaagtattgaactttagt

SEQ ID NO: 38802 - DNA, 430 bp, Homo sapiens
gttcatcaaatcatttaaacattataattatatttgtaatgaaaattattaaatttacataaaaaatatcgagaaaaattctcttgcgtgttccaaagttagaaaattagcttgtggcaggcttagtttagtttcgtttacccaaacaattgtactgtttgaattcagatttttctcattactactcttagagtaagtgacttggaaaaaaagaaggaaaccagcctgggcaacatagggagaccctgtctctacaaataataaaaaaattagctgagtgtggtggcacgtacctgtagtcacagctagtttggaggctgaggtgagaagatcacttgagctaaggtgtttgagattagagtgagctatgagcatgccactgaactccggcctaggtgacagaatgagaccttgtctccccaaaaaaaaa

SEQ ID NO: 38803 - DNA, 552 bp, Homo sapiens
tcttcactttctccccagaagagtgtctttcccatctcagcaaatggtatcatcatttacctagttcctaagctagaatctcagagtcattcttgactcctgtctccctcaaaggcccacacttctactgtcaggtcctataaattctgtcttcaaaatatacctcaaattcttccactttccatctccactgccagcatccaggtgttaggctctgtcattgttcaactagactacaacatagttttcatatctattccactattaacaccctctcattcattttcaacacagttgtcagaataatcttttaaaaaaatctatgtgaagtcctccaagaacttcctactgtacttagattgaaacaaaatccacactcatgaataaagcctttaaggccctgtgtaacttttcctatcctaccttcagcttcactccaattcctctccccgcaacttttggtgttctggccaccctggccatctagttccttcaccacaccaagttcttttgctcccgcaaggcctccatatattccttctgctgggaatg

SEQ ID NO: 38804 - DNA, 424 bp, Homo sapiens
gatttatatgctggcgttgatgtaggacagcaatcaggcaatgttttctgcctttgacagttggtgtgatagtttgcttccagtgaagtttgactcactgtatctggaagctgtcagaagtgggagcatgaaaaggtcatgacggatggctgtggataagtggttaggggagggagctggtaagggagacaaactgcctcccttgtttccaagagaaggggctgaccctggctgctcccggccagcccccgtgctcttttcttccccacctgcctgagctggaaagaagcctgccgggctccagttttgagaggggcaccaggttgggtgtagtgtagctcatgagcccttcccagcagcgcaacccctggcataccactagaactgctagaagttctgttaaagaaattctgctaaaaaaaaa

SEQ ID NO: 38805 - DNA, 1677 bp, Homo sapiens
  misc_feature (1068)..(1068): n is a, c, g, or t
  misc_feature (1147)..(1147): n is a, c, g, or t
  misc_feature (1149)..(1149): n is a, c, g, or t
  misc_feature (1151)..(1151): n is a, c, g, or t
  misc_feature (1153)..(1153): n is a, c, g, or t
  misc_feature (1155)..(1155): n is a, c, g, or t
ataatatagcttaacatagatataacccccaaaggactagtcaaataagtggatgaagaggactgaaaggggctggtctagatgggtttagaatccctagaagactaacgggctgttggtccttcggtcagttttccatcaatagtgttctcagtggagggtttgatgtgaatctaggaaccaggaggtctaggttattgtcccttagaagggtagctattgggcagaccatccggccaagagacaagtaagaatgacttcagagaaagcaaaacaggttgatgaagtcgtcttcctttgccagtggttggctgggcatatacctgtgaatggggccaacagtttcctccaaacacaacctggagttgtctctacccacaggagtaattatgccccaaattctaacccccataaagccaggctgcaaaagttttcatttagaatatttaaaggtgaagctgggcatggtggctcatgcttgtaatcccagcactttgggaggctggggtgggcagatcacatgaggccaaaagttggagaccagcctggccaacatgttaaaaccctgtctctgctaaaaatacaaaaattagctgggcgtggtggtgcatgtctgtagtccactgtagtcccagctaattgagaggccgaggctcacttgaacccgggaggtggaggttgcagtgagcccaggttgtgccactgcactccagcttgggtgacagagtaagagtctgtctcaaaaaataaacaataaaaacaatatttaaagctggtttaatgacatgccgacctctgacactgagcaagtggcctctcatatatttaagatacattaagattaactgctggtcgtggtggctcatgcctgtaatcccagcattttgggaggttgaggcaggtggatcatctgaagtcaggagttcgagactagcttggccaacatggcaaaatcttgtctctactaaaaatacaaaaaattagctaggcatggtgcctttagtctcagctactcgagaagctgaggcaggaacctgggaggtggcggttgcagtgagccaagatcangccattgcactgtagcctgggcaacagagtgagactccatctctctctctctctctctctctctctctctctctctctntntntntntatatatatatatatatatatataactgtttgttttttttttttcatggctgggtcagggttggaagtgggcccaggcagctgccaactttaagatatgttgattgtaaaatgtacttcttgttaaattaatgaggtgacccagtccatcagtattttaactatgagccagtagattggttcacaagcatattaaaggccaaacctaaaaatggcttcagtctcattgcctctaggttcttgtgttcattctcgctggacacatttccatcagtgcaccctaaattaatacaacagaggatcaggttctcccacgtttgggtgcttagggactaggaaagcaagaccatggttggtttagtagcaaactgtgtggaatcatatagactacaaagagtcaaccaatattgccttgtcttcacagccagaaaacagtcgccggaaacgtagtgagtactggctaacagtactataaaaaatagtataaatactatattatattaaaatatcctatatagtatta

SEQ ID NO: 38806 - DNA, 848 bp, Homo sapiens
tgtcgcctccttctcctggtgtccatttctggaactgctatttgtatattgcatgatattttatcaggaaaaaatataaaacagatctaatttcatgaaaatgctgttgccataatgctcaggagaacagggggaagagagagattcaagtcttcctaatgtctaccttatatgcagagccttggaaagatgggcaaatgctctgtgacaagccaccagggtagactggtactgaaaagaccctactacacacaggggctctgtccctggctggaaagttacaagtcagcctacctctctgtgatctggtttccacacctactactctttatcccatgaggagcttctggaaactaaaatagcagctgcccaggtagaagagtgttgaccaaaggacacatcaccagcacagactgttaatcatgtgactagagaaaactctcatggtggcattcaaatttccatatccttcttctatggaaatttctgagagacccagaaaagaagcgtaacgacgagggaaagtgattcctgcagacctgaacattccagacttaccaggtgatccagctgtctgtcagcgggaagaggctgaggcgcccccttctggtgcatctgaatagtaagaaaccctgtgtagaaagaaaccctgtagcaattgggcaccttctccgtgatctgtctgcttccaataccaaaaattgttgctttttaaatgacatccatcctaagcttaaaaaagacgcatattatttgtataaaatgttgaagacgcagaacaaaaaatgtaaatcacatgtaatcatcccttccagaaataatcgttattaaaatttctgtgtatgtgt

SEQ ID NO: 38807 - DNA, 811 bp, Homo sapiens
tgtcgcctccttctcctggtgtccatttctggaactgctatttgtatattgcatgatattttatcaggaaaaaatataaaacagatctaatttcatgaaaatgctgttgccataatgctcaggagaacagggggaagagagagattcaagtcttcctaatgtctaccttatatgcagagccttggaaagatgggcaaatgctctgtgacaagccaccagggtagactggtactgaaaagaccctactacacacaggggctctgtccctggctggaaagttacaagtcagcctacctctctgtgatctggtttccacacctactactctttatcccatgaggagcttctggaaactaaaataggtacttcgaatttcattgttgcatcgagccagctgatttgggagttgagttcctggataggcatactatccacagtgttttaccagagtgaaatcacaggataggctcagctgtaacaaactatatcaaatctcagaagcttcaaaagactaaggtttatttctcactcatgccacccgtctactgagggtcatgcggagttctgctgagtgatgttctccatccaggatcccagccaggatcccagctggtagagcagcctccacctggaacattgcctaagatattggaagggtacaccaaggcaatggtgaagctcaaagtggctcctaatggctggccagaatcagcctttgtatctccttggccaaagcaagtctcatgaccacagctaattcccagcaggtgaagatgtgatttcttccatccagaaagacagaaagccagaa
